United States Patent 8,781,750 (CELL-TYPE-SPECIFIC PATTERNS OF GENE EXPRESSION) - sequence listing, part 30

SEQ ID NO: 36980 - DNA, 105098 bp, Homo sapiens
gcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtggtgagtgtccgcgaccggccacgcccggcccccccaccgcccggggccgcagcggacgcagcctcggcctcgcccgcgcctcggcctcaggcgccgcggcgacctcgaacccggacttcaccgcggtccgcgcgccagggctcgggcgcggccccgggccggttgaggtttaggtgttgttgctcgcggttcccgggccttcggtcgctcgggaaggggctcagggagtggcgcggggggcgtaggccggtactagtggacccttggccccgggcgcagcgcggcctttaaagtctggaccctcgggaaggcaacggaagggtccccacccctcaatttgctagtatcatggccttcttttggactttcgattgtaaaactgtgaattccatcagatgcttgtcggtgttggcggcggtggctgctgaggtcctgaaagcgttttgcctccgcgtgtgtgcagaacaccgaaataatcgtttttctctcttcgcctctgtttgcagccaacggctttcattaaatatcctcagcggtgctaatggtggtctccgcgcaggctttctaaaatggattactgacgccagtgttggtggcatatttccgtcttgaagtttttacttctaagtggattttaatatcgtactgctggcgtttcaggaaggataaactaacattactctcttgatttgttaaagatccgtttagagttgggcctaatttgactttttttttagcccccaagtgagctcttttaccagcataaatgctcccagatgttttagcccaattgctatggactcctgttaatgatttagtggtcattatgtatgcagccttaatggagttcttgcagaatcacacgtagactccctcatcttgattcaggtcccttagaaaagtgaaatgatagtgacggttttttttttccccccgagacggggtctcgctctgtctccaggctgaagtgcagtggcgtgacctcggttcacttcaacctccgcctcctgggttcaagcgattcttcttcctcagcttcccgagtagctgggactacaggcgcgcgacaccacacccggcccatttttgtattttttagtagagacagggtttcaccatgttggccaggatggtatcgatgtattgatctcgtgatccgcccgcctcggcctcccaaagtgctgggattacaggcgtgagccaccgcgcccggctgatggtagtttttattagagcaaactagcgatagcattttgtgctggtgaggacttgtggaaatagatttccttaaatctgaatcttgtgaatgtgtcttttgtgttgactgaagaaagtaaactaataatttattgaacccttcgtggcaggtactgtgctacatatattatttcattttatttgagcagccacattgagggaggaaaagatggtgttattccttttttcaggtgagaaagtatttcgaggtgaagccaattcttgaggtcatagaactagagttattaagattgtagactgagattctactagacacactgtagctcttttcagctgtttttaggaaaacactctgcgttccttagtgtaattaatacttgcagaattttctgtatcttactgttataaagtaaatataagtctgtttcggaaatgtattcaaatttcaatcataattttagaaatgccatagaaggtatgttttaccaagtattgtagctagatagaaagattagttaaaattctttttaaagagattttaattgaatctttaatgttttcactttgtttaggagcaaaatgctgaatacaactgtgaaaattaatgtgaactcacaggcttaggagccaagacagaatttaaattaggtcgagcctgaaagaaataaggccctaaaaagtaatggagagaaagtattgccagtagcatcatttctccaccacacatcgcattgctgttgcactcactgggaagtgtgccagtgaacatgtctcattatgagaggctcagaatttcccatcacatcctttggcccttttaacaagattagcttatctaaaatgtggactgaaaaaagtattttacgtttaggacatgtcaattgaaaagatacccccatctgataagatttctcctgtctgataaggtttttactagtctgaagttgtttagatgtgggaactacttctgtcactgctgtaggcttgtttgaccttctgactctccatttgaaatgctaagtcccctttttgtgattgtcgtttcctaagtgaaatacaaatgtaattggaatttgaatccaagatccagattatagccttttatcaggttgatgaaataccctgctgttaaccttctccattgcacattattagcatttaataaatattggctaacagtgctggatttatggagggctcgttgaaatattcactaatatttgaatggtgatcttttaaaaaatgcttccaaaaggatttatggatttctagccattttttagatttacccccttctgtttccttatcagttcattaggaattgtgactattttgtttagagtcctttcctaatgattatgtagaggatgtaaagatgaagagtgggatttgagttgggcctttaagagtgggtgtgattttgatatgcagataataggaacaagtgacagcttgagctgtggaatctaatcttggaaatgtacttaggtggcaaactgtagaggactccaaaggcaaaactaagtttgactgtatatttgttcagtggaggaagcatcttatttatttatttatttgtttatttttttttttgaggtggagtctcactcttgttgcctaggctgtagtgcagtggcatgacctcggctcactgcaacctctgcctcctaggttcaagcgattctcctgcctcagcctcctgagtagctgggactacaggcgcgtgccaccatgctcagctaattttttttttgtatttttgtagagacagcgttttgccatgttggccaagatggtctcaaactcctgacctcaggtggtccccctgacttcagcctcccaaagtgctgtgattacaggctttagtcaccgtgcccggcctttttttgaaagaggcagtcatacatggtcaattttgaaattttttgggaagacaaatcaacactagtgggaatgaaggaagaagaaccggagtggaggaataaattaggaaagcctaaccacctagaggtgcagtaataaagtggcagcggaaggtagcagatggaggtgaggagttttgtattgacagaaatagtaacagggacccttgtgggaagagtggtaaaaagacttttaatcatggcaagtctgagtggaatcaaaggattatgagaccttaaagggtaagagaccaagagaggtgggatttggatttggagggatttctgagatagaacaaggcttgctggttgattggctatgggcggttgttcattctgaggcctctaggttgggagcctgggagatggtggtgccattatccaagtaaaggaatactgttagagcagatttgtcagggggaaatagttctggtttgaacttaagtttgtaatgcctgtaggccattcaggctatatccagaaaccatcttaaaatttgtaagaggggagcaggagctggagatgaaaatttgtgtaaatggtagttaaaatcttgagtggatgagcacagattcttatctgggtcattggttaggtgaaattgcaatcatggccaggcgcggtggctcacgcctataatcccagcactttgggaggcccaggtgggcggatcacgaggttaggagatcgagaccatcctggctaacatggtgaaaccctatctctactaaaaatacaaaaaaaaaaagtagccggccgtggcggtgtgcgcctgtagtctcagctgctggggaggctgaggcaggagaatggtgtgaacccgggaggcagagcttgcagtgagccaagatcgcgccactgtactccagcctgggtgacagagcaagactgggtctcaaaaaaaaaaaaaaaagaaattgtaattatatgttttctatatttatctttttggttaaaaaatacatagcatttgatagattttcaaatgagtccattatcctggaaacattaagaaccactgaagtagaacagaggaccaaccaggtaactctggcaaagaagaggaaactgatgactggtcagatgtataagggaacagtgtagacggggaggagggagaggaggagagattgaaacactcttagtatgcttggtcatcttagactaagatagcaagtgtctattttggtttaattgagtttgaaatgctgtttctgaatgcgacaagagagctcatggggtcatcttcatagagatattaattgaagccttaagagtggataagacatctgagaactaagccaaaggagtgcctgcctttactgtgtcaataaaggtcaagttatggaagaggacagaggaaatgtggccagagagaccaaagaactgggagtgcacgttatcaaaggagccaagggagatggtactcattaagggattggtattgagtactataggagggaaacagaatgcagctgacaagccattatatttgttgactttcagctctttttttttttgagacagagtcttgttctgtcgcccaggctggagtgcagttgcacaatctcggctcactgcaacctccgcctcctgggttcaagtgattctcttgcctcagcctcccgagtagctaggattacaggtgtgtgccaccacacccggctaatttttttatttttagtagagacggggtattgccatgttggccaggctggtctcaaactcctgacctcaggtgatccccctgcttcagcctcccaaagtgctaggattacagtgtgaaccactgtgcctggcctcttttttttttttttttaaagcggggatgttcaacttgggaaagctgaatgaataaaagaaaaaagagggggatggtttcaactaaaatttcattgtgatcacattcctgatggtacaatgtcctcctgtcttgttaaggttattgtgattatagcagactagtagaactaccactttttcagcactcttgttttgtattttacatacattaatgctaagccatataactgtacagcaaaagtggtaacttctgtttgttttttaccccacaagtgaagaaacttgaggcacacagaggttagttaacttgcccaatgacacacagctaggaagtgatgaagcaaccccagtttttctggttcctaagtagtgctccaccaaagatcagagttgagaaaatagattatttcagtaacaagaaatatctgttgtctgcttttgcttgtatcactttttagcctttaaaacctttcatgtagagttatttactcagaaaatgtttattgaactcttcatccaaataatgggatggaattggggaataatacagagaagataccagtgttacccaggagtttgtgaagtgctgagaggaagagaagagctgagtgacttggggctgtctttctttggcttcccagacttctgagctaggtgttgatgtgtgagtaggagtttgccttgagaaatgccttctaggcaaagcgaagtgtgcatgtaaaggcacagaccgtgaacacagtgcatcaggtcaggaaaaccacaaattacttgggaaggctggagtgtagggtgccttagtaagaaggtgggagttgagacagctgggggtaggcagggccaaatcctgaagggcattatttggtaaggactttggacttgatcttgtgggtgacggagtcattaaaggatggccctgtttctgtctgccagttccactcccactttatctcttatgctttctgcccattttgcctacttacttactttttttttgagacagagttttgcttggaggctcactgcaaccttgcctcctgggttcaagcaattctgcctcagcctcctgagtggctgggattacaggtgtgtgctaccatgcctggctaatttttgtatttttagtagagacaggatttcgccatgttgtccaggctggtctcaaactcctgacctcaggtgatccacctgcctcggcctcccaaagtgctgggattacaggcgtgagccattgcacctggccgcattgtgcctactttatctcgtggtactcagtgggggtgattttacctccctgctacagaggcatttggaaatgtataggggggcggctttttgttgtgttgtcacgttgattagggggtgttattggccgtcagtaggcatgtcaagggcagacatgctaaatggtctggattgcacggtacactccctccactggagaatcatcctgccaagatgcccatagtacagcaccccagcctgccccaagaaacatcaggctctatttaagtcccgcttttctctaaagctcatctctatgaactttgccctattgcttcctgttaatgcactctcttcatggatctctgctgggtgtttgtaccacctgtttgaaaggcaggaacagcaataacatatatcatatataaaaactctagacctggagacagagatattgagattcttaattttgcttgctcattgtttacttaacttttttaatcaagaagtctcctctacacttttggagctcaaagatgcaaggacagcagcttacatgagtaacagaagaatctagtgtttctgagcagagtttagagtaaaaggataagtcaaaacaaaattaatttttatattaatagcatccctaatgatgtattcctggtagttagctataaccattacaccattcccataatctgatttgtgtaaattcaagttgacttttccccaaaactgtatgtaatttattcctcaccttgctcacaatttatatacctattaattgaaaaacacctcattccccaacaaacatctagagctccttgcctccggcctactccacccaccctcttgcctaatcctgagatgctattttgctcccctttagatttgctttttttctttcacttcttgaggctcccacactgaaaggtgcctaggagctcatccagtagctgcgctgtctctgctccctctaggaaaggccacctgcctgagctttgaaatggcccacaccgtaccagaaggaagaagagagattccaggaggattcagacgttacccaggctttctggaaactgagcagaaccacaggaggagaaagctataggcagctgaacaaaatttatgtgtttctatttcccctgctataacatgaaaggactgggctctgtctgtggttttcaaatctcctcctctcttaggggcttcaggcctcaccccaaatagggaaacttcacatacagcattctctcccctaatccctgttttttctattctttgctcttctcttatctacctccttcccctcccgtttcccttcttcctctgcccttagtcttttttctttttcttaatttccttttagtcattatcatcttcagttcacataggtagtaactattagggttagcagggcaagatcccatttggaaaaaggatttgattgctttgaaaatgatgttgggcaacccacaggatagatggtctccaaggtccctcccagattctcagactcaaggcaggccctggggtttgaacctatggccagtaggagctggatagcaggtgtctgcatggataatatgccatgatcaactgactaatgttagttgcaagcctgccttgctggtttaagcttcattctcattcttgtctttttttttttttttttttttgagacagagtctcactctgttgcccaggctggagtgcagtggcgcgatcttggctcactgcaacctctgcccccaggttcaagcagttctcctgtctcagcctcctgagtagctaggattacaggtgcctgccactgtacctggctaagtttttttttttttttgtagtttttagtagagatgggctttcaccctgttgcccaggctggtcttgaactcctgacctcgtgatccattcgcctcagcctcccagagtgctgggattacaggtgtgagccaccgcgcctgaccgtcatccttgtctttgaggtattatattttgcactttacacataagggaactgggtgtcaggtaactcgttcagggttcacagccagtaagtatattgcagaactgagatgtaaattgagatttatgcagaccccaaatcctgtgaccttttttcttttaactactataggcttttctctgttataccgagttacctagaaacgtacttcctacagcctgggttcctgaatggattagccctaaagtataaaatgattatgccattgcagacagacctgaagaagaggctagaaaggattagagttaaagtaactttgttttttgtttttgttttttctttatctccaaaggatctgtcatctagcaacttaatttttatcaggaagcagtattgatttcttcccattccttctagttacctctaccagtttcttgattttcattcatttaatattattaaacacgtaccggattatgtgctaggcagtaggaacaaagtagtgaacaaaagttgttcttactctttggtgtttacagtccaacagggcagtaataacatttactgagtatggtgaggtgtggagtgccactggatgatataagatattctgagtagtcatgaagggtttccgggaggaagtggtgtttaagctgggacctgaaggaagacttagagctagctgggtaaaaggtagggtagagtgctggaatgttttaggcactactttgtagagactgcattatagaaaatgaaaagtttatgattaagatctgggggcctttgtcatattactgcaaggatagaaagtgcagttaaagctttaggtatagttggaaccaggaactggaaaatagaccaacgtagctacctccctccctctttacagttacaaaagcttcttgtaccctacatctctcagcagctggattttcccccctcttttctcttttgtcacttccccatgcactcagcagaggagagctgaccctagctccctgaaggtatgtgtcttcaggttttttgatgaccagaggctgagaacactctgaatccaattccaagtggaacagaatgtgtaaaaacactgttagggagatcattctgcacagaacagctcactccacctggcctttccagcctgggagagtgtctgcctctggtctagtcagctgaggcccaaggtggggtcatttattaaataaagctgcatatctcggaatgtctaaagggcaaggtgggaattgtcaaaaggggtctcattgatttctgacttgttaggttaaagttcttggtactgttttccctgtcattctccagggagtgtgtatcactctccggtttttacagatgaggaaaatgaaacaaaagttgggtaacttgccagtcacaagtaaggggtcaaaggattgtcatgagtattaaataaaacagtatacttgaagtcctgagcacttggtacctagttaatgctctgttattcctttgaagtaaacagggttgacaagatgtgaatccccctttgtctcggtctctatgtaaagcagcatgtgcagaagtacaaatatttggcttggtggtcagatgactttacaatggtatggaagtgatacacatgcagtagaaaccttacttccgagtacccacgcaactgttctgtttttcattttcagtatagtatttcatacatcatatgagttactcaacacttttattataaaatgggctttgcgttagatgattttgcccaactgtaggctaatgtaagtgctctgaacatgtttaaggtaggctaagctaagctgtgatgtttggtaagttaggtgtattaaatgtattttcagctaggctgggtgcaggactcatgcctataatcccaggactttgggagaccgaggcatgaggattccttgagcttaggagtttgagaccaatctaggcaacatagtgaggccttttctgtactaaaggtactaaaaattaaaaaaaaaaaaaattagccaggtgtggtggtacgtgcctatagtcccagctacttgggagcctggggctgaggatcgcttgaacctgagtggtcaaggctacagtgagccgtcgtcgtgtcaccgcattcccgcctggcaacagagcaagaaactttcccaaaaaaaacaagcatttcaccttatgaggttttccatttatgaagggtttattgggatgtaagtccatagtaagtcaaggagcatctttatatagttagaatagggacagtcaagtgtttcatgcataatccaaatcttcaggaggcaacatcaaggtaacccgagtttagggatattctgcaaaataactggcctgtaaacctcaaaattaagtcaagatcatggaaccaagaaaacactgaggaattgttccacactaaagaagtgtgcagaaacatggcaactccatgtggttcatgattctgaatcggcatgattggcaaaactagaatgtctgaaaattagattgtagtcgtgtatctgtgttaatgattttatttttatcttcttttttttttaactcttcttttttttggtattttcttttttgttttggtttgtccttccttttttttgttgttttttgttttttgttacaaacccttgtgtcgatagctgactgctctgctgtatacgaaaccctgacccagaaacaggttgtctgtgaatggtttagcacaggtcccccgtgaatgtgcattgtgtgacgggcaaaagtgtggccgcctttctactgtgccaagttttccagcatgagaggctttccatatctggtcctcagatatgtggtgtgaatgaaggggggaccagctatccgaggccaaccgaggctccacagttggctgccatgtcattttgcctgggcgggattctgacttagaggcctttggtcataatctgacaggtgagcgttgacgattttgatggtagcattttgtttgtatgggagaatagtctagttttgtttgttggaaatagtcactaaagtattgggggataatgagaaagaaatactggcaaacttactctcacatgcttcagagactaaaagtttgataagctagatatagaacttttcctatggtttgagatatagttccttttctctaaagagttgtcggtgagtccctttcagaaacgtacttgagtgaggatgtgttgaaatttgtgggaagctgtgaaaggcagcttttagcctaccaaaagaggactggcctggaaggcaagagacctgagtcttggtccctgcttctgatgacatgtcacatgggcatgtgctcgtcactctgcttctgcaagtttttgtgtttctcatctgtggagttaagggattgggatggtctctagggtctcgtacagctctaatattgtcaccgccctcaggaacattacatgaaattagcatatatgcaatatattaagattcatgtgtggattgtttcccagttactagcgctgtctttaatgtaatttacctcagaaatctctggataatcattattgagatataatgaaatagggaaaaacttgaggttaaaaactagtaaattgatttacttcaacattaaaagcccacaattaaacccttgaggaaaatgactatttttattttttattttttgctctgcaagtaaggttggaacttcgtaatactgtatgacagtagtcgtttacctcacgaattagattattcatgtgtgtttgactgaagagagtttttacctagtgactggaatgaatgttaatgctgctattttggcattggaaaaaaaaggtgtaatgaaaaatgtcaagtttgagagagagagaaatacttaaatagaactgatttaaaagcaattctgaaaaagaaagaacttggcacaatctttctatgaaagcaaagactttactgcacagctaaagaaaatgaagcaaaaacaatacattgccccaattaatgtttgaattcactgaacacaaggtaggctagcaaagtagagagtaatatctttgcctcaccttggccacaaggatttattttgtcagtaaccaagtttagtgtactgctatttagctttttcactacagatgtgaaaatgtttctttttggggtttgtttgaaattttctttcccttttcaatttagcagtgctgaacctatcctcaaataaatttacatttttcccattaaatcaactttgtttctgttccatggttgaagcaaatactttataaagaaaaaaatcagtgtagacctttcacaagttaattattactgcagggctatataggcaaataaaaatattagatgttatgttttagaccagtgaaaaaacagttggtagtgatgctagattaagacttgccagaatgttcatccccttagtgagccattctgcttatgataacattttgtaatgttttcaggcattcttttgggacagccctgatcacttatcattcaaagggatgataaaagtgacaatctttagacgtgttgtaaattctttctttctttcgtccaaagggagctagaaagaaaagacatttgtgattatctgtccacttgaacacaactgctagaaagagctatttaattattgccaacaaggcagtgtgagagtttatagtaacattaggagtgtttccagttatcccagcaggattcagcattcaagaactggtaaattttggccagacgcggtggctcacacctgtaatcccagcactttgggaggccgaggcaggcggatcacctgaggtcaggagttcgagaccagcctgaccaacatggagaaaccccgtctctacaaaaaatacaaaattagctgggtgtggtggcacatgcctgtaatcccagctactcgggaggccgaggcaggagagtcgcttgaacctgggaggcggagcttgtggcgagccgagattgtgcgccattacactccagcctgagcaacaagagtgaaactctatctcaaaaaaaaaaatctggtaaatgtttgtctggcatcatagaatttaatgcttacctctaaaaatgtaaattggaaaatattttagccttatgtggtgtgtgatgttagcagggaagtctctaatgttttcacatgaagtcagatgctggctttggaccgaggtgtattttgtttacttaaggcagtatccatcatttcctattttagttttttgtttctttttgtttgtttgttttttgagatggagtcttgctctgtctctcaggctggagtgcagtggtgccatctcagctcactgcaacctccacctcctggtttcaagcaattctcctgcctcagcctcccaagtagctgggactacaagcgcgtattgccacccccaggtaattttttgtattttagtagagacagggtttcaccctgttgcccatgctggtcgtgaactcctgagctcaggcaatccacccgccttggcctcccaaagtgctgggattacaggcatgagccaccgcacccagctgtcagatgtctttactgcctccgtgaagatgatatgatttcatcacatttaacattgttaatgtgaagatcatgtcaatagatttccttatatggaatctctcatacctggaataaactgtgcttgtttatttgtattcctttttataatgtgccattggattctgtttgctaatattcagagattttgtgttgatattcgtaagtagtattcaactgtagtatcttttgtgcagtctttgtcaggttggggttaccattacacttgcttcataaaatgagtgtggaagttttctttccttttctgtgttctgaaatagcattaagactactttgtctttttttttttttttttgacacagagtcttgctctgtcacccaggctggaatgcagtggcatgatctcggctgactgcaacctcttcctcccaggttcaagtgattctcctgcctcagcctcccaagaagttgggactacaggtgcacaccaccacgtgtaactaatttttatatttttagtagagatggggtttcactatgttggccagactggtctcaaactcctgacctcaggtgatctacccacctcggcctcccaaagtgctgggattacaggcgccagccaccagtctaccttatcttaaaatggtataattttcctttgaaactatttgcctggtatttttttggttttcttagactggtttctgcttggtttctaccaccactcttaatcccctccagttgttctctgcaaccaccaccatgactgccatttccttgagcacttattatccattaagcacctttatgtgtggtaattaatgactgttatgtgttttgttgttttgatacaaagtctcactgtcgcccaggctggactgcagtggcgctgtcacttgaatccaacctccacctcccgggttcaagcagttctccagcctcagcctcccaagtagctgggattacaggtgtgcgctaccacatctggctaatttttgtatttttagtagagacagggtttcatcaccttggccagggtggtctctaactcctgacctcaagtgatccacccacctctacctcccaaaatcctgggattataggtgtgagccactgagcccagcctgttatgtatttttgtcttttgttttctttgagacagggtgtcactctctcactcaggcttgagtgcagtggcatgatcacggctcgatgtgtttattcttgtttttttcttgtttttctgttgtttttttttttgtttttttgagatgaagttttgctcttgttgcccaggctggagtgcaatggtgcaatcttgactcactgcaacctccacctcccagattcaagcgattctcctgcctcagcctcccaagtagctggaattacaggcatgtgccactacgcccaggtagttttgtatttttagtagagatggggtttctccatgttggtcaggctggtctcgaactcctgacctcaggtgatccgcccgcctcagcctcccaaagtgctgggattacaggcttgagccgccgcacccgggctggactattatctttctattaaacaatacagtacttagtatttcctggttttgaatttcatataagtgaaatcatactgtgtgtattcttcaactagcttttttcattcatcattatgtttttgagtatagtatagttacttgttttcactgctttatataccattgtataaatataccacaatttatccattctagtattaatggacattaggtttgttgttattacagtgttcctgcaagtaaccttgcacatttctcctgatacacaagagtttcacagatctttagacagattccccagtagtggaattgctggatggtagggcatatgtacattcaccgggtattccacattgttttcctaagttgttttcccagtaaagttttgtgttattattattgcacatcatgtgtttaattgattccttgatactttatgtttgttgttgctattctaagtgatatcttttttttttttttttttttttgagacagagtctcgctctgtggcccaggctggagtgcagtggcgatctcagctcattgcaagctccgcctcctgggttcacgccattctcctgcctcagcctccctagtagctgggattacaggcgcccaccaccatgcccggctatattctaagagatatctgtagatggtttatagaaatgcatttgacttttgtaaactgatgaattactggaataaaaagattgtccaacaaactcttattccagtaatccctctttaaattttttaaggacaaacatatcatctgaaaatcatgatattttgtttcttttcatgacttagatatattttatcttgtcttaactgtgctggccggactctccattacaaagttgaagagcagtggtgatacagagggcatccctgacttgttctgatgttaaaaggaaagcttttattgagtgataggggctactggtttttcataaggcttacttcccacccaccccctccccggaaacagggtcttgctatgttgctcagactggtctcaaactcctgggctcaagtgatcatcccactttaccctcctgaatggctgggattacaggcacatgccacagcacctggcttcataaagctttctttgtcaagtttttttaaacttaaagaaaaaaagaatcctgaatgattgaatttctacagatgctttttaattgcatgtatagaaattttcttgttttttttctttaagtttcatgttaccctaatagattttctaatattgaatcaattttgcattcctgggattaaacccaacttggtcatgatgtattattattatatattgctggatttggcttgttaataaataatagggtttttctcatgtggtttggtatgaaaattagactacccttacaaaatgaattggcaagtgtttcttttcctattcttctgtttttatttctgtaaaattagaatgattccttcaaagtttggtagaacttgcctgtacaagtctggacctgggtggttttttggttttggtatgtgtttggttttttgttgaaaacatgttaagctgattcaaaattattttaaaaatggttatacgactgttcctactttgaatttcttcttggtaattatatttctcttggcatttattcttctcacttatttttacatttactagagtattgtattttcttacctcttttaatcttattttgaatatccatttaaacataggtaagatataagtactgtttgtggctgggcacagtggctcatgcctgtaatcctagcactttggaaggccaaggcgggcagatcacttgaggtcaggagttcaagaccagcctggccaacatggcaaaatcttgtctctactaaaaatacaaaaattagctgggcgtggtggcgcctgcctgtaatcctagctactccagaggctgaggcatgagaatcacgtcaccccaggaggcagaggctgccgtgagctgagatcgcgccactgtgctctatcctgggcgacagagcaagactctgtctcaaaaaaaaaaaaaaaaaaggtactgtttacagaataagttaaatacttgtcatcactgtgcagattgcaaaatggaacattgctagtaccttagaaacgccttctcaaatctttaagagttgagtacgttccttaattttgtgataattgttcttttcagactcttctccctttttattctttacttttattgatgtataatatacataaagaaaagtggccagatgtggtggctcatgcctgtaatcccaacactttaggaagccaaggtgagaggatcactttgagctcaggagttcaagaccagcctgggctgattatagacgtgagccacattgtcctgctgggtatatatttagtagcagaatgactgtgtcagtctgtgcatagattccattttagtagatgtgccaaactgttttccaaagtggtaaaatatttccattagcagtgtattagagttcagaccagtgcatattctcaacaacacttggtatcatttttagcctctctagtgggtatgaagtggtatgcattgtgggttttgtttgcatttctctgatattttagctcttttttggtggttaactcttttttgtatgtttatgacattcggctatctcgtgaagtatttaagggttattttgcaaatttttctgtggagatttttgtttcattaaattataggagttctttgtagattttgatgagtctttttttagattcatgtgctgcagatattttctcctttccaagagttacctctttttttttttttttttttgatacagtcgcaatttgtcgcccaggctggagtgcaatggtgcaatctctgcttcctaggttcaagtgattctcctgcctcagcctcccaagtagctgggattacaggcacgccccaccacaccctaggctcactgcaacctctgcttcctaggttcaagtgattctcctgcctcagcctcccaagtagctgggattacaggcacgccccaccacgcccagctaatttttgtatttttagagacgggatttcaccatgttggctaggctggtctcgaactcctgacctcagcctcggcctcccaaagtgctgggattacaggcgtgagccactgcgcccggccgaattacagctattttaaagatcatcttcagtaactagtaactgggtcactgtggatatgtggatatgttgtctcttttttctcgtttctgtttccttgtatgcttggtaacgttcaagtgaatgctggatactgtgtatgaaaattgttgatgctctaggtgacatttttctccagagagagctctccctaatcactgataggcagatacagtggtgacagataaccataattcagtgagagattgagctgattcgagggttggttgcagttttttttttttttttgtattacacaccttttaatttgaattaattaggcatgatcattattgaaaattggtaaagtgtagattgataacaaccaaaacaggggaaaacattcatttaaaactttcccaaataaatgctccatgtataggcctctattaaaataataacaataaacattttttgaaccactttatatattttaagatttgtttagggctttttcatttgcacgtgaaaatattcctttttttttttttttttttttagtatttattgatcattcttgggtgtttctcggagagggggatttggcagggtcataggacaatagtggagggaaggtcagtagataaacatgtgaacaaaggtctctggttttcctaggcagaggaggaccctgcggccttcctcagtgttcgtgtccctgggtacttgagattagggagtggtgatgactcttaactagcatgctgccttcaagcatctgtttaacaaagcacatcttgtactgcccttaatccatttaaccctgagtggacacagcacatgtttcagagagcacggggttgggggtaaggtcatagatcaacagcatcccaaggcggaagaatttttcccagtacagaacaaaatggagtctcccatgtccacctccctccacacagacacagtaacaatctgatctctctcctctccccacatttcccccctctattcgacaaaaccgccattgtcatcatggcccgctctcaatgagctgccgggcacacctcccagacggggtggcggcccggcagaggggctcctcacttcccagacggggcggccgggcggaggcgccccccaccgacggggcagctgccgggcggggggtgccccccacctcctggacggggcggctggccgggcgggggctgccccccacctcccagacgggctggctgccgggcggagacgctcctcacttcccagacggggcggctgccgggcggaggggctccttacttctcagacggggcggctgggcagagacgctcctcacctcccagatggggtggcggccgggcagagacgctcctcagttcccagacggggtcgcggccgggtagaggcgctcctcacatcccagacggggcggcggggcagaggcgctccccacatcccagacgatgggcggctgggcagagacgctcctcacttcccagactgggcggccaggcagaggggctcttcacatcccagacaatgggcggccaggcagagacgctcctcacttcccagacggggtggcagccaggcagaggctgcaatctcggcactttaggaggccaaggcaggtggctgggaggtggaggttgtagcgagccaagatcacgccactgcactccagcctgggcaacattgagcactgagtgagcgagactccgtctgcaatcccggcacctcgggaagccgaggcaggcagatcactcgcggttaggagctggagaccagccgatccaacatggcgaaaccccgtctccaaaaaatacaaaaaccagtcaggcgtggcggcgcgcgcctgcaatcccaggcactcggcaggctgaggcaggagaaacaggcaggaaggttgcagcgagcggagatcacggcggtacggtccagcttcggcaacagagggagaccgtggaaagcgggagaaggagagagggagagggagaaggagagggagagggagtggtgtgtttggcgggggtggggggactctttgtgtggaaggtgacagacttgcacgtttgcttacatatactagagttagaactgtgcttgggtaggtactttgagatcattggaataaagatagcatgtgaaaacagaataattatgaaaacgtcttcttttatacagcactttgtactttttaaattgctttcactgctgtcacatcaaacctcttcacacttctgtaggacagataaagcacaattatttctctgttacgcagatggggaaacagacctaggcagggatatagtgacctgcccacaggtctaacagcatttgagtgataattagaactaaagtggaggaatttttatttgagaagttgagcagtgagagtcaaaatcttcttaggagctgtaggtttttgtaccaatggagagatctctttttctgttggatatgattgacaatgttagaagagatattcactggaggaaggccccgcagaaggaatgaggaacagacctctggcctgtattgtgcctccattgtctctggtgtagttgtgcatattgtgagattacagatgggaaagaaagagatcttcaccctcagctcaagagaagaaagtaagggtgctgtaggaacagatgtcacagtaaaagcatgccaatctaagtgtgctcaagggattttatgctagttggccttaggttctggtaagagataaggtggggcatctgccaagagtacataagggatcaggggcttggaaagtgtgaagaaagtttgagatagctgttgtgtgcttaaaattaactaaagatgaataaaaagactggcccctttcattgagagtggggactttgttctctgctgtatccccagcacctagtatacacattgcacatagtaggtactcagtaaatatttgttgaatcaggcagattcctgcctaggtctgtttccccatctgcataacacaaataaggctggctaaccctgtgccatctccgtaatagtcttcatcttctcttcactttcccattcatttctctatattagttgaatacatgaatgaagacaggaataagttcctcactgaagttacaagcctttttaagaacagcaaggtaacatatctcatttatcaaattagtaactgcatttgaaaattcagctctgacacttatggctgggtgacttagagcatgtcctgtaacttctcagagtctcattttactctggtgaaacaaggatcatgtcttttgagtgttgaaatgactgtattaactaaatcactatgtaatcctaagagcaatctttatgcatcccagaatggggtagagaataaagtattggagtgaatgactgtgggatataggctagatacctatgtacatagataatttcatggagcctttttaaaaaattatggtaatatacacataacaaaatttaccatcttggccaggtgctcacgcctgtaatcccagcactttgggaggccgaggcgggcggatcacctgaggtcgggagttcgagaccagcctgaccaacatggagaaaccctgtccctactgaaaatacaaaattagccgggcgtggtggtgcatgcctgtaatcccagctactcaggaggctgagccaggagaatcacttgaacctggctggcagaggttgcggtgagccaagattgcaccattgcactccagcctgggtaacaagagcaaaactccatctcaaaaaaaaaaaaaaaattaccatcttaactatttttaggtgtactgttctgtagcattaagtagattcacattgtgcaaccaatttccagagctcttttttttttttttttttttgagacggagtcttgctctgtcgcccaggctggagtgccgtggtgcaatctcagcctcccaggtgcacgccattctcctgcctcagcctcctgagtagcggggactacaggcgcccgccaccacgcctggctaattttttgtgtttttagtagagacgggatttcaccctgttagctaggatggtctccatctgctggcctcgtgatccacccgccttggcctcccaaagtgctgggattacaggcgtgagccaccgtgcctggcctccagggctgtttacatcatgcaatgctgaaactctatagcaattaaataactctccatttttccttcttccaagcccctggcagccaccattctactttctgtctctatgaagtctgactgctctaggtacctcatgtaagtggaatcatacagtgtttgtctttttatgattggcttattttacttactataatggccttaaggctcatccatgttgtagcatgtgtcacaatttcctttttaaggtggaacaatatactccattgtaaatacacacaccactcatctgttgatgaacacttgggttgcttttgcctcttgtgaataaggctgctatgaatataagtgtacaactatctctttgggaccctgctttcgattcttttgggtaggaacccagaagggcactactggatcatatggtaattctgtgtttaattttgaggaaccacaaactcctgagttcaagtgatcctcacaactcagcctcccatactgtttccaaagtggctgcaccttttcacattcccaccaacagggcaaaaggattccagtttctccacaaccttgccaacacactgcccaggaggcagaggttgcagtgagctgagatcgcgccactgcactccagcctgggtgacagagtgagactccatctgagaaaaaaagaaaaaaaaaaaaaagacctgatttggctatgggggttctgccctcatgaatggatttaggtcattatcacagagtgggttggtctaaaagtgagttgggccctctctgtctcttacgctcctgcctttgcttgcccttctgccatggggtgatacagcaagaaggcctctgccagatgcaggcctcttgaccttggacttcccagcttacggaactataagaaatacatttcttttcctataaattacccagtctgtggtattctgttatggcaacacaaaacagacgaagggattttaatgggatggttggaaactgaatgtggactacctagagtggacaccaccttgttggttgtagcaaagccatgttaaaaggtaagcctattgctacaatgtaagggtaggtaatattttatttacatactgtatcataagtatcaacattataaaggggataagtacactggagcttaatgttgtgttcctgtcttctataaccatttgatcactatgtctattcctaataaatctcacctgttctttaaaaatatcctagtaattctttgggttttgaatctttactctccattataagtatgtatacatctaaattttaaaaatatgcatgcaggcattctgactagatctccaaggcttggccgacctgttaaatgacataactcaagtaaattatcagacatatcagaagtacaaacttgatgggcttggttgagatatagtgatcctcagagtgctgtctggtgacccctgcactctcctctctgacaggagagctcagccttaccctttgctgaagaagtgagttctctttaccccttcttctgcctctgatgtcttctcatctctaaatatggtctgtacccctcacaccacaaataaaagtgttcttacttcagcaaaactatagggaggggctcgtcgccactggaattggttctaacggttgaaactcattcctcattcaggatccttccacaggtccacagtgctttatttgcagctcagggtttcagacctttctgggtatcttttgtaagctcatttggggcaaaacctgacgtggactgccacgagactattcatagtctgtatttttcccatctagtgtgattatttgtatgtttgctgcagaaatatcagtgctggattccttggtacacaccagacctcgccagggatgtatgcacatatgtatgcactgtattacctttctaaaatctgaaaaatactgaattctgaaacagctttgttccaagggctaatgaatctgtgcttctcctgaacttgctacaatttgtaatccccaaataatatagtttgataatcatctcagttttttttctttagagaaaatttggaaaacacagaaaggcacatttatgcaaaaagcattcacctgtaatgctgctacccagggatatctgctgtcaacatcctggcacatttttttcctagtaaaattgggattacattttatatacatcatatcatttggtattctgaatctttgatccaacacagtagtataatcattttccagaccactaatcagtctttgaaaacagtaaaaattttattttatttttttgagacagggtcttactctgtcacccaggctggagtacagtggcgcgatcttggctcactgcaacctctgcctcacaggttcaagtgattctcccacctcagcctccttagtagctgggactacagacgtgtgccacagccagctaatttttgtaatttttgtagagacgaggtttcaccatgttgcccaggctgctctgatactcctggactcaagcgatccacccacctcggtctcccaaagtgctgggattataggcatgagccaccacacctggccaacagtcaaaattttaaaaccggctgggcgcagtggctcacgcctatcattctagcactttgggaggccgaggcaggtggatcacgaggtcaagagattgagaccatcctggccaacatggtgaaaccccatctctactaaaaatacaaaaattagctgggcgtggcggcacatgcctgtagtcccagctactcaggaggctgagggaggagaattgcttgaaccctggaggcggaggttgcagtgagctgagatcgcaccattgcacgccagcctgggcaacagagcaagactccatctcaaaaaaaaaaattttaaaccatatcattattcatgcatttttttttacttgttagcaatatatttaaatactaaaaagggcttaacttttttaaaataaattttttattttatttaaaaattttattttagagacagggtgttactctgtcgcccagggtggagtatagtggcataatcatagctcactgcagcctcaagctcctatgttcaagtgatcttcttgcctcagtctcccaagtagcagggattacaggcacagtccaccatgcccagctttgcttaatgttcttcgcatgattaaagtggggttgtgggtttggaggggaggaagaccacaaagatagtgccattctcatcacatcacatcaagggcatatactgtcaacagaacactcttgttgttgaccttgatcacctggctaaagtgtttgccaggtgtctcactgttttctcctttttgcgtaatatactcaatggaagcaagtcattaagtgtatcccacactgaaggagtagggagttatcttccacctccttgatggtgtagtatcaacataaattatttggtattcttctatttgggagattgtctcttctccccatttgtatatatcactatggacttgtgaatattaattttacattttgggttacaatcccaatggcacttcgattttggtgcttatgtttttccagctttgggcattgggagctctttcagttggcttctgtgtccctttgacataccttaattatttacatgtaaaaaaatgtttagctccatacttcctggcactacaatatgttctaagttcatctagtatatttcttgccccagggacttaacttcaaaagaaccaaggctttattgagatataatttatggctgggcacggtggctcaagcctgtaatcccagcactttgggaggctgaggcaggcggatcacgaggtcaagagttcaagaccagtctggccaacatagtgaaaccccgtctctactgaaaatacaaaaaaaaaattagccgggcatggtggtgtgtgcctgtaatcccagctactcgggaggctgaggcaggagaattgcgtgaacccaggaggcagaggctgcagtgagccaagatcgcgccactgcactccagcctgggtgacagaaagagactctgtctcaaaaaaaaaaaaaagagagagagagataatttacaaacatttcacccgtttaaagtgtacaattcagcgtgtttttttgttttgttttgttttttcttgagatggagtctcactttttcgccaggctggagtgcagtggcgtgatctcagctcaccacagcctcagcctcccgggttcaagcaattctcctgcctcagcctcctgagtagctgggatcacagactcccgccaccacacccagctaattcttgtgtttttagtagagacagggtctcaccatgttggccaggatggtctcgatcttgacctcgtgatctgcccaccttggcctcccagggtagctttttaaaatatatacacagatatgtttaataaccatcaaagtcaatttttagaataatcacctcaacaagaaacccttgactggatacagtggctcacacctgtaatttcagcactttggtaggtataggcaggagtatcacttgagcctaggagtttgagaccagcctgggtaaaatagtgaaaccttgtttctacaaaaaatttaaaagttagccaggaattgtggcatggccctgaggttccagctacttgggagggtgaggcaggagaattgcttgagcctaggtcaaggctatagtaacctgtgaccacgcgactgcactctatcctggccaacaaagcgagaccctgtgtcaaaaaagaaagaaagaaaccaatcctgtatcctttagctatttactctctctctctctctccccttctttttcagtgtaaagtaactaccaatctaatttctatctgtatagatttgcctatctggacattttgtataaatggcatcacatgtgtggcttctttcacttagcatgtttcaaggttcatccatgttgtagcatttatcagtacttcattccatttttatggctgaataatattccattgtgtggatacaccaccttttgcttgtctatcagttgatggagctttggtttgtttccaccttttgattattatgaataatgctgctacgaacatttgtgtacaagtttctatgtggtcatggttttcatttgccaggtcatatggtaattctgtgtttaaccacttgaacataaattgaagtattgatcttttaattatgttttgttagagacagggtctcactctgtcatccaggctgcagtgcagtggtgtgatcacggctcgttgcagccttgaactcctgggctcaagcagtcctcctgcattagcctcccaagtagctgggatcacaggcatgcaccaccatatctggctaatttttaattttttgtagagacagggacttgccatgttgcccacactggtctcaaattcctgggctcaagcagtcctcccatctcagtctctcaaagtgctaggattacaggcatgagccaccatgcctggcctattattgagtttttttgtttgttttgtttttgtttttgagacacactctcactctgttgcccaggctggagtgcagtggtgcgatctcagctcaccgcaacctctgcttcccaggttcaggcgattatcctgcctcagcctcgcgagtagccgtgattacaggcacccaccaccacgcccagctaatttttgtatttttagtagagatgaggtttcaccacgttggccaggctggtctcaaactcctgacttcaggtgatcctcccacttcagcctcacaaagtgctgagattacaggcatgagccaccacacccagctcctgtgattgagttttaaaagttctttatacattctagatacagattccttatcaaatacatgatatgcaaatatttttctctcattctgtgagttgtcttttcattttctttctagtgtcctttgaagcacaaagttgttaaattttggtcaagtccaatttatctatttttttcttttgttgtttatgcctgtcatgtcatatatgtaagaatccattgccagattttcagggtttaccctgaagatttatccctatgtttctttgtagagttttattgttctagctcttacatttaagtgtttgagccattgtatattgtgaagtgtaaggatccagctttattcatttgcacatggctgtctagttgtaccagcatcatttgttgaagggaaaggatagtcttttcctttccccactgagtggtgttggcacccttgtcaaaaatcagttgaccatagatgggtttatttctagattttcatttctgtcccatcaatctatatcttttttctttgtgccagcaccacccttttgattatttaccttgcaataagttttggaatttgagatgatatgggcttaacttttaaatgacttcccaagtaactaagggcttatacaggatttgcttttttagtttagttattatttttatttaaaatcatattctaagttttctgaagttacactagcattttaaaaaattaattattttatttttttgagaccgagtcttgctctgtcgcccgggctggagtgcagtggtgcgatctcagctcactgcaacctccgcctcccgggttcaagcaattctgtctccgcctcccaagtagctggaattacaggcatgaaccaccacggcctggctaatttttgtatttttagtagagatggggtttcacgatgttggccaggctggtcttgaactcctcacctcaggtgatccaccccgcctcagcctcccaaagtgctgggattacaggtgtgagtcaccactcctggccgtactagctagttttatagtgaaagattttattttaatgctgtatttttttttaccagcatctctccaatctcccatgaaagatttttaaaatcaacaaaaacaagccttctgctgtacaacacttactgaaaacatcactttcgttactctatccagtacttttaaattgatatatagtcctaaatttaatttcctgggcactgccccagagtctgtgagacaagtgccatttgttctctccccttcatagtcaggctctctcgggaatggttcgtgctgcttgctctgctttctgtgcccacctcttctgcccacgagagccagactttagccccctacccccactcttgcactctgaactgatggtgtgcacactctatgtacagtctttcttgattttgatctttctggactggttgctttttcctgaaggccttcctcaccaaagattctttttcccctttttttgccattctccctggaaaatcaaaagattttgattttttctggagcacttgatgttataagccatttcctttttaaaaagttacatctactactttgctgagacacctctggttttcccaagtctttgactctttgttcttagttcttgggccctctgtgtcccatacacactctctggatgatctcatccaaattcctaggggctgatcactcttctgtcctaaaaataaaacaaagccaaaacttctgcttccctttgaagcactaccatccttctttcctccagagccctgcccactgttttactttctccctcccacttcaggctaaagctcactttgctctgccagacctgttctcagcaaggattcttttgtttttttaaacctacgtaatgattatcccatactattgtgtcctattttttcctttttctatgtatctgactccaacatgtaacatcaacataatgttaaattttattaaaaacaggttatttatataactgttgcccccatttgttgggcatttatattgcttcattttttcagtttttaaaaatttttaaattttttattttattttcaagagacagggtctcactatgttgccaaggctggtctcgaactcctggactcaagcgatcctcccaccttggcctcccagagtgctgggattgcaggcgtgagctaccacacctggccctcattttagttttaatttatttttaactttttagagacagcctcactttgttgcccaggctagagtgcaatggcatgatcatggctcactgcagcctcgatctcctgggctcaggtgattctaccacctcagccccccaagtggctgggaccacaggcgcacaccatcaccccagataatttttttttttgagacggagtctcgctctgtcgtccaggcaggagtgcagtggcgcgatctcggcgcactgcaacctcttgcctcctggattcaagcgattctcctgcctcagcctcctgagtagctgggattacggacgcgtgccaccacacccggctacagataatttttttgtattttttgtagacactgggtttctccatattgcccagggctgatctcgaacttctgggctcaagggatccacagcgtcagcttcccaaagtgctgggattacaggcatgagccaccacgtccacccctacattttttttctccccccagatgtatacttttaagttctgtttttgtttttgtttgtttgtttgtttgagtctcactctgtcgcccaggctggagtgtggtggcacaatcttggctcactgcaacctccgcctcctgggttcaagtgattatcctgcctcagcctcccaggtagctgggactacaggcatgtaccaccacacctggctaatttttgtatttttagtagagactgggtttttctgtgttggccagcctggtctcgaactcctgacctcaagtgatctgcctgcctcagcctcccaaagtgctgggattacaggtacaaattgctacacccggcctgtatacttttaaattctttagtgtagggcctctgtcttgagtgcttatcagcttttcgctggtgaagtgggttggccaggataaaaagtatcatcaagatgccatttctctcttcttccccatcccaactcccagagctgatctgtctccctgctccaggctttcatgccctgttttgattactgtcagctttccagagtgaagggatctctcttttaagtgttagctcctgaaataatgatctgagaaaagggatttttgtttgaagggaccatgctttttttttttttttttttggacataatttacctaccagagaaaagaaaaacttcacctttaaaaagaatataatttagttgttttcagtatatattcacaaagttttggaaccaccaccactgtctaatcccagaacattttattacctcaaaaagcaaccccattcccatgagcagtcactctccatttcttccctcccccagcgtgtagcagccagcctctgtgtcctttaacaatgtagaaccagccctacttgactctgagtgtgcaggtattcttttgcactcttgtttgcttacatttctgcatgcattttactattttgtatcaggatttatttatttatgtattactgtttggcattgatttcataacatcaatttcgagagtaatcattgttgatttttatttttttggctgggtccgggtatgtgtcttctcattctcttcctgcatcctagatctttctttttacttcttcctgctatttatttctttagttagttttagagacagggtctctgttgcacaggctagactgcagtgatcatagctgggtgattctgggtcccttcctccctcagttcagcctctcgagtagctgggactacaggcaggagccatcacacccagctaatttttaaaatgtttcgtgttgatggagactgctttctgtgttgcccaggctggtctgaaactggtaggggcaagccatccatctgcgtcagcttccccaaatgctgggattacaggtgcgagccatcatgcctgacttcttgtgggtttttgattctgtgaagccatctccttttctcttgagccttgatggtttgtacttaacactctcagctccttcctgggctgccctttaaaatttgcttgctgtgttccttgcagttgagtcttatctttgttctttgtttataatgtgtttattttcttgggttttgaaggcagcattctgtaccatttctcagcttagctcttcccagagttctgttgtgtaggattttctgggcacattcttgtataatggaaagaacatagaattcagaagaatgaataagggttaatcctagctctgtttttgggtgactggctaagtcacctcgactctatggtaggacttttaactattttaaagtcctatgtagttatcatgttctaaaaattagcatgcagatagatagatagatagatagatagatagatagatagatagagttttttgttttttgtttttgttgttgttttgttttgagacagagtctcgctctgtcgcccaggctggagtgcagtagcgcgatcttggctcactgcagcctctgcctccctggttcaagtgattctcctgcctcagcctcccaagtaactgggattaaaggcatgcagcaccatgcctggctaattttgtatttttagtagaggtggggttttgccatgttggtcaggcgggtctcgaactcctgacctcaggtgatccacccgcctcggcctcccaaagtgctgggattacaggtgtgagccaccgcacccagcttcataatttttatgcctaatgaaatataaggaaaactgggcaggcctggtggctcacgcctgtaatcccagcattttgggaggccaaagcaggtggatcacctgaggacaggggttcgagaccagcctgaccactctgtcgctactgaaaaatataaaaattagctgagtgtggtggcgggcacctgtaatcccagctactcaggaggctgaggggggaaaatcacttgaacccgggaggcagaggttgcagttagccaagattgcaccactgcactctagccaaggcgagattctgtctccaaaaaaaaaaaggaaaagaaatataaggaaaactaatgcagagtttacagttatcaacaaaaagaataagaatgataatgattattaaatttaattatttaagggccaggtgcggtggctcacacctgtaatcccagcactttgggtggccaaggcaggcagatcacttgaggcgaggagttccagaccagcctgcccaacatggtgaaaccctgtctctactaaaaatacaaaaaaattgcggggtgcctgtaatcccagctacttgggtggctgagacaggagaattgcttgaacctgggaggcggaggttgcagtgacccgaggttgcgccactgcattccagcctgggtgacagagcaggactccatctcaaaaaaaaaggtaattatttaaaattatattaaaataatgaaaaaagtgagattggagatgaaagtgataaaaatctagatggcagtgacactgtttgtattgaatttatgaaacaagttcacgtacctgttcatccaagtaaccttatatgtgagataagtattctttacattttacagaggaagatactgaggttcagtgaggttaagataattgcccgaggttacaagcacagagctgtgatacaatacaagaacttgaattcaggtttcaggacttccaagaccaaggctttgtatcttgacccaaaataaaagttgaatagtttgaaggttatttcttcaaatatactctatcacttaagtaggttttcgggagtgagcgaagacggcacaagtttgaacattcgtcctggagatcatctgttactctgaatgtatcgtgggttagtgttgtgggcatggctgctatctgggggcaggttgaaaagctgccacattgccactgtcatcctacggaatactagttaagcagaattatgagttcttgtgaaattactcaaattttttatttctcaagttacagtggaaatcttatttctgaaatttcttttcttttcttcccatattgtctcctcatttgcactcttgagcagtaaatacatctgttccaaacacaagcaaagacctagacagagaaataactgccagagtcagtggcagtgttgcagcttttcaacctgcccccagataacagccacgcccacaacactcacccactgcatattcagagtaacagatgatctgcaggacgactgctgaaactcctgctgccttcactcactccagaaaacctactgaagacctgaggaatggaggactagattgaagaattgggaagtcactgagaaccaaggcagtgcctctgtcattctctgtggagcagcaggccttgtttctgcagtccagatctgtctactacttggctcctctctgcagaatgaagtctgggtgcatgtggcccatcccagcattcccagttatgcaaccagatactcttctgccagccagcctggccccttggagtctctgtgctccagctccaggctgtctgagaagaggagctagttggcccagctctaccttagaatggattcttgtctgggctgggtagtacctcatcagctgtggccaggagcaatactctcaacagcacagacaaaaggggacagatccctattgggtaaaggtgatgtgggctggggtaagtaccctgagaggtgtctgtcacagaaaactgcctgagagaactttgtcaaagttctgggctccactctccaggggttttgttcagtcaataggtataaaatagaaactaagtgtccacttgtttaaaaagctccctggatgagtctgatgcctcttcagatttagaaatcactttactctaatacgtgtaaataaattaatatgtatttgtgtttgcatgaggaaataatggaaagataagcaactaataaaaatgggtaatgggtggagattgatgaggctgttgaggatgagggagcaggttctttcacacacacacacacacacacacacacacacacattttaaccaacttaaaaatttaaagaaacacttcagcttaacaattagaaatcagattcaaaacaatgattttaaaattgaagatactgaggtccagaaggtgcactgtatctgggaccaggtttctcatctgtgaagtaattccagtttttggtatcagtcacttaaatgtaatttattttttctcatcagcataatcccatagaagttcatactggtaggcaggagaagaagggaatagatcccaaagggaattggaagaatttgggttctattgctttgtctttgttctgtagagaaggtacttccacagtagacccaaaaccatgagatatgggcccaggacaaagtgagctgagaagaaaagggttggtgcagtgactctccatcttagttgaactttagaatcacctggggtcctttacaaaataaaatcccaattcatacacacatatacacacagtctaggacagttattcttagggttttttttgttgtttcgagacagggtcttcctcaaactcctgggctaaagcagtcctcctgccttagcctcccaaatagctgggattacaggtgtgagccactgcatttggctcgtctgatttttttgtttttgtttgtttgtttgtttgcttgagatggagttttgcccctgttgcccatgctggagtgcagtggcgcaatcttggctcactgcaacctctgtctcccaggttcaagcgattctcctgcctcagcctcccaaataactgggattacaggcgcttgccatcgtgcccagctagttttttgtatttttaatagagatggggtttcatcatgttggccaggctggtctcctgacctcaggtgatccatccgcctcagcctcccaaagcactgggattacaggcgtgagccgctgcacctggacttgtctgagttttttcatgattagaatgagattatgcatttttaagtgtgttgtgctcttctcagcacatcatatctgagaattcatgatgttgctgtgtcttagatgttaatcatttggttaaggtggtggtatctgcctgtttatccttttacgactattatcgtagacatcttaggggatgtactctgagactgtgatcaattttactcactgattttagcatccatccatgggtcttgtctgaaacttattattgtggtttttgcctaattctgatttttttccccaatttccttcattccttctgtattaattggagtgcatctgtaaggaagaactatcctccctctcatttattcacttatttatataggtgtggatgcatggatatgtgttttattctatggatttagtctaatactgtgatttattttgttgctcagattgttacaatttcaactttagtttgctctttcaggttggcctctaggccctttcaatatgcttttgtattttttttttttttttttgaaatggagtttcgctcttgttgcccaggctggagtgcaatggtgcaatcttggctcactggaacctccacctcccgggttcaagtgattcttgaacctcagcctcctgagtagctaggattacagatgcccgccaccacgcctggctaatttttttatttagtaaaggaatttatttagtaaaagaggagtttcaccatgttggccaggctgttctcaaactcctgacctcaaatgatccacccacctcggcctcccaaagtgggattacagcctggctgtcaatatgcttttaagtgtgctcattgctactgggtgtcactgcttctaagtcttctcagcagacagaactaggaaaataggcttatgtatactcagctacatattacacatgtatctatgtttatttctgtgtatgtctgtgtatatgttagaaattatgagttcatactgatatctcattctaatccaacactgtgtggtttattttagccttccctcttatttgtaattattttgccaacctggctgtcattatccttcatttttttaaacttactttttcagtcagtaccactgtctacatgaattagtgtcagaattgctaactcacatctttgtgagaaacaaatttacttactaggtagcagcatttgtgttacagttctttatgcctttagctttacaatatccagtcaaaataggttttcaaagtttcttcctcatgcccttcagtgtggttatgttattcctttgtaacgcagttagattcacttgttactgtttgtattctgggttctttaatttttttggtatgcgctacattactctggttttgagtcatctatacacaaagatatactcagagaaatatcactccttccttatccctaccatccattcccatttcgttttatccctttcccacctatcccctgtaggtagctgatctctttagtttctggtttatccttcctgtatttcttttgtacaaataagcagatatatgtatatgttcttattgcccatttcttatatgaaggatagcatagtctaaatcttgtactttggttttttcacttaacaatatatcttggaattcattctgtgtctgttcttagacatcttagaatgattttcattcatttttactgctgcatagtactccatgtggatataacatagtgtcttcagtctcctccaatgtgtgggcatttagattgtttccagtattttgcaattacaaatagtgctactgtggataatcttgtacatatgttttttcatatcattggaggtgtaccttcagagtagattcttagaagtaggattgctgggttaaaagatgtacacatatataattttgttaggtattgcccagttcccctccagaagagttgtacagtttgcattcccaccagccatatatgaaaactacctgcatatgttttaaaacacatacagatgaatgattatcagttttgtttagggtcttcctttccttctgcaattcctcttctatcatgacaggttgcaaaagaaactaactgcaactttttcatgaaaagaagtaaaattagttttccagagctgactgaagattttcttactggcattttaaagttataattatgtattacatttttccactttacctagtttagcatctgttatgtaacatctcaccacctgcttagttgtgcaggcagttcttttcagtttagataataatactggatactgcaagtttaaacattttccccatcttagtcattttccagatttctgagacaggtgtttaatatttccaaaagtgaggcagttcagaaaatatttgcatttcttcactcttacatttcagtgacggaggtggtcatctgagcctctcttcctttgacttgactcgttggggtacagcttacaaaagcatgccagggtcaccatgacaaagtagatcatcctcttttctagaccatggctccctatcctgccctctctccctgacgacccctggcttgagaccctcacctttgtgttttcccggtgtgctggtcctctctggcctcgctctggattctgtctgctgacctccccactctgaccagattctcagttctcctgatctctccactcccactctataggaaccctactgtttattttgtctgatcttgctcagactgctgatacatactggagaaagtcacttaattgtcatgattggcagcactaaacatctctggattctttctgctgagtcttcaatgttttcttttaacttgtccccgttcgggtccctttctcaccttccctgtgcctggtttgccttcacatcttctgccttccagcctgctctcccatactcccacacctcatttacagcacatactcaccttatttcaggaaagacaggttttgacttatcctgaggaaatagatctaaatagccagaaccttccaaatggataggctactttgggaagcagtacattttctatatcatgatcattatgattatttttcttgtccttactgcctgccttcttcagcttcttttcagttgacctgtctgaatctggctcaatgatgaacctgaacttggttgatcaccacaagagcctgtggccaaggactgttggcctatataaagtgtcatggttcagaacatgggttttgggggtcagcacacctggatttgaatctcagttctgttaactactaggtatgtaatcatggacacgttagttgaccctccactctgcctcagtttcttcatctataaagtaggggttatgtttcatagggttgtggtgaagataatatataaggatttttcttaagttcttagcactgtgctagtgactatgatcattatgattaaatgtagtccttccttattttctcactctacctcaggggtcacttaatgctcttggtttgtgttgatactacttctagctgttgtcataactcactgccagctagcctcacccagaccattgtaaagttcttttccagtgaaagtgggaggaaataaatgaggagaaaggaaatgtagggaaatgatcaagaagtggatactccatctatttcatcagggtctccctttctttctcatggcaagttcagaacacttctaagcagtaactgctttgcattagatagtatctgttaccaagtctcactttgggctaccctagcatgctttaagtaaaacagagctgcttggttatggatttttaagatgatggatagtcgcagtactaaatcctggtagtatatcttagatcaagtaaaatagacatttttcccattcatgaagagagaaatgtttttcatactttaataatttgggtaccacagttcaccaaaaatttgtggaaacttttctgaatataagtcactacaagtcttcatctatgtcagtgtctgcgcatacacctgtataactgagtgtgtctctttatccatattttttattttgtgctgcttatgtttggatgtagcctgaacatgaaataatggaatcttctttttgtaacttggccagcattatcaaagcatatatgtagggcatagctgagttaggactaaaactcagacctcctgatttgaagcccagtgttcttttctgatgttacttcctttttagggtatcacatgataaatgtaatgaataataataagtaaaataattttttttttttttgagacggagtctcgctctgtcgcccaggctggagttcagtagcgtaatctcagctcactgcaacctccacctcccgggttcatgccattctcctgcctcagcctcccaaatagctgggaccacaggcgcctgccaccatgcccagctaattttttgtatttttagtagagacggggcttcaccgtgtcagccaggatggtctcgatctcctgacctcgtgatcctcctgcctcggcctcctaaagtgctggtattacaggcgtgagccaccgcgcccggccaagtaaaataatttttaaaagaccatacaacttttttttgaaggcctactatcttttaggctgcatctgctttttctaatcttcacaatccccgggctttcctcattttctagccaagcaagtgattactcagagatactaagtaattcagccagtgtctctcagctagtgagggataggaccagaattgaaaccttttctgggtcttttagtctgttttattactgaagaaattgacaaatgcatatgtaaccaacaaaacttgttcaagctctgggctctccagagcaccttttctagagaagttgcatacttgttaatgactagattttaagccatggtacctatagtacattggaacattggctcttaaaataataaaaaattatgaataaatgctaagcatttgctattactggttttattgcttaaataaccttaggctagcttttaatagttcacttaatggtttgcagcatctgaaaaaaaaaaacctttgcactgtttttcttggttagtgaattgtcagagaaccaagctaaagtaaggaatacattttcttttaaagcaatcattagtattatctacctatttatttttggaacatgagtttggctcagtctaacttacttagcatctgaagacaagataatttttatctgtgaaacagagtgctgtagtttcgtgttcagataattaaagttcaccaaaatgggtggcttagagaacagcttaatagctttccctaaaaataacccattcacagttgttaggtagcattttagttgctacagtatatggtgcttgtgcatgataataacgtttgtctaaataaggtggatatattatccacaaatattgagcctctgctatgagacatgactataatgacaggggatgaagaggatgggaagaaaacctaaaaatattagaaattttatgtcaaagcctttgaaatgattgtggaaggctgggcatttattctaatgatactgtcattacttaaaacctgtttggaacatttcccttggaatttccttgaatatgagcttatgaaccatgaaagagaatcaaccccttaattttgtagcacagctaaatttttaaaaaatcaccttttgagatataatttatatgcaataaaatgtatctttttatgtgtactgttcagtgaaatcttgacaaatgtatgtagttgtgtaactgccaccacaataaagatacagaatatttacatcacttcaaaaagctttcttgggtacctttgcagtcagtttgtgcctcaggcaagcacggctttctttccttttgtttttgagacagagtccagctctgtcacccaggctggagtgcaatggcgcgatctcggctcattgcaacctcctgtctctcaggttcaaccgattctcctgcctcagcctcctgactagctgggattacaggtgcacaccaccacgcccagctaatttttgtatttttactagagatggggtttcaccttgttggccaagctggtctcaaactcctgacctcgtcatccacccacctcagcctcccaaagtcataggattacaggtgtgagccactgcacccagccacggcttcctatcactatagattagcttcagcttttctagaatctcatataaatgggatttaaaagtttgttctctttgtgtttggcttctttcatttagcatagtgtttttcagatttgtccttgttgcatggattagtagtaattccttttattgctgagtactgtcctgttgtatggatgtaccacagtttgtttaccctttgcttgttaattaacatttgggtcgtacacagtttagggctgttaggaataaagctcctacagacatctgtatatgagagtttcaactttgctgcatcctcaccaacacttggtattggtcagttattttagctattctaatgggtatttggttttaatttacatttcctttatgactcatcagtcatattttcatatttgttgtcacaaaggaagtgtttattcttttgcctatttgtaatattgggttgtttgtagtcttgttttgaagttttaagagttctttatgtatgctaaatacaagtcctacatattgcaaattttttctcctctctgcacaattcatttttgaccttgatgatcttatctggcctgctctgctcaccatctcattcgtggatcccactcagcagcctttccctttcagtcttggctgtctctttccatttccactgtcactgctcttacgcattccaaggactttactactcccttcagagatgtggtgggtgttttttttttttttttaaattattattttactgacttgagagtgctgctggattgatagtgaccttgggtctgggttgctagatgtcctgcagtgggtggtatggtttcacactgaacactgaactgacctgcttaacatgccaattacatccttgttgcttagtccacgccactgtcagtcacctcttgctggtattatggcagtgcttggaacggtttcctttttttttttttttaactttttcctttttttatttttattttctttttttaaaatagagacaggatctcactatgttacccaacctgatctcgaacttctgggttcaagcagtccacctgccttggcctcctaaagcactgggattacaggcatgagccactgcccccagccactttttcctttttacagttcagtttttctcttatttggtaagatcatttacaaaatataagttggatacttttattccccagtttaaagtgaaaggacacttaaaagataaatccttagcataactgctgggtcactgcgcatttcttctgcctcatcgtgagccacgctctctctggtacactgtagccacagtggtcttcttagggcttctggtctacttctggtctacttctggtctaccctctccctgcttgtagaatacttgctgcctttgccacccagcaacctggctaattccggcttatccttcagttctctgtttaaatgccttccctaatttctttagagaagaagagtcttccgtaagcttctaatttaaactaagttttctagttatccttaataacattaattatataacttgcattttccttagcaattatcataatttataatgtagtcatgtttatgacaaatatgtttattaatacctatgtctctctctcttattttttttttgtgatggagtctccctctgtcacccaggctggagtgcagtggcgcgatctcagctcactgcaacctctgcctcccgggttcaagcgattctcctgtctcagcctcccgagtagctgggactacagatggcacggcaccacgcccaactaatttttgtattttcagtagagatggagtttcaccatattgatcaggcaggtctcaaactcctgacctcaggtgatccacccgccgcagcctcccaaagtgctgggattacaggcatgagccactgcacccagcctctatgtctatctcctctcatagtttatgagggcagagagctttatatttttactgctttatccacagtgcttaacataatgtaggtgattatttgataaataaaattaactttaacattcaaatgtttttaaagttatttgatgcacatcctttacgatcccaaactgacgttttttttctcttgaatacaaacttctgtactagtttcctgtctctgccatttccactgaatctataaattgcccttataacaagagttctcatcttttttttttttttttaatgacgtgaatcctttaggcagttggtgaaacttgtggctccttttcagattaatattttaaatgaataaaataaaatgtgagattacaaagggaatcagttatgctgaaataccacttttgaaaaattaagaagtctttatatgtgcttctttactaatgccgtaaatagcaagatcaggcagcaggtctaacaagcactgtaatttcaaagtgttgatgggtatagatatttcaagaattataactggtctccctatgtctagttttagcctctttagtcagttttttttttctttttttttcctttttgaaatggagttttgctctgtcgcccaggctggagtgcagtggcacgatctcggttcactgcaccctccacctcctgggttcaagcagttcttctgcctcagcctcccaggtagctagaattacaggagcctgccactacgtgcctggctaatttttgtatttttggtagagacagggtttcaccatgttggtcatgctggtcttaaactcctgactccaggtgatccacctgccttagcctcccaaagtgcttgggattacaggcgtgagccaccacgcctggccttcagtcagttctatacctgtgtttctgattcccttcccctcccctcccctcccctgccttccctgagacagagtctcactctgtcacccaggctggagtgcaatggcatgatcttggctcactgcagccaccgccttctgggttcaagtgatgctcctgcctcagcctcccaagtagctgggattacaggcacgcacaaccatgcctaatttttgtgtttttagtagatacagggtttcaccatgttggccaggctggtcttgaactcctgacctcaggtggtccacctgcctcagcctcccaaagtgctgggattacaggcatgagccaccacatccagactcttcatcttctgttattgaagtaaagtacagatttctcagctttttagtaacatcaccttttgttcttcccctggacaggtgtaaactccagccatattgaactatccagcacctggtacccagccttccgtgcttcagcttctgtagctccttcttccttaagtgctttttcgtgtgctgcctattaaaatcctacctgcttttcaaggcaccattaaataccaccttcttagagagaggtccacagatactaacatagagcagagcctgacagataataaacactcaataaattgtaggtattattaagtgagaattgttcataacttcttttcaataccatcattacctggttcccaataaatgaactgtaaatattttgagtaatatacatctataaactaagacaaagcagtattatcagtaagtgtaagcaagtttaaagtgaatgcgtaaatgattaatgtgtagaatttatttttaatctcagtttaaatgtttgtcagttttaatcagagcatagtgagaaaatgatttcatgggcagacatggacatttcttattcttcatacttaatcacaaaccccaccaatctataataagattgatttcgagtactgtcagtctttttttgtgaaacagaatcctcaagctcctaagaattctgttttttggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaaccttgggagacacagcgagactccgtctcaaaaaaaaaaaaaaaaaagaattctgttttttaatacctttaatgtacttaaattgctaatgagtgtatatgtctgcctcatataaaatacaccaaaaacggaagtcttcacataggaagaaacaagactttaaagtactgtgtattgcattaaccatattaacatttgttgcttttcacacggtagtaaatatggtgttgaaaggaggagacgggcgggcgcagtggctcatgcctgtaatcccagcactttgggaggctgaggcgggcgaatcacaaggtcaggagttcaagaccagcctgacgaacatggtgaaaccccgtctctactaaaaatacaaaaattagccgggcatggtggcacacgcctgctactcaggaggctgaggcaggagggtcgcttgaacctgggaggcggaggtcgcagtgagccaagatggcgccactgtactccagcctggacaagaaagcgagactctgtctccaaaaaaaaaaagtggtagccgtattggaagtggtatagctgtgaggatcagattggttcattgctttctgaccttctgtgggcattggagaacaatagtaatgccaagtgccctatttacagggtcagggccacggacagacctaagtatttctacaagaaagcaagtaccttcaggatgtgggggtgggggggttatgagaaatgatagaacaaataaacatcagtgaaaggaactgtaccttaccacaaaaggaaagctttcaaatgaataaagtattaagaataaagaataggctgggcacagtggctcatgcctgtaatcccagcactttgggaggccgaggtgggtggatcacatgaggtctggagtttgagaccagcctggccaacatggtgaaactctgtctctacttaaaaaaaaaaaaaaaaaaattagctgggcttggtggcttgtgcctgtaggttgtcccagctacttgggaggctgaggcaggagaatcacttgaacccgggatggggagattgcagtgagccgagatcacgccagtgcactccaacctggatgacagagcaagattctgtctttaaaaaaaaaaaaaaagaaaagaaaaagacatttgaaatatccttgggtcacttgagcctggggcccactggtatttcatgtatcttggggctaggacaggtggaagctgagttgtcaagaccaaagtacttctggctaacagcctgttccttatggcatttgtggccacctgtaggatttttgttgtcatatcttcattgagaggcatcagataaggatactgtttttttcccgccctgcaaatttggttacaactgcagtaaagaagacatgagctatttagaacatacagttgtgtccttgaggaatttcatctaattggatggagactgcttgaacaggaccctgctgggacatgtgaggtttgtgaaataagcacccatttcttgtgagcctgctctttgcccatttatccagagctgtggctccccttcattctgagttggctgaaagggctccttgcctccgggtgacccagtgcaccatcctccccattccattctttcaacaaactgctacctgaggaaaagttataaaaatataaatgttgccatgcttaaagtctgtgcttagcatcctttggtggcttcccaggataaaattacgaaaatataaatatggcctggctcttgctcaccctccagcttcccctgtcatgtccctgtgtgtccgcctctctgcaggcactctgtcgccccaggttcccacaggcctctgcaccactgccccacatctcctctgcctggaatttactctcccttctcttccccctggttagccattggagccttctctttcaccctacccggtcctgcagccttcagcctcccctcccccagcccccgaccatggctttcataacatcctgtgcctctcagtttttcacctggatttaagtttttttcgttatccttgccttatgatcactctttaaaaagtagtcggctgtactctttctgctcctctccccatcctctccatttccttacttgaaccaaagttaccacacatcgtctggttgcatgcagattcagtgaatgctttccagttcttacttttctcagtctctcctgtttgaaatgccttccttctttgtcttgggaaacaccacccttttctggttctgctacatggttaagcagaactacatggcctctggagttggacaacaaaggttcttttttttttgagactagtctcactctttcacccaggctggagtgcagtggcacaattttggctcactgcaagctctgcctcctgggttcaccccattctcctgcctcagcctcccaagtagcgccagccaccatgcccggctaattttttttgtatttttagtagagacagagtttcaccgtgttagccaggatggtctcgatctcctgacctcatgatccacccgcctcggcctcccagagtgctgggattacaggcatgagccacggcgcctggcctaaaggttcttactccattatcatttctttccactttctttaactgattcctcatcctcatgctgctcctgagttctgtcttccgacttcttttcttgaaattctctctctgcaggagtgctaatcactgtggcttctgttaagaattcccaacttgatctctctcctgatgctgctggaaggatggaaccgtcatctcctccatctgaatcactgacaggcattcttagatttttaaatcaggatgctgaaaactatctttgtcccttacctccaccttctttttgtacctcccagacccaggcccacctctcacgtttataaggtctaggtcaagaatacaaatggagccctacataccattaaaaaaaaaaaaaatcaacctaagaaacattaagcagactttgctctctcctcctgccatgacagatatgccttcttttccttttttttttttttgagatagggtctcactttgtcacccaggctggagtgcagtggcacaatcatggctcactgcagcctcaacctccctggctcaagtgatcctcttgcctagtcccccaaatagctgggactacaggcgagtgccaccatgcccagctaatttttgtattttttgtagagacagggtttcatcatgttgtccacactgatctcgaacacctggattcaagtgatctgccctcctcaccctcccaaagtgctgggattacaagcgtgcatcaccatgcccacaccaggcctaatataccttcttaatgacctggaaggttgggttcaaatagaaaatactcaggctccttagagttctatgtcagtagttccggcagagcagaccttcagcatagtgctcttcccttcccagccacagcactatccatgtgttgtgagcttgagcacgtgtgtggcctcctgcctgcacaatgtaggtgcaatacacgccagcaagcagctgcccctttgaccaccacctcaagtgcacctgctgggtacagactacacttttccagatgcagggaattcccgggcacctgaggagcattttccccgaccccaataaccttctctcatgggcatgggcatgtctgggtgagggttagtggccagtgaccacagatgtctcagtctcttacctcgcctcctgtttcctctttcttttctttgcggtcttgcttttctgtcagaagcctactcatccttcaggataaggcttttgcgggcctcatcttcttttaatccttcccttagtatttgaagttaacccagctcctccttgggtttcagaagtgctttaatgtgataaaaggcaaagtatgttctctgttcctgtctccttctctcacaaaattgcaagtttcttaagagcaggatcattatttgtttttgccaccagtcctaacatgaagcctcacaaatgggaagttcttgacaagcgtggcttgaattcaccagaactctgtcttcatttcgtgttgttgtggtaaccctatcaaaacaggaaataaagctagtttagcatgacttgttcataattgactcatgctggttccctttccttccctaagcaatcataaaacatctgttaaataatctacttcagaatttcatggacttctacgtttattgatcggtacacttctagaatctgtatcccaattgccccagcactggaatgaatcatgtggccaaagaaccctggttctttttttttttttttaactgctttactaagaagtaattgatatacaaaatattgcacacatttaaagtataaagttggataagttttaatacattatacacctatgaaaccatcaacacaattaggataaggaacatactcattgcctccaaaagttacctcatttccatttgcaatcttcttcctcccattcccaggcaatcctgggggtaaatccaaagtaaacccaggattactttgtattttctatagatggaaatacatttcttttggtctggcttcactcaccataattacttgagattcatctgtgctgcatatatcaatagttcatttcctgttattatcaaataggaatctcatttccttttattatcaaatagcaggaatctatctgttttgagacttgagatgggtgtgctcacttcagaccttaatgtcctcccattctccataatttatgggtcttaggatagaattcatctgggacttgaggttgtgttcatttaagatgactagacactctcaatatcttgggttcctcaagggaagagtattattattattattattatttttttttttttttgagatggagtctagctctgtcgcccaggctggagaacagtggtgcagtctcggctcactgcagcctccgcctcccgggttcaactgattttcctgcctcagcctcccaagtagctgggactacaggcgcatgccaccatgcccagctaattttttttttatctttagtagagatggggtttcgccatgttggccaggctggtctcaaactcctgacctcatgatccgcctgccttggcctcccaaaatgctgggagtacagatgtgaaaaccacccccagcccagagtattatttataatttttgcgtcctaatgttagaatagttcttgatatatagaaggtactaacccaaagctggataaaagtttccccctttattggccaggtgtggtggttcacgcctataatcctagtactttgggaggctaaggcaagaggatcacttgagttcaggagttcgagatcagcctgggcaacattgtagaaccctgtctctacaaaaaaactttttaaaattagccaggtgtggtggtgctcacctgtggtccccactatgctacttgagaggttggggctgcagtcagccataattgtgccagtacactctagcatgggtgacagagtagcccatctcaaaagaaataaaagggccaggtgcagtggctcacgcctgtaatcccagcactttgggaggccgaggccgaggatcatgaggtcaggagatcgagaccatcctagccaacatggtgaaaccctatctctactaaaatacaaaaaattagctgtgcgtggtgacgggcaccagtagtcccagctactcaggaggctgaggcaggagaatcgcttgaacccaggaggcggaggttgcagtgagcccagatggcaccactgcactccaacctgggcaacagagcgagactccatcaaaaaaaaattaatacttaatttttttccctctttaacatgtttctttcccccttaaaaaaattttttttaagctaggtgccatggcatgtgcgtatagtcccaactactctgaagcctgaggaagtgatctcaggagttcaggaccggcctgggcagcatagtgagacttcatctctctctctctctctctctctctctctctctctctctctctctctctctctctctgtctctctcgctttttttccccctgagatggagtcttgcagtgtcgcccagagctggagtacagtggcgtgatctcagctcactcaacctttgcttcccggattcaagcaattctcctgcctcagcctcctgagtagctgggattacaggcgcgtgccaccacgccctgctaattcttgtatttttagtagagacagtgtttcaccatgttagccaggctggtctcgatctcctgacctcgtgatccacccacctcagcttcccagagtgctgggattacaggcgtgagccaccgtgcccagccgagacttcatctctttacaaagtaaaattgttttggttaattatatgttttggtaaaaagcatacaatttgccatcttaatcatttttaagtacacagttcagtagagttaagtatattcacattgttgcacaatagatctagaactttttcatcttggaaaattgaaaacctgtactcttgaacacatctccccatttctccctctcctcagccatttttaaccaccattctcctttctgattctatgagtttgttaattttggatacctcatataagtgaaattatgcagtatttgtcttttgtgacttatttctgttgatataatgtcctcaagcttcatccatgttatagcatgtgatagaatgacctttttggtttttcccccacctttattggggcataattgacaaataaaagttgtatatatttactgtgttaaatgtgatgttttgatatgtgtataccttgcgaaatgatccccacagtaaagctaattaagatacccatcaactcacatagttaacgtttgtgtgtggtgggggcaagaacatttttttttttcttctttggagacagtttcactcttgttgtccaggctggagtgcagtggtgccatcttggctcactgcaacctccgcctcttgggttcaagtgattctcctgactcagcctcccaagaaactgggactacagacgcgtaccaccacgcctggctaactttggtatttttagtagagacagggtttcaccatgttggccaggctggtgtcaaactcctgacctcaggtgatccgcctgccttggcctcccaaagtgctgggattacagacgtgagccaccgtaggtggctgataatagccattctaatagctgtgaggtgatatctcattgtggttttgattggcatttttctgattagtgatgttgagccttttttcatatacctgttggccatttgtatgtcttactttgagtaatgtctattcgggttctttgcccccactccctaccacccgcacctgcttttttccatttttgagacagggtctctctatgttgcccaggctggtcttgaactcctggtctcaagcagtctgcctacctcagccccctgaatagctaggactacaagcaggtgccactgcacctggcctttgcccatttttaaatattttgtttgtttcctgctgttgaattgtgtgaatttcttatatatttaaatattagccccttatcagatatgtggtttgtaaatattttctcccattcattgggttgtctcttcactctgttgattgttgcttgtgctgtgcagaagctttttagtttgattcaattccatttgtctgtttttgcttttgttgcctgtgctttgggagtcacaaccaaaaaataattgcccagaccaatgtcaagaagctttccccctgtattttcttctagtagtttttgtttgtttgtctgttgtttatttgtttgcttttgcttttttttttttttttttttttgagacggaatctctctctgtcatccaggctggagtgcagtggcacgatctcagctcactgcaagctctgcctcccaggttcacgccattctcctgcctcagcctcccgagtagctaggactacaggcgcctaccaccacgcccggctaattttttttttttttttttttgtatttttagtagagacagggtttcaccgtattagccaggatggtctcgatctcctgacctcgtgatccacccgccttggcctcccaaagtgctgggattacagggtgagccattgcgcccagccttttctagtttttataatttcaggttttacaatttttgtctttaatctgtcttgatttgatttttgtatagggtgtgaaataagtatccattttattctttagcaagtagatatccaattttcccagcaccatttattgaagagactatcctttatgtttggactctttattctgttccatttgtctatttgtctgtttttatgccagtaccatgctgattccctgccccccacccagctttattaaggtataattgacaaatacaaattagtatatgaaactgaggtggaagtgctggaaaaataattagtatatattcatgatatacaacatgatgttttgatatatgtgtatattgtgaaatgattaaagcaaggtaattaacatatctgtcatctcacatactttttgtggtgagaatgtttaagatctaatcttttagtaatttgcaagtatataatacattattattaactgtagtcaccatgctgtaggatagagctctagaacttattcatcctggttaactgaaactttatactctaacaaattatctgcacatttcaccctatccccgcagtgttgtgctgttttggttactatagctttgtagtgtattttgaaatcaagtgatgtgaagccaccactttgttcttgctcaggattgctttggctatatgggatcttttgtggttccatatatgaatttaaagattacattttctgtttctgtgaaaaatgccattggaactttgatagggattacattgactctgcagaccacactgagtagtgtagacactttaagaatattaagtcagaccaggcacaatggctcatgcctgtaatcccagcactttgggaggctgaggtgggaggatcacttatgaccaggagttcaagaccagcctggataacatagtgagaccccatatctaccaaaaagtttttaaattaaaaacaattggccgggtgcggtggctcacacctgtaatcccagcactttgagaggccaaggcgggcagatcacgaggtcaggagatcgagaccatcctggctaacatggtgaaaccccatctctaccaaaaatacaaaaaaaaaggaaattagccgggcgtggtggtgggcccctgtagtcccagctactcgggaggctgaggcgggagaatggcgagaacccaggaggcggagcttgcagtgagccaagatgcgatactgcactccagcctgggcgacagagcgagactctgtctcaaataaataaataaataataaaaacaattaggcatggtttttggatgctgaattgaatttctttgtgtgtgtgtgtggttttttttttttttttaaagactgaataatattccactctatgtatatgctacattttctttatccattcatccatagtggacatttcggttgcttccacatcttgggtattgtgcgtaatgctgcacaatgaacctgccagtagctcttagagattctactttgaattgttttggatatatgctcagaagtgggattgctggaccatatgggaattctatttttaattttttgaggaatttccaagtggttacaccattttgcacactcaacaatagagtatgaaggttcaaatttatccacatcacacttacggttttctgtttgtttgtttgtttgtttttaaatagtggcagtcctggctggtcgtggtgggtggctcacgcctgtaattccagcactttgggaggccaaggcaggcgggtcaccaggtcaggagatcctgtaattccagctactcaggagactgaggcaggagaattgcataaacccaggaggcagacgttgcagtaagccgagattgagccactgcaccccagcctggcgacatagcgagactccgtctcaaaaaaaaaaaaggcataacgttgaatacacgtttcaaaagaagacataagaaaagatggtcatcatcatgaatcagagaaatgcaaatcaaaaccacaatgagctatcaccacacacccattaggactgacccccactttttttttttttgttttttgagactgagtctcactctgtcaccaggctggagtgcagtggcgcgatcttggctcactgcagcctccatcacctgggttcaagccattcttctgcatcagcctcccaagtagctgggactatgggcgcgcaccaccccacccagctaatttttgtatttttggtagagatggggtttcaccattttggacaggatggtgtcaatctcgtgacctcatgatccgcctgccgtgacctcatgatccgcctgccttggcctcccaaagtgctgggattacagacatgagccaccgcacccggccttcttttttaatgaaccatctttggattcctgtgataagagacacacttatagcaaaaacctgtagtgtggtggtagttagggacaaaaggggttgagcaaaacaagacacagttggtaatgtcaaagtgattttaaagcataaatgtttatagacacctgaaagttcatggtatgccttatttaccaagtatcaacaataaaatatgtaaaacaaaaccgagaaatccaaggagaaactagcaagtatggaatcattatggaagagtgtaaccctctttgtcatcagttctatgaaagatagattgcataaaccaaaaaggcagcagaatggttaagcggagcagacaggaacagacaaaactcctttttttcaagtgggaccagatgaggatgatctcatattttcttacttaaaaggaggcagttggccgggcatggtggctcaccctgtaatcccagccctttgcaaggccgaggcggggcctatcacgaggtcaggagattgaaaccatcctggctaacacggtgaaacaccgtctctactaaagatacaaaaaattagccaggcgtggtggcggggcctgtagtcccagctactcgggaggctgaggcaggagaatggcctgaacccaggagggggagcttgcagtgagccaagatcgcaccactgcactccagcctgggcgacagagcgagactgcttccacaaaaaaattttaaagaggccgggggggagggcagttatttcgtcactgagtgttgatacagtagaggggcacactgaccataaactcctctctccaaaaattttgttggattataattttgcagaacaaattatgaccacttgtgactgttaacactagaaatttataatattaacactagaaaattgtaatgttgagtttaaaccagcattttataactaatccgtgctgttgttgaactcttgttctatgatttgaattaccaaaatagaatttttttctaaaaatattcccaatattgaataagcttgcttattatatatgctttttaatactatgttaaattattactattatatatgctgttgcctaactgaaaatcactggcttagggcctcatgtaccaaaccaaagcaaaataagatttgagtagtggttattttacttaagaaaatatacttcatttcaaagcatttggggccacctgtgtactatatgttaatggtgttgtaggataattggatcctagtaagacaaagttctcctccagagcattatcttgtcatagaatcagacaaatgtatcaataattcttaggattagtagactgataaatattatagaagcataaactttatttaatttagagacggagtctcactctgtcgcccaggctggagtgcagtggtacaatcttggctcactgccacgtgcatctcccaggttcaagtgattcttgtgcctcagcctcccaagtagctgggattgtaggcacttgccaccatgcctggctaatttttttgtatttttagtagaggcggggtttcaccatgttgtccaggctggtctcaaaactcctgtcctcaagtgatccagccgccccagcttcccaaagtgctgggattgcaggtgtgagccactgcacccggccctagaagcataaattttagaataaagttattttactgctttctattctagcacttaccccaaggaaacaagaaatgttgtcttactgcctgtcaatgttatttgattgctttggtcagtgggccagatgttgacatttattaatatgaaaatttcttatacacaagattgtaatagaatgtttatcataaagatagtagtaatactcaagattcaaattcataaaattgaaggtataatttttattattgcttttgcttataattctggtttatcagacattaaggacaactaggaaagaactgggccccatgttattgccacaaatatgttttttgaagaatacttttctaggttttgttataaaactacccaaacatcttgattcagtttcttgggggaagaaatggtcatgttgttttgcaagtgagagaaacaaagttaatagaagtaatcaaggtgttctcttgggtccatttttgttagggataaagatgtacagttgtaggttatttgaatgtttcttctgtgtcagaggaatttgatacaacagtaagaaggtgtttcagagacagaagtgattactctcaccagaatgcagttgctgtttaagacaatgggagaatgcttgtttgtgtatttctgggtttataaaggcaagactttcacccagttaacagggctaggttctctgttagttttgagagtcactgtgtgctctctcatgtcagttgcatccatcctccctagcttgaggcctttttgtggataatatacatgctgccttcacgggtatgaaacaggtgtttacacagtgttaaaaatataatactttaccaacttgccttcttcaaatattctgagggctgtttttaatgccatctctctctctcttttttaagctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtgtatcctttttaggcaactggccaattccactgcttggtaaccttgttgagtaaatagaacttgaaatttcctgaacttaaaggaaaagtgcattaaacatgctaaagggaaaatcgtaatctgtttgctatttactccctaagtctagtcatggaaaatcttggttaactctgtttgcagtcatgtttcttctgtccaagggatggtttgttgtgatgatgaaaaggtaaagggaagatcagtagtagactaagaaagagggtgccctggctatctacctggtgaaatcaggactgtcctgatcttaagagtcaggttaccactttaggtctcagtttccccacctttaaaatgaaggaactggtcgtcatgatctttaaggtcaactgaggtctgaaattatgtgattaactctgaccaacatttagaaatctggactgaacagatctagaggatgctgcctgggtaaaggctccatttgaaagatagagaggttaagtatactgaagaggatctgccagaagggaaagggttatacagcactcctaccagtttacccaatttgtattccgcccctccagggtgcgggagctcgctgtttctaggcagccctttccatttttaaacagctctgttaataagttgtagtgatatttgaagtgaaatgcctcctgccactaccacctgttggtcctgctttactttttgccatgaaaataagcctctctcagatgacagatttttaaatcatgtttcctttgaatcccatgctgcgcctcctatagcataaatctgtaagaaacagagactagtgtttacacagaagtgagtaaaagaaatgtagaaatactgctaatgaaataatactatgatgaagttaaaggctaaatgctttaataatttaatttctgtgagaaagaaagtagccatagctaaacttttaggtagttaagtacgtgaccaggcaagaaagcatgaggaggaaaactagcacaaaccccttcttagaacgacttgcccatagtcttacttatttaagatcttaacagtaatggaagagtcaagaaaatagacttagggttggatttactagtaagagtatgtttctagacctgtatttctggaagttttatgtttggcttttgaggagcttgggagaggaggggagcggcaacaagaagtaaaaagaatagtgacattacaggttactggaccaaacagaggagggagtatctgctacttacaggctaacagtgtttccagcaaaccttggagggggttcgttgatggtggacaatttagagagcaaagaggttgagacttcaagattgaccagaatttccctaacagcctgtttcagatctcagtctaggcccatagccgcatcagtcagatgtaatgctggaatgcctgccatctcacaggacctaaaaggagttaacgacttcagattctttccatgaaggaaaccaagttttcctcagtttcttctttcctttaagggcttcatggtgtaatgatggactgtttgggaagagagtcaagagaggatgcatttttgttttcaatgctttgctaaatgtgaccagctaattggtgttttaccttaacctgtgcaaacagatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaaggtcagccaggttatttactattaaggtgatatatattgaaaaaccctttcactgaagcatagttatatttgtcattattcatattttaaattacaccagaaatacccaaaaacatgtttatggcaaaaatgctaataaagtgtggtagtcctcttcttcttccttatcccattgctcctttctccccagagataccttttttttttttttcttaaagacagagtcttagtatgttgcccaggccggtctggaactcctgggctcaagcagtcctcctttcttggcctcccaaagtgctgggattatgtatgtgggccacagcaccaggccgtgataactaactactataacaaattggtggccagttgcggtggctcacgcctgtaatcctagcaccttgggaggccaaggtgggccttatcacctgaggtcaggagttcaagaccagcctggccaacatggcgaaaccccatctctactaaaaatacaaaaatcagccgggcgtggtggcatgcgcctgtaatcccagctacatgggagctgaggtaggagaaccgcttgaacctgggaggcggaggttgcagtgagccgagatcacaccactgcacgccagcctgggtgacaaagcaaaactctgtcctaaaaaacaaagtgtattttctcccaaagtattttctatgctcttgcatacatgtgtatttttatactttatatagataaacaggatcacgtacattatgtgttagtttttttgttcgtttgtttgttttttgagatggagtctcgctctgtcacccaggctggagtgcagtggcgcgatctcagctcactgcaagctctgcttcccaggttcccgccattctcctgcctcagcctcccgagtagctgggactacaggcacctgccaccacgcctggctaatttttctttgtttttgtatttttgtagagatggggtttcaccgtgttagccaggatggtctcaatctcctgaccttgtgatccgcccaccttggcctcccaaagtgctggtattacaggcgtgagccaccgcgcctggccttatgtgttagttttaaaatcatgttttgttggtgacatttttcttcaataaattttattcaaaagatagcagcagaaaacttaacgtcactgactttaatacctaataaggcattccaactaaataagaaaaccccaaattctttacagtcctcagagttctgaaaatatgcagcatttacatatttctgttttaatgggtgttacaggtaaacgagggaaatttatggatatcttagatgtgacggagcgatgtcgattcagtctaaaaaaatgcacaggaattcaagaagacctaaataaatgggaaggcatcccatgtctgtggatcataagacttaatactgttaagatggcagtattctccaaattgatttgcagatttagtgcaatccctatcaaagcccccagttgtttttttctgtagaaattgacaggctgatcccaaaattcatatggaaattcatatggagaactgatacacttcctgatttcaaaacttactgcaaaacacagtaatcaagacagtgtgctactggcataagaatagacatataggtcagtggaatagaagtgagagtcagtaaataaacccgtgtatctatggtcaactgatttttggcaaggatgccaggaccattcactggggaaagaatagtcttttcagcaaatgaatctgggacaactgaatagccacatacaaaaagatgaaaaaattaactcaaaatggctgggtgcagtggttcgcgcctgtaatcccagcactttgggaggccaaggcctgtggattgcctgagctccggagcaagaccagcctgggcaacatggcaaaaccccatctctaccgaaaatacaaaaaaattaatctgggcgtggtggcatgtgcctgtggtcccagctactcaggaggctgagtgggaggactgcttgagcctgggaggtggaaattgcagtgagcagagattgcaccactgcactccatctggggtgacagagtgagaccttgtctcaaaaggaaaaaaaaattcaaaatggattgaagaactcaattaaaagctaaaactttaatactcttagaaaacatagaagtaaatctttgcaatcttatgttaggcaaagcttcttagacatgacaccaaaagcacaagcaacaaaagaaaaaagtaagtggattccatcaagattagaaacttgtgctacaaagcaaaccatcaaaaaagtgaaaaggcaagccacagaatgagagaaggtatttgcaaatcatacatctgataagggacttaaaactagaatatatgaagaactcttataactcaataatgaaaagataaatagcctagtttaaaaaatggacaaaggatctgaatagacatttctctaaagaagatatacagatggcaataagcacatggaatgatagatgcttgacatcattagtcagtagaaaaatgcaaatcaaaattacattgaaacaacttcatgctaactaggatggctgtagttaaaaagtcagataataagtgttggtgaggattccactccttagtgaaaatgaaaacatgcatctatacaaaaacttgaacacaaatcttcatagtggtattgttcactatagccagtaagtagaaacaatccaaatgtccagctgatgatgaataaatacagtgtggtggatccacacagtagaagagaaaggagtgaagtactgataatgctacaacatggatgaatcttggaaacatgtctgtgaaggaaggcagccacagaagacacatattgtatgattctgtttacgtgaaatgtctagaataggcaaatccatagagacaaaaattagaattagtggattactgattgcctagggctagaggagttgggagaataaagaaggaaggaatactaactcactggaatttctttttgaggttataaaaatattttcaaattggatggtggtaatggttaatttccaccattataatactaaaaccattgagttatacactttaaatgagcaaattgtatggtgtgtgaattataggttaataaagctgcttaagtacatatatatgtatagcaataatcatttattggatttcagttcaacagacactcctatgagaagccctttgagatacgccagacaagagagatgagggtctgcccttgaaatctgaaaactgatagatcagaaatctggtagacagtaggtgattataatgagatgttctgtaactgagatggagaaaaagatggtgtacaaatgcaaaggagagaggtgggctagcgctggctgggactgggaggcagcaggaagaaggtggtatctgtgccggccctcgaggttgggtagcttttcttgcgggaggccagtggctctattggacatagggtatcataggcagagagtacagaaataaaataagaaggaagggactactaccgaaagcactgagtcttcctccctgtggctgcagcattggatgagtaatagggagtcatcgacactaagctaaaaaggttggttgcaagtagatcgtggggaaccttctagaactgtgtgtaaaaagcggtgggttttgtcacggtgggtgaacacggtggccaatgtccagtgagatgtaaaggacagcttccttcatcagatattgtgtggattggactctgtcccctcttaggatccttctgatacaggtttatgtcttttccacatgggatggaaccagctcctttacctggatcagtgcaaccaagagtcaggtgggcacaaaacgaataaagctatgtttaggatggctgtactacttctttggcacttaatgattgtcttgaaaatttgcagtgaatatttttatgtctcctcgtgttttttttttcttttggttatcatcatagccctgttatggcagattgcttttgtttttggagagacattctcaatcaatattttaagcatataacatttctgggaagaattggctcttatttttgcttgaaagtgttcatctttaagaataaaacaaatagaaccagactactctctctgttgtctcttcccagtttatggacttgtctttaaggccattctgttcacctactcacactcacacacacgagttgttggccgtggcataatttaggcatcgtcttgaaaacccaagttaacacaaagaatcagaagcataacaaattgactaacattttattttattttattttatttttattttatttatttttatttttattttatactttttcgagatagagtcttgctctgttgcccaggagtacagtggcatgatctcagctcactgcaaccttcacctcctgggttcaagcaattctcctgctgaagcttcctgagtagctgagattacaggtgcccaccaccatgcctggctaatttttgtattttcagtagatacggggtttcaccatattggccaggctggtctcgaacttctgatctcgtgatccgcccgccttgacctcccaaagtgctgggattctacaggcatttgccaccacacccggcctttactgatattttaaaagtatacagcagtcaggtgccatggctcacgcctgtaatcccaacacattgagtggctgaggcaggcggatcgcctgaggtcaggagttcaagtccagtctgaccaacttggtgaaaccctgtctctactgaaaatacaaacaaattagctgggtgtggtggcgcacacctgtaatcccagctacttgggaggctgaggcacgagaatcagtgggaggcagaggttgcagtgagctgagatggcaccactgcactccagcctgggcaacagggtgagactccatctcagaaaaaaaaaagtatacagcaatgtgtgtgcatcattctcatgggtataaatgcgagaagagagaatctcattcaaagatgagtatggtatgtcactgatttgttacagtgagcgtgtcaaagcagggcaagaggcagtggcagttcagtgtgcatatgacagttgagaacaccacatgaggagaggacttgtgtttgctggagctctgggatcactgcacatttatcacatcctcagtgccatgtgaccatgatgcctattcccacaggccccttggcctaggaagtttgtaacttgcagcgtcactgacctcctgttatttaggtcctttcagattttcaagaagatttcttcaaccttcatccaatgacttctatgttacagtgttttttactcttgaacccttaccaaaatatcttgaacccttatcgatatcagctattatcagtgtcttagacctttaacttttggctctgttatcagtcaaggccgacagaaataagcttgctttttggtttccataaacatgctttgcacttattttatgaagcttaagacccagcagacattgacatcttaggacccttccgggatcctctcttgtagactttattcttcaggaccacaggaactcaccagggttacagaccctatttggaggctctgctagcacatttctagtgtaactaccagggaacgtgagctatactagtctgtgcccttgtttactagactgatcccacagaaatcccagtaggagtcacaagatgctgggatcacaacatgtgaaaattctggctatgcctatgaaagaaagactctgatagatacaaatgaaacacgtctttggggcatcctttgtttttgaaaatctgaatttacacagcccaaaaggtatattttcttgtaccatatccttatttattttcctttgtatggaattatactgagtactactgcttttttattttgtagccttggcattgtattgattagtgtcatgtaaatttggttagtctttgattttatagtgttgacagaccttaaaaaaaaatcatggccaggcatggtggctcacacctgtaatcccaacactttgggaggctgaggtggttgaatcacctgaggtgaggagttcgagaccagcctggccaacgtggtgaaaccccatctctactaaaaatagaaaataagccacaccatgatattggagggccagatgatgaaaggccagtagatgcttgagaccggagaaaatgagaaactatgtattttttaaaaataaaatattcttaagtatatgaaactttaaaaaaaaaaagctttgggagtaggtttgactacctagaagaaggaagtgggaagaatctttggaaatacttatatttatagactaagtagaagactagcagaaagtagagtctgagaatagaaggccagtgcagatcttcacagcagtcctgagagctccagcaggacaggctgagaaaagggtactggttggttttggtgactactcagaacagtttttgtcaattcacctattgagattgctttgtgctaagcagataatgaaaggtagggatgcttcttaaagtgtgctctgtaaagacttcttcagcctgcatcctggtctctaacatgttgattgcttttcaggttgttgggaaaattaaataatgattttctagaatgcccagaaagtatctgccacttagtagcattattattcctattgccttttttatttttgtgatgttttgatatgaaaggttagaatttctaagaagttatcctgttttttttctctcttagatctgtgactttggcctggcccgtgttgcagatccagaccatgatcacacagggttcctgacagaatatgtggccacacgttggtacagggctccagaaattatgttgaattccaaggtaaggatgaagtttgcataaaaagaaatccagtaagtaagagaactttctgaatgcattgcagtaagccgtaagtctccctctgcgttgagagtttgcctgtctggccagagacaaggtgctgtcttttttgagacagggtgttactctgtcacccaggctggagtgcagtggcaccatcacggcttaccagtctcaacctcctgggctcaagtgaccctcctcacctcagtctccggagttgctgggactacagagtgcaccgctacacctggctaatttttttttttttttgagatggagtctcactctgttgcccaggcagagtgcagtagcacaatctcagctcactgcaagctccgcctcctgggttcacaccattctcctgcctcggcctcccaagtagatgggactacaggctcccgccaccatgcccggctaattttttgtattttttagtagagacggggtttcaccgtgttagccgggatggtctctatctcctgaccttatgatccgcccacctcagcctcccaaagtgctgggattacaggcgtgagccactgtgcctggccacatctggctaatttttaaattttttttgtaaaagtagggcgtcttcctatgtcgcatgttgcccaggctggtcttgaactcctgagcttaagggatccacccacctcagcaccccccacgccccccgcaaagtgctgggattacagggatgagccaccacacctggccccaaggtgctgtctaaattttgttcggcattgaacttctgggccctagggctcagcctctctacctcagctgatatagtgctgacggttgtagagtaggagggggtgtgcctctccagtcactgttaccataagtggtctgtgtttcactccttggacagctgtcctgaagtcctacctatcgctgtcactgttaggtgcaggctgggtttgttgtagaggttattcagtaatgtgtatttctgtgaacatgggccagggctattctataaaggtcaaatttatctgataatgaagaatgtctcttcggcagaattatattgtaatttgttgtacttgaagaaaacataaatgtggacagagtaggaactgccgtggattcttttgaaattacgtgatttcctgcttccaaatgaagtgctttcctctgcatctgtgagtggctatagagagtgcatccaggtctcatccacactctactagcaaggtctgtgtcttggtcataagaaatggttgaataagtttacaaaagcccagaaaagtgaagtctgacattttttgttgggtttatgagccaggaggcaaaaattgagggctgctatggagattgagattcagtatttttctgttatttgcaaataatatatgaataaggtgtgaaaattgagtagttaagtaggcctgacatactacctgtatctagtatctcaggattataagattcttaaacacagttccctctgctgtcatgtaaagatacttgaagaaaagcaataaaaatagacattggatcttgtatctagggcccaggaaccagaaatagtcctgagaggcttagtggaaatgaaagaacaggtctaattagcttatagtcttctttttcttcctccatcctttattactagtacagataagctattagattttttcataaggaaatggaatttgtttaaagcatttagtttttcttgatatcctacatttgttcagtttagttataaaagtaaaatctcattaacataaattccattataaagaaggatttggtgtaacagatgtttcagagaagaaaatgccatgttgattctctgtaattctatatcacaaataatcccacacaacaggttctttctctgactggccacgtgacagccattctaaacaaggagcattggcatgccagtgttcagtgccagttgtaaagggagctgttggtgtgcctttgtcctggtgtggcttggtcttgcagtctccgttctgacttagacgccgccactgtctccacttctctattaccctccagggagaagtagccagagagggtgttcttcaagatgaccagcttttccttctacttgcagggtcaccaaagtgaaaattgagtgttcatttttttcttatttgcgatacctgtagcctgagaatgttacttctagcagttgtcttcattttgtttatttttattaatgtagaaaattatcaaacccatagaaaaattgagagtagagtgaatacccatatgcccctgtccttggttctccagctattaacaccttgtcatatttcttatccctccttccctctcttactctttcctttctctctctctttcttcttctgtctcttctcttttgtcagaccatgtgacacttcaccaacatataacacttcactcctagaccctttggggcatactaatgctccttacaaggaaggtgttcttcccacagctagagtacccttaccctttcataaaatgatcagcattaattccatgacatcccatcctcccaaaaaagtctaggtaactctgttttcaacacatgatttaattgtttcatgcattattcttagtctagaacagtcttgcccttcctctcttctttaagacattcagtactttgcaatgtacagatcagttgtttcacagagtggttcacattgtggattcctccagtgagttctttctgatgagatgtagcttgcacgtttctaacacgaccactacagattcctgaagacggtgcagaagtagctgggactacaggtgcccgccaccacgcccggctaatttttttgtatttttagtagagacagggttttaccatgttagccaggatggccatccttgtttcccagcagccttcccccagtggttcagcactcacttctgtcagttatcatactggaggttataaaatggtaattttctaaatttgttctttcttttacttgtattagctagaattctcctatgaagatttttcccatttaccctttctcttcctctgtatcctacctttgtttttaaaacactattgcagacccaggattttttttttatgtgttctccattttaattttctttcttttttttttttaaactcatattgtcccagttttgagaagctagagcactctgtgtacatatttgtaacgttttatagaatttcagctttcagaaaacttgcgctgttttagcttgtttaggaaagaaaaaaaattttttaaagaaaagttgctgggtgtggtggctcacacttgtaatcccagcactttgggaggccgcggtgggtggattactcgccaggagttcgataccagcctagccaactttgtgaaaccccatctctactaaaaatacaaaaaattagccaggcatgatggtggacacctgtaatctcagctactcaggaggctgaggcatgagaatcgtttgaacccgggaggcagaggttgcagtgaggcaaggtcacaccactatactccagcctgggtggcagagtgagactctgtctaaaaacataaaagttgcaagaaaagtataaggtagccattctcaaaccttcttgtctcaggatacctttacatttctttctttcattggttcattctttcttttgttctttctgtttttttttttttgagaccgagtctcactctgtcacccaggctggagtgcagtggtatgatctcggctcactgcaacctctgcttcccaggttcaagcgattctcatgcctcagtctcccaagtagctgggattacagatgcatgccaccaagcccagctaatttttgtatttttagtagagacggggtttcaccatgttggtcaggctggtctcaaactcctgacctcaagtgatccacccccctcagcctcccaaagtgctgggattacaggtgtgagccactgcgcccagcctcttttttttttgagacagtcttgctctgtcacccagatggagtgcaacggcaccatctcggctcactgcaacctcggcctcctaggttcaagcagttctccctgccttagcctcccaagtagctgggattacaggcacctgccaccacgcctgcctaatttttgtatttttaatagagatggggtttcaccacattggctggtctcaaactcctgacctcagatgatccacccacctcagcctcccaaagtgctgggattacaggcatgagccaccgtgcctggctttttttttttttttttttttttgagacggggtttctctctgtcacccaggctggtagccaccccctcctcaagcgatcctccagccttgcctcctgtgtagctgggactacaagcgtgtaccaccatgcccggctaatttttgtatgtttttgtagggacagggttttgccatgttggccaggctggtctcaaactcctgggctcaactgatccacccacctcagcctcccaaattgctaggattgcaggcatgacccactgcgcccagccaagatccctttacatttgttaaaaattatcaaggaccagctgggcatggtggctcacacttataatcctagcactttgggaggccgaggcgggtggatcagttgagcccaggagttcgagaccagcctggccaacatggagaaaccctgtctctactaaaaatacaaaaaatgcactgggcatggtggcacacacctgtaatcccagctacttggaggctgaggcaggagaatcgcttgaacctgggaggtggaggttgcagtgagccgagatcttgccacagtactccagcctgggtgacagagtgagactctgtctcaaaaaaaaaaaaaaagtcaaggacccacacacctttttttagttacgtaggttatatctattgttatttacaatatgaaacttttttttttttaatttttggagagaagtctggcgcttgtcccccaggcttgagtgcaatggctcaatcttggctcactgcgacctctgcctcccgggttcaaatgattctccggcctcgcctcccgtgtagctgagactacaagtgtgtaccaccatgcccggctaatttttgtattttttagtacagatggggtttcaccatgttggccaggctgctcttgaacttctgacttcaggtgatccacccgcctcggcttcccaaagtgctggggttacaggcatgagccaccacacccggcctacaatatgaaactttaaaatgtattaattaatttttaaatagtaaacccactacatgttaagataaattacatgtttttcttaagaataagtttattttctacaataaaaacgttttagtgaggccaggcatgatggctctcacctataatcccaacactttggaaggccaatgcaggaggatcaccaggagtttggaaccagccctggtgacatagtgagactctgtacaaaaaagaaatttatttatttatttatttattttttgagacggagtcgtgctctgtcacccaggctggagtgcagtggtgtgatctcagctcactgcaaggtccgcctcccaggttcacgccattctcctgcctcagcctcccgagtagctgggactacaggcgtccgccaccacgcctggctaatttttttgtatttttagtagagacagggttttaaccatgttagccaggatgggctcaacctcctgaccttgtggtccacctgcctcggccttccaaagtgctgggattacaggtgtgagctgctgtgccctgccatctgtacaaaaaattttaaaatcagctgggcatggtggtgtgcacctatagttccagccactcaagaggctgagatgggagattttcttgagcccaggaaattgaggctgcggtgtaccgtgatcacgccactgcactccagcctgggcaacagggtgagaccctgtctttaaaaaaagcaaaacgaaaaacaaccttttagtgagaagagtggcattgttttcatttttgcaagtctctttaatgtctggcttaatagaagacagttggattctcatctggttctgcattcagtctgtcaaatatgttgttttggtttaagttcatgaggaaaactcttttttttttttttttcaggctttaatcaatttaataatcaatataatattacatgcatagttcttcaaaaatgtcaaggaaaactctttcccatggattttaactgcttgaattcagagcatagaaaacagaagaaaacttgagtgcaatattaataaagaccctttaaaaaagatgttatataaaaagaaaaatcgcaagccagtgaaaaatacatgcaaaattctaaataacattttagcaaacaaaatctatgcttaaaagcataacacacaaaaaagtgagatttttccctagtatgtaacagtaatcagacattttatcaagacatttacaaataagcctaaaaatagatgtctgagtgctatttatgaaattcaagatctattcctcccatccaagcactaaccaggccaaccctgcttagcttccgagatcagacaagatcgggcgtgttcagggtggtatggccagaggaaaactcttcacacaggtatgtagctggaaaaaggagggaaattttagtagtcttttcagccacttgtggctattctttgatcctacccccagtttaaacaagtggtggtttcttaaaggttaattgcagtgtggaatctgaaatcatatcagtgaattcttgatactatttcgttaaaatccattagtctaccttgcactcatactcatgcatgattttttagcgtatttggaaaatactggttcactgagttacacagatattccaagtgtcacattttcatgtacacatcatcactcatcatattgcatctggaaaaatcttcttttcactcgtgactgaaaaggatgaaaatgtcatagtagtataataaatgtactgtgacctctcagatcctctagagggaacccataggagtctctggaacactcttgtagaaccgccagatagaactcctaaataccctttaccccagattcaggctcaccgattttttatcttttgccccatttgctttatcattctttgtgtgcatgtgtgtgggcactcccacgcactctgagtcatttgagagtaaattgtagatacaccccttcaccttgtttcagtatgtctttacttcaaaccatggtcctgttgttccctggggacatgtggcagggttgtcacagtgaggggtaggggtactccctgcatcaagaggccagagatgctgctaaaaatcctacgatatacagaacagccctccaaacagaaactttctcagcccaaaatgttagtcataccgaggttgaaaaaccctgccttaagagtattctctaacatgaccacagtacagttttcaaaatcaagaaacttaatactgattcagtatctaatgcacagtttatattcacattttagatattatcccaataacctttgaactataccccacccaaaccaccccccgacctgggcacaggttcacatgttgtactgtcatgagttttgtttgtttgcttgtttgcttgcttgttttaagaccaggttcgcaggccagccacagtggctcacacctgtaatcccagcactctgggaggccaaggtgggtgaatcacatggggtcaggagttcgagatcagcctggccaacatggcaaaaccctgtctctgctaaaaatacaaaaaatttagctggacatagtggcaggcacctgtgatcccagctactcaggaggctgaggcaggagaatcgcttgaacccaggaggtggaggttgcatgagctgagatcgtgccattgcactccagcctgggtgacaaagcaagactccgtctcaaaaaaaaaggacgggttctcattctgtcacccaggctggggtaccgtggcaccatctcggctcactgcaacctccgcctcctgggctcaaggccatcctcccaccttagcctcccaagtatctgagactacaggcacgtgctactgctcatggctgatttacttatttatttttgtgcttttcatagagacaggttgttgtgtttctttagtctcctttaagagtgcagatgagctattttgtagaatgcccctcagttttgggtcatgcatttttaacatgaataccagaaaagcacttcattgtattagaaggcacttctggagccaggtatggtgcctcatgccgtaatcccagctctttgggaggctgaggcaggaggatcatttgagcccaggagtttgaaaccagcctgggcaaatagtgggaccccttctctacaaaaaatttaaaaatcaaccaggtgtggtggtgtatgcctgtggcccacctactgtgtgccagctactcagtagtgccagctactcaggacctggctgaggtgagaggatcacctgagacaaggaagttgaatttgcagtgaggcatgattacaccattgcacttcagcctgagtgacagagtgatgacaccatctcttaattttaaaagagtcagcttatattccttggagaaacatcttttttgcaccattgttatgattcagacagaatccttccatgattttttttttttttttttaatttttagagaaagggtctcactctgtcacccaggctggaatgcattggctcggtcacagctcactgcagcctccaatccctgggcttaagtgatcctcccacctcagcctcccgagtagctgggactgcaggtgtgagccaccatgtgtggcaaaataataataataatgataataataataataattagttaatacccagtgttgttgaggacatgaggaaatgcattttctttcacatgctgctattaggagtgtaacagtgcaactgcagtcatagttcactgcagcctcaaactcctggcctcaagcagtactcccacctcagcctcccaaagtatcctcccatgacttctaacaggattcctttaaaagaaaacatattcctgaaaaatgaataggaaaagaagatgagaattcttttattttattttatttgttatgttatgttatatgttatgttatgttttatgttatgtttatgttatgttatgttatgttatgttatgttatgttatgttatgttatatgttatgttatgttatttttggagatggagtctccctgtgttgcccaggctggagtgcagtggtgcaatctcggctcactgcaacctctgcctcctaggttcaagcaattctcctgcctctgcctcccaagtagctggaactatgggtgcccaccaccacgcccggctaatttttgtagttttagtagagacagggtttcactatgttggccaggctgatcttgaacttctgacatcaggtgattcgcccgtctcggcatcccaaagtgctgggattacagacgtgagccaccatgcccagctgagaatattttagaagagattggtaaaatatgatggagctagcacacactcccccaaacccagaaaaggtttttagaccttttttctttttccagctccaatttatgacaattctaaatctgtctctcaaattgtttcaaaaaaggacggatgtatactttggaaattctaatttaataagttaatcaactttgtgggtttgttgttgttttgagacagagtctcgctctgtcacccaggctggagtgcagtggcacgatcttggctcactgcaacctctgcctcctgggttcaagcaattctcctgcctcagcctcccacgtagctgggattacgggcacccactaccatgcccggctaatttttttgtatttttagtagagatggggtttcaccatgttggccaggctagtctcaaactcctggcctcaagtgatccgcccgcctcggcctcccaaagtgctgggattacaggcattagccactgtgcccagcccaagttaatcaactatgaagagaaaaataaaatcacataatcttggttgttcagcctctcataagaaagccaaattgttttttgcttttccatgttgtttacttgtatttctgaattgtagagtcaaaggagaagttcagagtcccatcagcaatgcacctgtcatacaggaagatctcatcatgtcctgtaacaccagataccattttcagtcttttctctctttctcctgcagggctacaccaagtccattgatatttggtctgtaggctgcattctggcagaaatgctttctaacaggcccatctttccagggaagcattatcttgaccagctgaaccacattttgggtaaggttcccgagcccttcaggagctagatttactcaagtttgtacagcttacatcaaagtcacttcattaaattaagaagagttctaatatactctttaacctgtggtaggtgtgaatttttaaccttctctgatttaaaatgttaaggacttttgtgtaaaaacataagaaaggtaaacatcaggagtggtgataagcaacggctcatatcaattatcagggttcattccgactcagagttgatggtgtgtagtcatttaccttggtcctgataactaatagctaatttttttatctgataggtattcttggatccccatcacaagaagacctgaattgtataataaatttaaaagctaggaactatttgctttctcttccacacaaaaataaggtgccatggaacaggctgttcccaaatgctgactccaaaggtaaatgttatttcgttgattagttttttcttaggcttagcttcgcgtttatttgttaaattgttaggtcactagcctgaaaaatgagcctatggctattggataatgctttctttagtgctcactctgaattgttgtcttccccctttttttttttggaaacagtggcagtgcagtaagggaacctggtaatgacggtctagttctccaccttttggtttctttgctaattttaatttgcattaaggtcactttttttttgtttttgtttgagacagtgtctcactctgtcgcccaggctggagtgtagtggcccgatctcggctcactgcaacctcctcctcccgggttcaagcgattcttctgcctcagcctcccaagtaactgggactacagacgcgtaccaccacgcctggctcatttttgtatttttagtagagacagggtttcaccatgctggccaggctggtctcgaactcctgaccttttgatctgcccaccttggcctcccaaaactgggattacaggcgtgagccacagcgttcagcctaaggtcacatttttaggtctcaggaagtctaggaccctgcaaacaaattacaccttttcatcttgtcacttgataatttttaaaatcaggtttattgaagaataatttacacagaataaaattcacactttttagttgtgtgggcctctgagttttaacaaacataaactgtcatgtaacaaccaccgcaattgagatgtggaatattcccatcatccccaaaagttgccttgtgccgtttgtagtcagtcatccctctgcaaccccaagctctggcaatcattgatctgatttatatccctatagttttgccttttccggcatgtcatgttaatggaatcatgtagtatgtagcctttttatgtctagattctcccattcagcataatgcatttgagatttataaaaatccatgtcattgtttgtgtcagtctcttcagcaaatggtgctggaacaattagacacccatatgcaaaatttacaaaactcaaaatggagcataaacctaaatataaggcctaaagttattaaccttcaagaagaaaacaggagagaatcttcatgaccttatgttaagcaaagattttttagagtacccatgaaaaaaaaaagtgatacatttgatttttttatccttttttttttttaggttagcttcgtttaataattgtattattctttattcccatttaacgtgtacctgttaaatatattaggcagctagtttttaaaacttcatgctgttataaaaccatgataggccgactaatgaccccccacccacccccatggctgtattctaatttctagagcctataactatgttaggttacctggcaaacaggaattatggttgcagatacaatcaagattgtttatcagctgaccttattttttttttaactgctccttacagagcagggctaatccacgggcagtgtggtatgccccgaataggcccatcagctgactttaaagataggaaggttatcctggattgtcttgtctaggtaggtggattatctaggtgggcccatttataaaaacagggttccttaaaagttgaggagggaatctgaatagggtgcttgtccttccatatctttatctacatacatgtgcatattttctctataatttattttttaaaaataattattataaaggttaacttttttaaaaattcagaaattatagaaatatttaagaaggtaaaattcttttataattattccctaaatgtcatggttaatagaattgtgtcttgaatatcttttccacatcagtgcatagatctaggttatcgttaatgattttatagcatttttatccagtgttctgttagaaatttagctatttctaacttcctattttatctgtatgtgtttatctatacatgcatatgaatatatgtgtatatgtatatttaacaactgtctacttaaatgttgaattggttttatgtattgacctgagtgaaggttgagaaatacttggttgtttagaaatgaatttcttttgaaaatgggagaaattttcttttaatctttcatataaaggtagaagaatttcatcattgtagacagttaagaagtatgggaggaatggtaagggagtaagatattgatcaccaggatcccacagtaacctttcactttttttgcactaatgtgtgcaagcttctgtgtggttgtaattatataatgtattttggttttggggtgttttgtggtttttttttgttttttttgttttttgtggtttttttttttgagacagagtctcgctctgtcgcccaggctggagtacagtggcgtgatctcggctcactgcaagctccgcctcccgggttcacactgttctcctgcctcagcctcccaagtagctgggactacaggcgctcgccaccacccctggctaattttttgtatttttagtagagacggggtttcaccatgatagccaggatggtctcgatctcctgaccttgtgatctgcccaccttggcctcccaaagtgttgggattacaggcgtgagccaccgtgcctgaccggtttttgggggttgggttttttttttttttttggagacgggtttggctctatcacccaggctggagcacagtggcacaatctgggctcactgcggcctccacctcccaggctcaagccatcctcccacctcagccacctgagtagctgggactacaggtaggtagtcccacctcagccatctgagtagctgggactacctgtgccaccatgcccagctaatttttgtattctttgtagagacagggtttcgccgtgttgcccaggatgatcccaaagtcttgagctcaagctatctgctcaccctgggcttctgaagagttaggattacaggtgtgagcaaccacacccggcctgtaatgtattttgatggtaggatatttttagctagaatgtcacatgcataatacatgttactgattagatttgcttgtatattataccacctaagcatgttatctaaatgttactaaatgttatttcctgagtcacttttttaaagagctgcataagcaacaaagctgcatcattaggcctggtaatgtggctcatgcctgtgatcctagcccattgggaggtcaacgcaggaggatcgcttgaggccaggaatttgagacctgcctggacaacatagtaagaccccatctctacaagattaaaaacttaaaattcagccgagtgtagtagtacctgcctgtagtctgaactacctggggaactgaggagggaggattgcatgagcccaaggaggtcaaagctgctgttagctgtgattgcatcattgcactccacgctgacggtgacactcttatctcttaaaaaaaaaaaaaaacaacaaaactgtaataaataggcctactcccaaacgttcctctcctgtttgtttccttactcttgtctgtaatcatgagttgcatcaaactatttctgattctttttttatgcttattttcattttcatttttttttctttcttttttttctgagacggcgtctcactctggctggcgcccaggctagagtgcagtggtgtgaacttggctcactgcaacctctgcctcccaggttcaagcaattttctgcctcagcctcccgagtagctgggattacaggcgcccgccaccacgcctggctaatttttgtatttttagtagaggcagggtttcaccatcttggccaggctggtcttgaactcctgacctcatgatccacccgtctcagcctgagccactgtgcctggctgcttattttcattttcttttttctcccctcccttctcctcctttctttcttcctttctttctttcaagtttcacttctatcgcccagcaggctggagtgcaatggcgtgatctgggctcactgcaacctctgcctcccgagttcaagtgattctcctgcctcagcctcccaagtagctgggattacaggcatgcgccaccacgcccagctaattttgtatttttaatagagatggggttttaccatgttggtcaggctggtctcaaactcctgatctcaggtgatgcacctgcctcagcctctcgaagtgctcggattacaggcgtgagccacagtgcccggccttcattttgttttttgtttttattttacttttttttgagacagaatttcactcttgttgcccaagctggagtgcagtggtgcgatcttgtctcactgcaacctccacctcccaggttcaagcgattctcctgcctcaacctcccaagtagctgggattataggcatatgccaccatgcctggctaattttttgtatttttagtagggatggggtttcgtcacagtggccaggccgttctcaatctcctgacctcaggtgatctgcctcctcggcctcccaaagtgctgggattaacaggcatgagccaccgcacctggccttactttgtttcttttgagatggggtcttactctgttgcccaggctggagtacaatggcgtgatcacgactcacttcagcctcgacctccctgggctcaagcgatctgcccacctcagcctcctgagtagctgggaccacaggcgcatgtcaccacgcccagctaattttttgtatttttcttagagacagtattgcatcacattgccagactggtcttgaattcctgggctcaagcaatctaccctccttggcctcccaaaatgttggaattacaggctgggcatggtggctcacgcctataatcccagcactttcagaggccgaggcgggcagatcatgaggtcaggagatcgagaccatggtgaaaccccgtctctactaaaaatacaaaataattagacgggcgtggtggtgggagcctgtagtcccagctactcaggaggctgaggcaggagaatggcatgaacccgggagggagagcttgcagtaagccgagatggtgtcactgcactccagcctggccgacagagcgagactccgtctctaaataaataaataaataaaaattttaaaaaattagctgggtgtggtggcaggtgcctgtaatcccagctacgcaggaggctgaagtgggagaatcgcttgaacccgggaggtggaggttgccgtgaggcgagattgcaccattgcactccagcctgggcaacagagcaagatatggaaagatgttagacctacaaatgccagtggtatgaacattcacacaatcctgtgacgcaggtactatcgacaatcgtctataaaagaaaactgactgggtgcagtggcgcatgcctataatccgagcactttgggaggctgaggcgggaggactgcttgagcctaggagttcaagaccagcctgggcaccatagtgagaacccatctctacaaaaaatacaaaaattagccagatgtggtggtgcatgcctatagtcccagctacttaggaggctgaagtgggaggactgcttgagcccgggagtttgaggttgcagtgagctatgatcatgccactgcactccagcctgggtgacagagcaagactccatctcaaaacaaaaccaaacaaaaacacaatctaaaagtagagacggggtttcaccatgttagccaggatggtctcgatctcctgacctcctgatctgcccgcctcggcctcccaaagtgctaggattacaggcgtaagccactgagcccggcctaatttttttttatttttagtagagacggggtttcatcatgttggtcaagctggtcacgaactcctgacctcagttgatccacctgccttggcctcccaaagtgctgggattacaggtgtgagccactgcacccggcctctagttgttaaagagtgactacatggtgttcccttgtagggatgtgacccataagtgtccttcagccagactcacattggacattaaagtttacatcagttacctattgctgcattaaaaaaacactccaaaactcaggcttgaaataacagccatgcatttgttcatgagtccattgggctggcacagctgggtagttctgctgagcccacctgggttcagccatgcactgcagtcatctgctggctcccttcaccatccctcaattgtggtggtttaacgtcttaacagttggtccttcctacagttgcctctttatcctaaagtagactagactcagtggcttctcatgatggcagaaatattccaaaagagcaagagcctatgctgcaaggtctcttggaaccaaatctcagaacatcacttcaacagttctaccatgtttttttgttgttgttttgagacaaggtcttactctgccactcaggctggagtgcggtggcacagtcttggctcactgcaacctccgccacctgggctcaagcaatcctccgcctcagtctcttgaatagctgagaccacaagtatgtgccgccatgcgtggctaatttttttttttttttttgagacagcgtcttgctctgtctcccaggctggagtgcagtggcacgatgttggctcactgcaacctctgcctcccaggttcaagcgattctcccacctcagcctcctgaatagctgggattacaggtgcgtgccaccacacctggctaatttttgctttttatgtatgtatgtatttatttatttatttattttcgagacagagtcttactctgtcacacaggctggagtgcagtggcgcgatctcggctcactgcaacctctgcttcccaggttcaagcaattctcctgcttcagcctcccgagtagctgggattataggcacatgtcaccatgcccagctaatttttgtattcttaatagagacggggtttcaccatgttggccaggctggtctcgaactcttgacctcgtgatctgcccaccttggcctcccaaggtgctgggattacaggcgtgagcaccgcacccagcactgttatttttcttttcttttttttctttttttttttttgagagggagtctcactctgtcacccaggctggaatgcagtggtgcaatctcggctcactgcagcctctgcctcccaggttcaagcaattctcctgcctcagcctccctagtagctggggctacaggcgcgcaccgccacacctggctaattttttgtatttttagccaagatattggccatgttggccaggatggtcttgatcccgtgacctcgggatccacccgccttggcctccaaaagtgctgggattacaggcatgagccaccacatctagccagttgtttttatatttttaagaaaacatacataaattcattcattcagtggatagatttgagtgtctgtttggtgccatcaaggcttctaaggccctggacatacatagtaccagcaataagagggattaagaacctgtttggagatgggaagtctgaggactcattaaaaaaaaaagagagagagagctttcttacagaactgatagtctagatttgtcaggaaatgaatggaagacctcagggaactcaagagattaaaaaacttacaagctagaatttttaatgagagttcacagaaaaggaagatgaaacagctcttaaatatataaaaggtactcatgtttactcattatacaagatacaaacattgaaaagtcagtaattcttttttttttttaacgccctcctcaacagagtagcagacatcaaagtttgacaccctactgtgtggtcaaggctgtggggaaaagggtgttttcggagagagctggtggagtgtaaactggttgagtctctgtagaggacagtctggcaattctgtcacatgtcttttgttccagcaattctgggtattgaacttttaggtctgccaaccaaatgggggagtggcatttaatttgtttttctgtaattaagagtgagattgaaattttttcatgtttgttggaaatttttgattgctgtatcccttaaaccgacactattgtagatttttctttaaaggagtcttagcttacgattctctcaaatgacttcagtgagggagaagaaattattattcagcagatggtactgggctagttgaatagctatttggaggaaaatcaatttaaatcattacacatcaaaatgaattctaaaagaattgatacttatttaaaatttatatcatgagaaactaacaatagagtattcagtatttttctgatctctgcatggagaaagacttcctatgttttaaaacaaacatcaaggaaagagagacatataaaagtttaaaagctaaataaaattagattaggtgtggacaataggtctaaaatgttctaaattgagtaacactggaccttctcctaactgttctgtagaaggcagcaaagtacagtggttatacccggtgctctggagtccgcctcctgagttcaaactagggttctgctacttggatttttgactttggacaagttatttaagctgtttcatgatttcctcaaccctaaattgagacaattgtagttcccacctcataggataattaaaagagttaaggaattattgttaactttagattcattattaatattattagtatctaaagagcagagacaaatctaagaccacagtgtataaataaatgagcaaaggacaagaacacacagtctacaggaaatactgagatgaggaaaactataggaggagcagtttgggtgacagcagttgagaatttggtttagtctgtgtttaatttaaggcacctgttaggcattagaaacaacctaagtgccaaatgttaatcaaatggctgagtaaattatgagacatctacttaaaggaatattttaaggccgctaaaagtgattttttttacaaagttttgatagtgggggaaaatgctaatgaacagtatttactaagggaaaataaaacagcatttgtcatacataatatgatttcagccttctacaagaaaatgcatagaaaagaattcaacaacatatgtgaaaagataagcagtggttaccattgaatgatggtgcttggggagcaagggaatgtgggtgagtcattcacacagaccagaaggccgggtttggtgggtcaaccgtctgaggtcttttcagttccacagttccacataacaagaacttactggcccaagaaagagctttattggctctgataactgaaaagttcagtcacatgtggattgatgggcacagacactgtgtctagaatctggacttctttatcatccagttttgccttgctctgggctgtctgtcagtcagcctctcttttcatgatgagagtaagacacttgacctgatcactgcagccaggacttaggctgactctcatcacctctttgtgctcagcttggatgccatgcctatccctgagcagtcactgtggccaaggggactcaggtgaatatggcccagtgagtgtcaccattcccacagcacagcccaggagcgtgggcaagcctgagcgctcccctatagcaaacactgttggatggattagaggggcagtggatgctggtgggcacaaccagcaggtgatcccgagagtgagggaagataaggaattctattttctcccccccacccccccccttttttttttcctgaagagacagggttctccctctgttgcccaggctggaaggctggagtgcagtggcacaatcacagctcactgcagcctcgaactcctgggctcgggcaagcaccgtgcctggctaatttaaataaattttgtagagatggggtctcgctatgtttcccagtcctgtcttgaactcctggactcaagggatcctcctgccactaccacacccggaccccccccgccccccgttttttttttttttgttttttgtttttttttttgagatggaatctcactctgtcgcccaggctggagtgcagtggcgagatctcggctcactgcaagctctacctcccaggttcacgccattctcctgcctcagcttctggagtagctgggactacaggcacccaccgctatgcccagctaattttttgtattttttagtagagacggggtttcaccgtgttagccaggatggtcttgatctcctgacctcgtgatctgcctgcctcagcctcccaaagtgctgggattacaggcgtgagccaccactcctggcccccactttttttttttaaattaaaaaacgcaatttctataagaagtctgtctccatttctcagataacctaatgtttgaaaaccttgcagactttattacacatatagatacatacattgattgtaaatggaatcataggctatatattttattacctacacaaacttggatttattgatctacagcttggtcaccctcagctcaatatagctttgggaggtatttaacctgtggtcttttaaatcttgcaagagattgaaaagatagaagaatgagattgtggccgggtgcggtcactcatgcctgtaatcccagcactttgggaggccgaggcaggtggatcacttgagcccaggagttcgacaccagcctgagcatcatggcaaaaccccgtctctgccaaaaatacaaaaataagcctgatgtggtgacacacacctgtaatcccagctactcgggaggctgaagtaggaggatcgcttgaacccaggaggtagagattgcagtgatctgagatcaggccactggattccatcctgggcaacaaagtgagaccctgtctcaaaaaaaaaaaaaagaagaagaagaagaagaagagtgagattgtgagaagttggagaacacaaaccttcagccagtgatggaatagggacaaagaaaagaaactagtgccatgtgatatcacagaagcagaagatggcattttgagaaagtaggcatgcacaacagtgtccatgcagcagagaggtctagcaagatatagattggaaaatgtgggttgattttccaatgaggggcttgttggtgaccatgcaagaggagttgaaacagtgaatggaagtgagaaatttgaaatggaaagtggagacagaaacgactggtccacatgaggggaaggggttgtggaccaggccacaagttggggagaattgactttgagtagagagaggatatctttcttggcagtgtcagtaagggtgtgtgtgaatctggctaggagggaattccgcgaagatcactcttgggtgcctcagttttctctgtagcaccctcaagaagatatgctgagagtaatgagggtcagttagcaagaaggtcatgattcaagccgtgcaagttgggtgaaatctgagagtagaggaggggactgaccaaagctttccagaagctgttgagggccttgatgaggctgaaaatcttgagtttttgtagaacggtagttactgatagtgtgctccttaaacacctgagatccccaggatcctttcagggtgtccacaaggttaaagctgttttaataatcttcttaaagagttactcacactgctctctatgttgccatcagcacttgtggcacaggagcaatgatgagcagagtccccagcaccacaggcaggtcaaggcagtggaactagagaggttactgagctctgcactgccacacccccactgctcaaaaccagtgccagtaaaaagtactcaccatattaaatccatccttaatacatgtcttcacgatgtctgtgtgacaaacacgtatagcatttctgctgcatactgaatgcagtggttttctcagggaaaagcacttatgtaactatttgagctatgagcagaattaactggtttttaaatcgtccctcagttttgatgagtataaagagttctgagatcagaaagtttgagaagcactgtcgcactggcacactttgcacagttcagtcttttctctggccccgcacagaaacatgagttgaggatggaagtgacaggttgcagcattgattcagggtcagagtttcacgaggcaggcaagatagacatgaagaggcactgtggagagccagtcaatggctttccccaggtccaggacagggcaagaaggaaaaaaggatgatggattagaagaaagggttggaatcaggttgttacatactatttgaagttaaagagaagggccaggctggccaggcgcggtgggtcacacctgtaatcccagcactttgggaggccaaggcgggtggatcacgaggccaggagtttgagaacacgctggccaacatggtgaaacccccgtctctactaaaaatacaaaaaattagcctggcgtggtggcaggcacctgtaatcccagctactcgggaggctgaggcaggagaatcgcttgaacccaggaggtggaggttgcagtgagccgagacagcgccactgcactccagcctgggcaacagagtgagactcccgtttcaaaaaaaaaaagacaagggccaggcacagtggctcacacctgtaatctcagcactttgggaggcttaggcaggaggatcacttgagcccaggagttcaagaccagcctgggcaacatagtgactccccatctctacagaaaaattaatttaaaaaaattagctgggtgtggtaacatgtgcctgtagtaccagctactcgagaggctgaggcaggaggattgcttgagcccaggagttcaaggctgcagtaagctatgatcatgccactgcactccagcctgggccatagaacaaaatccaaactctgttttaaaaaacacagaaagagaaaatgtagtattctggaaggcactagggaaagtcaggatttgtggtcaggagtaatactagcctcaaagggacttccagtcttttaggggaaataaaacctgtatccaagtaagcatccacacaggcagccatgattcacaccatctgagtgttaccaatgaatgcccatgtggcgtgggaggagggagtccggacattcttgactgtgggatccgcacctgccagctgcttcccggttctctccttttctccttctgtagctatgaataatgtagaaatagcacttgcagtaacagaaggctggagatctagctacttttcaagtagcaaatctttttttaaaaagctgtcttctttgaaatttatgcctggaggtttaagggcctagaatttatttaactttaaggaactaatggatctgttttagaaatgcttaagctgcaaaacatccagttggcttggagtgcctgtctacttaatacgaacaagtttgagtaggacccttctgcccccagtggtttagaagtaatactgttagaatcttattgtggtccaggccttctggacttttcttagcacagacagtatctaattgggtgaaaagccaaatgacttaatctagtttcaagaaagtccttgagaaaatgtctgtgagttctatgtggggagggctggttgggagcaggaagcaaagtgggatttattacctatattatagaccacaggaatctttttttttttttttttttttttttgagacggagtctcgctctgtcgcccaggctggagtgcagtggcgcaatctcggctcactgcaagctccgcctctcgggttcacgccattctcctgcctcagcctccgaagtagctgggactacaggcgcccaccaccatgcccggctaattttttttgcatttttagtagagacggggtttcaccgttttagccaggatggtctcgatctcctgaccttgtgatccgcccgccttggcctcccaaagtgctgggattacaggcgtgagcccccgtgcccagccaaccacaggaatcttaagattcggcaagggttgtgtgtcttgcacacatatctacaagtgttccttggaagtaggatttgaaccagagattcctgggttcttgaccatcatgcgtctttgtcctgacccttgagagggccacttcctaaacctagccagtttgtgtgcccacagacccagggtcacagctgcaggcatgaccacctcttctactgcgcagacactccttcagtcacagcaaaacctgtctggattctctactctgaaaagttatctaggctataaaacaaaatatcattattccgtaatttcctaaagtgcacttgtatgtattgaaaagattatagatagaaacatacataacttttaaatgttttctatgcggaatttctcattatgtccagcatgtggtttaccatgtttatcatctcctgttgtcttaaggtcaggggttgcaacaagggaggtcaaaattggccggggctgagcacaaatacacacccacagcccttcagtgacctcaggcagcaagatgcctcccacctccccccagcacccaagcaatcccttcggaaggtctactgattgttcttaagggttaggaaacattttcttagtaaatagtgaaaacttactttttgaaagtagtggctagaagtgattccttaaactgatcatgagtattaaattgtaccaaattttacgtgattgtttatcattttaggaatggtgagaagggacatacaattaaattttaaaatgttttaagaagaaataatgatattttatcattctactttgagggcttaatagtatgtgctaatttgcagatggatgaagttgacctttacctacaaataacctaataagaaatgatcattgctggccgggcgcgatggctcacgcctgtaatcccagcactttgggaggctgaggcaggcggatcacgaggtcaggaaatcgagaccatcctggctaacacggtgaaaccccatctctactaaaaatacaaaaaattagccgggtgtggtggcgggcgcctgtagtcccagctactcaggaggctgaggcaggagaatggcatgaacccgggaggcggagcttgcagtgagccgagattgcaccactgcactccagcctgggcgacagagcgagactccgtctcaaaaaaaaaaaaaaaaaaaaaaaaaagaaatgatcattgtcagaaaagacgcttcattaagtagtgccagtgtttttgtttgcggtctgcaattgtcagatggtcggtccctatgttcacagtctcgggaggcttggagatatagtcagcaccctttgtgctggctgctctctctgtagtcatgcttagctcagttgttttgtgggtaagttacttaaacaggaaattgaagtatttctgtgactacttctgctctcactactgcaaaacctttctctttatagctctggacttattggacaaaatgttgacattcaacccacacaagaggattgaagtagaacaggctctggcccacccatatctggagcagtattacgacccgagtgacgaggtaagagctcatgttcctggctgctgcttcagggacatagatcagccagcagtggaccaaccatatcttgcttagattttcctgagatatacctgctgccatacccggttcttccaacaagcccacctttgccttgaggacgagtgctgtggggcacagcttgaaatccctccccccgtaactctgtctatctcagaagacttcctccaggccacctgcaacaggtaggggcggggtaaacgcatgtataaaggggacagctgcaccagtatggagcacagagggcatgggtctgagactggaggccattgtcatggtgtgacaggaagagacacctgaagtgaagtgctggccctgaggatggccggggtggagaggaggtgggcagcctgctgacagggacagcacacagagtggggagggaagtcaacttggacagtttccactgtggcttggcgactccatgtcgggtgtgctattccctagagacaaggacacgagagcctgttgtaagaagtgatgaggccagagtggatatggcagctcttcagagcaggcagggcattcaggtagaagatgctgcatgtcatgttctccccaagacagtcctagtgccttggctctctggtgtctctggggttcaattttaactttattctctggaggataacaaagaaaaatgcaatatgaaccaaaagtttggattgttgtagttgaggctcatatgcacagagaatagtctttaccctcctatttttgaaagaatcagctttcccttccacatccatctctctgcctccagcaacaagttaggcagcttgtgaaatacctacaacatagccagtaacacagaataggagagaatacaggtttggggctcttacaagcttagtgggctggagatttcccaagcttccgagtccaaatcagctggctggggtggtgggtgatgcgtgtaggacacctcctgtgatcccagatgcatagccctccttcgggctgagctatttattcttctggacatgagtccttctcccctttcagatggccaaagcttagtgcagagtttggggtctgtgcttcctccccctaaaggccccatgtgaggattacatgggtgagaggtgagattctaggcattcactgattgacagctggtattatcatcagcttagttctgtaacattgcattagttcacgggcatttaaaaatcaaaatgtggccaggcatggtggctcacacctgtagtcccagctattcagaaggctgaggtggaaagatctcttgagcccaggagatcgaggtttcagtgagctgtgatcacaccactgcactccagcttcggtgacagagcaaaactctttctctaaaaaataataatcagtttgtcactgagtgtgtatggggttctttgatctaaatagacagtttatattttacttaaatagctttctggagtatggttaaaaattaaaatgggggctgggcgcagtggctcacgcctgtaatcccagcactttgggaggccgaggcaggaggatcacttgaggtcaggagttcaagcccagcctggccaacatggggaaaccccgtctctactaaaaatacaaaaatagctgggcgtggtagtacatgtttgtaatcccagctactctggaggctgaggcataagaattgcttgaccccgggaagcagaggttgcagcgagccaagatcatgccagtacacaccagcctaggcaatagaatgagactcagtctcaaaaaaaaaaatggggccaggtatggtggctcacacttgtaatcacagcactttgggaggccaaggttggtggatcacctgaggttaggagttcgagaccagcctggccaacatagtgaaaccctgtctctactaaaaatacaaaaattagccaagtgtggtgccaggcgcctataatcccaggtactccggaggctgaggcaggagaatcgcttgaacccaggaggcagaggttgcagtaagccgggatcgtaccactgcactccagcctgggcaacaaagcgaggttttgtatagaaaaaaaaagagaaaagcaaacttgtaagaaaatacaggagagatttttttcatactacaaatatgtagctttataatcttgttacagttactaacattttggagtatttccttctcagtcttgtatttctgtatctaaattttaaaaataaaatagttttcattctcttgacacaacataggcattttcctattaatcttccttgcagcttaattttgttttcttttttgagatggagtcttgctctgtcaccaggccaggctggagtaccgtggtgtgatctcggctcacttcaacctccacctcccaggttcaagcaattctcctgcctcagcctcccgagtagctgggactacaggcacgcaccaccacacccagctaatttttgtatttttagtagagacggagtttcactgtgttggccaggatggtctcaatatcttgacctcatgatccacctgcctcggtctcccaaagtgctgggattacaggtgtgagccaccgtgcctggccagttttttttatttttctttgagatggaatcttgctctgttgcctcggccagagtgccgtggcgcaatctcggctcactgcaacctccgcctcctggattcaagcaattctccttcctcagcctcccgagtagctgggacgacgggggcctgccaccatgcctagctaatttttgtgtatttttagtagagatggagtttcactatgttggtcaggctggtctcatgatcctcccaccttggcctcccaacgtgctgggattacagatgtgagccactgcgcctggccttgcagcttaatttttaacagctctaagatgttttttcatacaaagataccatgatttatttaatgaaatgcatgtattttagtattatgggtgttgattggataaacgtaccaccaccccaacagcagcacatttctcttatttcgacattcactgccttaaaacatttaaaaattattctgggatttgtggtaagttcagaaaaacacttgaaacagattcagttgctcccaggctaagtgtttatgagaacttgaggagtgtgggcacaactctcagtctctctctgtcacccagactggagtgcagtggcacgatctcagctcactgcaacctctgcctcctgggttcaagcgattctcctgcctcagcctcctgagtagctgagattataggcgtgcaccaccacactcggctaattttttgtatttttggtagagatggggtttcaccatgttgggccaggctggtctcgaactcctgacctcaagtgatccgcctgcctcagcctcccaaaatgctgggattacaggtgtgagccaccgcgcccggccatcaactcttaagtttttatgagacatcagtcctgttgtaaattcagaatctgagcagtggtcattttatgaatcagtaaattactgccttacccataacaactttgactgttaaatgttttgttttcttttaaagcccatcgccgaagcaccattcaagttcgacatggaattggatgacttgcctaaggaaaagctcaaagaactaatttttgaagagactgctagattccagccaggatacagatcttaaatttgtcaggtacctggagtttaatacagtgagctctagcaagggaggcgctgccttttgtttctagaatattatgttcctcaaggtccattattttgtattcttttccaagctccttattggaaggtatttttttaaatttagaattaaaaattatttagaaagttacatatattctcctaggaatctctctctcgtttattagaaactccaagtacctcctttactctcaagggtagtgaatgtgattatttggaaacaactttttcatattccagattgttcatctttgggttctcatcctttccttgctgcctgtccagagcagtttcacagttacatgagcatctctctggaaagggttcgcctcaggactccctcccatggaaagcagagccaccagttaaataaatttagtattagagtcctctgtgcctgccccttcagaaactcctagctgggacctggttctacagttgatgtcacatgcaaggggcccagaccctgttaccagttcagactagcagtgtaggctggagagctggagaaacttcatccaggagatggaggctgggctggccagtcagggggatttacatgggcctgcacagaagctacatgtgcttagatcataagggaaggtgaacaatgtgacaatattggtagattttaaaaattgagcaggcccaacacaatggctcatgcctataatcccagcactttgagaggctgaggggagaggatcgcttgaatctcagagtccaaggctgcaatgagctatgattgtatcactgcactccatcctgggtgaaccctgtgtcagaaaagaaaagtatacaggaaaagaatgcaaatcttgattttagagagtatgtgacaagaggagagagaactggacttgtgtttagaactctatagaaagaagcagtgaataaagaattgtgggccaggtgcggtggctcacacctgtaatcccagcactttgggaggccgaggcaggtggatcacgaggtcaggagatcgagaccacggtgaaaccccgtctctactaaaaatacaaaaaattagctgggcacagtggcaggcgcctgtagtcccagctactcgggaggctgaggcaggagaatggcgtgaacccgggaggcggagcttgcagcaagccgagattgcgccactgcactccagcctgggcgacagagcaagactccgtctcaaaaaaaaaaaaaaaaaaaaagaattgtgagccaaggtagaagcagttgctggggagatgctttggacagaaccgtgttgcagttagaggcgtccattccccgtcagtaagaacaaagaaccaagtagacatgagctgaggactgacatgaccaactcagcctccaagcagatagccctgaaagccaggcagggcaacagaacgaggaattggtagggaatagacactagtagtttgggggccggaaaatggtgttttcaaaagtctgacatcaaagcaggaggggttgaaatgagggaatactgggtaggagatcagctaagaacaaatgcctggtcttccataccaaaggggccgtagccttggactagaaatgaagtggtgagaagcggcaaattcaagaggaggaggaaaggcaaagtcttaaagactccaagttttctaaacctaccaacttgggggaggcagggctgctggcactgttaagccctcacttagcctgctgttaacaccagacgcaccccaaaagacgatctctcaaacccaagggaagtgttgtggagtcacgcgaacaggacgtgcagtggactgctagccataagccttgcggagtgactgagaaagaagcctgttatcagcaggggctgagctggttcatgtcttctgttgccccatacacatgtggctctctagtggaggaggtgttagccacagtgatttgcacaatcactcactgacagaaagctgggccccaggatccaaccattttcacacctgcagtccccacagaacttccttcctggctcctctgtgaggtgctcacagtggagcaattgtctctgtttctcaagagtccgtccctctccctccgtgaggctccaggacacactcccagtgtctgtacaaggtcaggttaactagaccttggtcagcccgctgcctttcctctacagcagcggcgtggggtagtcataacagacctggatggcctgtgaggcctgcccttctgtgaagagcactctcttgccgtttacagaacctagaatattgagctgagcaacttctgttgcttttcttccttcacagttcctttcacagtcattttccctcagccaggtggtggcttgtgagcatctcatctctgtcgcttcaggtcaggcggcagtgctgcctgcttagtctgcattagacactaacagcaaacgcggcaagcaggacctaaacacagcctcagaggggcccatgtagtaggggagaaagacacacacacacacaactgtgcacatttttagtataaaagagcttctggggttgacgtgataatttgtttttcatcatttaatcagcattgagcacttcctttcgccagttaggaaaggaacaaagatgaataaaacccaggttttgctttccagcagcctcatagcaggaaatgtaaacaacaaggagtatacagagtcccagagatggacacaggcatggtgggtcccagagagtaaggcagacattaaagcctcacagagtgtggccgactcgcggcagttgtgctgcagctgaaacctgacagttgggttctttgctggttggggaggggcacagctgtgtggaccctggaaggcgggcatgccagacagctgggcaagaggggggctgcagagaaagaggccagcccaggctgtggcccttgcttccccaggaggccagctctccctcacaggtagctgcctgacctgaagcagtggctcaggtgactctggtggcagtaaggatgcaggaggacctctgagagcagggacttgggggaaaactggtcaggccactgaagagacaggcagcaccgcaggcacaaggatggcaagacagaggcagggttgctcctgaggccacagggcgcagttgctggcagaacgcctcctgaagccagctttgcaaggcgggggaccagtatccctctcaggtccaccaccactctgagagtcccggcgtggcaaggacagtcacctctgtgcgttgttcatttgctccagacacagaagacacacagatgctccctatgtgcttatagcatgattttttttcccaacattcttttagtgacagttttcaactattctgaaaagttgaaggaatttaaagtagacacccatattcccaccacctagattatacagttaacattaacatcttacttgttttctcatagatctgtccatctgttcctctatccacccatcaacccatcgcattttatccattcattgcaaaggacgttgccaacgtctagactgacttacaatttagtcatctagaatatcacatgaatccaggggaagctggggctgggttggctgattaaactatgggataggttctttcataaacatttcattttggtgatcacaacagaattttgggaagtcagcatgcatccatgtttataattgaggaaactgaagacaggagcctttgagcacttcgctcaaaattgtacatcaagtggcaaaactaggcagagaatccaggtattttggacccagaatgtcattttcttgaaatgtttgccagcatgaaacagtggcaggctgcacactgcctgtgattagccttgctccttgggaaagttctcaggactcattcacaatactaaggagcattgtctctgagttcccagcccacacactggagatcaggagctctgaattggagagctcaggaggtaaaggtgtaataaaacatgggaacactgggagggcacggttgaccgtttggctgcagcaagaaaggcttagaaacatacaccccaggaccacagagcacagctgtggggcccctttggtagaggaagcaatgaagtgatatttgtagtggtggccgaaaggtcttaaaaaagggtcaaattatattcattgtattttgcttaagggggtcagttttagaaatgtttccatgggcaagtttaaaagctgatcatgcctactacctgtgacaagcctcattcctacccagcccatgtcctcagtctcctaccctgtgaggcgggtgaaggtagaggtcagtgctcaacttccttcttcatctgcctgattgtgaattttctcaggtggattgatcactaggggcatgaaccgcatttccctttggtttattgaagatgaaagcattttagggcagctttaatttcctgccaacccgtaggtttggctgcagttcacctctacataaaagagaccacttctccctcttagcccatctccaagtccacagtttggctatagttagcccattcttcttgccccacctcctgagtggcagatggaaaccacagctctgaaagtgctctgtgaaatagtaagtgatactctgctagattttcatgcactagtgttggatatcttacggtaaataaaggacatcttaggaacactgcagtcagcgtaggctgggggagtggcgtctttcctatgagtgttgtggaaaccacctcagaactgtctgagaggaggtgcctgtggagtgagggctgaccctggccccttcagaactgccatgtgttatccttgcccaaatgtgtccaaagaaatggccattttgcaggagtcttttttcccttttctgttttcataatgctattgctgctgctgctgttttaatgtggttcactgttgtcacttttgtgttttgtgatgctgatgatgatgctgttttcacatggctcactcttaactcagtggtctgtttgtgtttctataggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattc

SEQ ID NO: 36981 - DNA, 98648 bp, Homo sapiens
ccgcgcgattccgagggggttaacggcggagccgccggccgggcgcggaccggagcgcgtgaggctccggcgcgcaagcccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccgggtgaggaccgcgccgggcgggccgtcggggcggagggcggacacttgttgcccgaggaggcggcgcgggtcgcagcgcccagtcccggccgcgcgcggggcggggaggcagcgacgtcccccgggctgctcggccgcggacccgtcagggctggggcgtggggacggcgccccgagggtcccggtcccctagcacccccggggcgcgcggagctcactgcagagtcccacaggctcgccccggcccccgtgtgcgcccaggctggtgcgactaggggggtgaattcgctccccaaggtggggcagcgccgccgccccctgcgctctcgccatcgccccgcatttactcgctggaggagggggtcacctcattcctagggaggaggaaacagacattgagcggcgacgtgactcagtgttcataaataggacgacgtccctgcattcccaatctgcactattggaagaaaagccaatgtttgggtgaggatccgtggttgctcattagccagcggctggccagttttggtggaattgtgttggggggaaggggaccatctttcagacctttaggatatttagtcaagaaccttgcccccttgtgtgaaggtgtggcttgccgccatcggggacacccagtacatggggagtcgactccttcccccgcctccccccacccccgcaaaatccacacaatttagacactttggagggtgaggggcaggtatgagtaatcaataatggtggtggggaggaagaatttatttcaaatctgcagttattgtgcagaataaaatgtggacaacgtgggcgtcacagaatgaaaccggtctttgagagatgccccattaggagagcagctgtcaaaaaaagcagtgctttcagcgcttggctgtgggtccacaaatgctgtcaatgaactatagttgaaggctgctgccaatacaacaccactgtgaaacagaatggtgtatgtaagtgtcatttatttataatttatatgttcacttactttctgaaaggaattacaatggccgtgtgcttaggtaagcttccaggcatgctttctagagcagcaattgtcaggaactcagggtcttactgattgatcttactctaaaaccttttcctctccatataaactaagcgctagccagcatttcagaccttttccttaggagttctaggctgtctttctgctagaacaaggtcaagtcacgtaagacggcacttacttgtagtgttggagacaattttttccagtgttggatacaatcctgaaattgtgttgtatgaaagtttgcccacttcgctagctattcattttaacaaatatttattgagacttcgctacgggataggtactgtcctaggctctgaggctgcatcagtaaataaaatagcatttctgcctccagggttgacattttttggaagggaaacaagcaataaagaaatatcaaatgtatcagaaagtaatgatgctataggaaaaaataagacttggagggcaggaggagggagtggagatctgggagtggaggggagattgctattttccataagatgatcagggaaggtcttactgatatggtgatattttgagcagagacaatgtagcattggttcattcaggctttgctgtctattgagtgcttactgtgttccagccactggtttaggcccagaggataaagcagggaacatttcaagctccttgctttcatggagcttaggatccagtggttgagggggagatagacaataggaaaaaggcaagtgaacaagatcatttcggatagtgataaatgcgatgaagagactgaaacagggatagagagcaaggggagggggcttggtcagagtggtcaggtcctaacactgtgggggttttgttgaagagctggtgaattggggcagtcctgagggaactaacaagggatgtccaggcctgcagccatgagcaacagctggaagctggagctgggggaggaagtcacgtggctggaaacctaggggaggagctgcctgccaggagctgtagacttgaaggtgtggagttgagatgctaaggcagggtacaggcagggaagaaattctcaggcttctgatttcattggcagaactcaaaggacagctaggaggcaagggagcccctgcagtggagtccataggttgggtcatcctttcagggcccacagaagggtagataatggctctggggacagtgtggataaaggggacttacacagaggagttagtagggagccactttagatggagtggcccagggaggcctctgcacagcctggaccaggttgacaggaagaagctccctggggaggtgtttgtgtggccggcatcccggcagagggactagcaggtgcagaagctccagtgcagggtgaactccatttttaaaggacttgaagggttgcatgagagacagagaggcgattggtagctgaggttggataagcaaccagaaaacatccccctggggccatggtaaggattcaggtgtgattctaattgcacatcttggtggagaatggctttcaggagggaaactgggtaggctagagaggaagcaaggagacctggtaggaggctgttgccatcatccaggggagataggaagggagtgggactaggatggtggtattggagatggagaaaggggcagagcctccatctgagcctcttctctccatttggagaatctggagcttcagaatggggatgagggagggttgtgcactgatgtccaattctagggtcctgtgagatatacagcaatcagtgaaaacccaaaaaccaggtgggctaagggagtcccagtctctgagggcaaatagctctatgcagtgggcaacctgagagctaaagtcacagcgggtccttggtaagccttgcagcaagtggaccatttctcatttagctgaaaccatccttctaggtgggaatatgtagtttctgcggtttcaatgtggcagtcttactgttaagactggggtgtcacctttggatgatgtaatgtaaatgtaaatctactttaggttggtggtatctccccttgtgtaaacagatcattaactgcaatgctgacaaaagtccctgggggtctggccgtcccctccttagccagtctgttggatctggagagtgatggtgtgaggaaaaaagactggatcaaacttctttatatatagtcacatgattctgtaagcttagtcttcaaggaaagaaaaaaaattaacctgaactagaattcttttgaaaatttacatcagaagctgttttgtaactataattgcttggccagatatgtaagatttgttttcattggctggctcaggatcaatattgtaaatactgtataatgagtttgttaattaaatgtattagattcacactgttacagatgaatgaaaacttttattaaaatatgattattttctgtttgtacaaatatttgatgaacatattccattatagtactctttttgtgagtctttttttcttttctatttagaaaagcaaaacaattcaaaatgctttgaaccagtaattacatgtgctttgaattgctgaaaatggttagttggttccctggaataagagtttattcagtcatcatcaagctgaccaggaatttaagagttctcagataatattccgttcatttccaagcagtgaatatagttccgtatagtaatggaaacaaatacccttttttcagttgtctgaaatatgaatgtatatttgattcatagagctttgctggaaggctaagtcagaaaattatagaaaaatttactcttttcgcttgagtaaacttacctaaaaaaaacaaaaacaactcacctaagatttgtgatagatgtagtgctatcatgactttcttttaataacaaaatattcggatcagcatgaaagaagtagaagtgacatccttccattctttatgtgagtagagacctttgagcagtgctcccaaccttagctgcacgtcagagtctctagggagctttgaaaaattcccatttccaggccactccaaacccattccaatctctggggctgggaatcgcctggaaagctccccaggtgattctaattgttagctgaggttgggaaccattgtctgaagccggggtttggcctgaccagaggcatcgttatatcttaaaaagatcactgaaaatttgatgaagctccacttctagctagatgacttaccctttctgtgccttgatttcctgaaccgggagccaggcccttggtctgcaggcttccttctcctgattgttgtttgaccctgtggcctacaggcggggtcactggtgcccacagaccaggagatggggcatttggtttaaccttaggttacctccgttcgccttaatgggtgctgctcactctccacccaaacggcagatcatgcacttggcctcccaaaacttgttttctggtcgcaggacatcattcgaaagcaatttgatgattgaagtgttttgaggacctaaggtggccctgctgatgtacatagtttccactcctgaggttgtatatacttggctgcgtttctgcctgttcctcttccaagccagtctgttgtagcatattgtaaaatgtgacatcctagcaggagagtaacagttgggttctattgcactggaaaatccaggcagttttaggccattttcacttttcaccctagtgtgagggtgaggcatgcggtttctcagatttaaattctgaataaaatttccccttaaatgatcttatctccaatatggtatagagtttaatttatttgggaaggttcagaatgttgtacatttttgaaagctacatgttacatatgtgcgaagtttattttcagttttccactatttctctaattttagggtttctgactctaaaatcagatgtttttcacatccagagctgctttaaatcctcctcaccactccaccccctaacaactgcttggttcccctctcagctcaatctgctgtcaccttcattacttaaagcattttttcttccatagcagtagctttaaatgttactgcctgcaacttcaggcttttccagcctcaggacaattacataaaggaacaaaaaataggctttgtgctagagcagaatagctaaggcaggagctgttggttccaatgtttatatttcaggctatattctttgtctctttgtttctctccttttaaaaaaatgtgatccactcattttcatacatatcaccgcagggcctgtttgcgcaggtctgagaacgcatcactcctggtacagtaatagtgactgtgcacacatcagcatgtgtgggatgggtagaccctgggtgtacattgtctatgcagaatcattaggactcatctcaaggatgctgaggaagtgccagtcatttcacatacagttcagttgtgagagacaattttttcctttgtaaatactaatcaccatcaaagcataagaatgctgatgagacacagccgatcactctgccatgatctctgagcattaggaggctataccatggcagtagaaagtaaaaatgtctcttcttgggaaaaacagaaacattttcaaagtgtaacctcaggagaatattaattaccttaactcaaactttgacgttggggaaagggttggcttcatgttgtgtaaatttcaatcatcatagaaattctttaccatatttgatatagttggggtaggttttttatttattttcacctctgaagatttagctgggtttaatatgctcacattccccagtgaagtctacatgaggaggctgggaagcatactggttaaggctatgggtcttaagcatacctttcccacttatgcagtgtgactctgggaagctatttatcctaccgatgccttggtttccctgcctgtaaatggagctgttgatagtactcacattttatgatacacataaaatgcctgtcagagtgattgggtctgtatatacaatataggtttgtgtattagttatctactgccatgtaacaaacccaacacttagtggcttaaataataaatgttaattatgtcacagtgtctgtgggtcagaaattcagggatggcttagcctggtgcccctgcctcagagtctctcccaaggctgcaataaaatatcagctgtggtttcatctgaaggctgaactgaaggagtggtatctactgccaggctcacttgtgtgggggctgctgcaccctctccatagggtggcttgcagcatggcagcaggcttccctcagagcaagccagatggaatgggatccaccatctttttgtagcctaatctcagtgatatcccatcactttcgctgtattctattcctgagaagcgagtcggtaagtgcaaatctcactcagggagagggaattacaaaagggtgtaaataccaggacgtggggatccctgggggccatcctataggccagtggtccccaacatttttggtaccagggaccagtttcatggaagacagtttttctacagaccagggggcagggagctagtttcaggataattcaagtgcattacatttactgtgtactttagttctattattatataataaaataattatacaactcaccataatgtagaattagtagaagccctaagcttgttttcctgcaattagatggtcccatctggggctgatgggagacagtgacagatcatcaggcattagattctcataaggagtgggcaacccagatccctcacatgcacagttcacaatagggttcatgctcctatgggactctgctgccgctggaactcaggcagtaatgtgagcaatgggcagcagctgtaaatacagatgaagctttgctggctcacccgctgctcacctcctgctgtgtggcccgcttcctaacaggccatggactggcactggtctgtggtccggaggttggcgatccctgctataggctgcctaccacagttagatattcattagtacattttttaatttggaaacttttttgacttctgtggagcaatcagtgtttagaaatgcatattaagatttctttctaaggctgggtgtggtgactaatgcctataattccaacactttgggaggccaggagttccagaccagcatggccaacatggtgaaaccccatctctactagaaaatacaaaaattagctcagtgtggtggcacgcgcctgtagtcccagctattcaggaggctgaggcatgagaatcgcttgaaccctggaggcagaggttgcagtaagctgagattgcgccactgcactacagcctggaatacagagcaagactctgtctcaaaaaaaaaaagggagcaaatccaaacggatccctgacattattaaaaagacttatttggaggaaaaaaagaggatttttttctaatctgatttttttctttttagcttcagctccataaaagaatagttttagccactatagtttaacatggaacacttcattgagaggactatagctaggttactaagtttctgagtatcaagagcagttaccccaccatatttctgaacaaagaactcgggaagctaaaccttttataacttggaaaggtccagtacttttccttttgttactaatttcagcaggtgccgcatgaaattcccatgtgcaatcataattaatgccaaagagagaggtatctgaggtcggcctgaattcacgattaagagacaaaaatattatttaattcagaaagttcctcaacataacaatagcatgtcttattttatcactgtattattaatcttctcaggctgccataacaaaaaacacagattaggaggcttgagcaatagacatgtatttcccacagttctggagcctgcaagtctgaggtcgaggtcccagcatggtctctttctggtgaggcctctcctctgggctgcagatggcccccttctccctgtgtccctacgtggtctttcctcagtgtgtggagagaggagcaagctctctggtgtctcttcttataagagcactaatcctattatattagggccccacccttctgacctcctttagcctaattacttccttagaggcctcatctccaaataaagccacactggggattagggcttctgcatttggacttgggggatgcaagcatttaatccatgataatcacctttaatttttgttaatctttgtgctttattttaaagataataaaatagtttctattcattaatatgaagtgctttattttgtatattaagtaccctatttatgtaatacatgtcacgggtgcacctagccggggtcagtgtcacaggcagtaaaggaatttaccaagacagttgcaggtaaagaaagccagatttattagagaaagtataaaaatatgttgcaagggtgcagcaggcagcacagcagagaaggggccgtctgccaagcggcagaggctggaaggaagttttatagggttgcgctggaggggcctatgtgctgaaaaaggtcactgtgcccggggttgtttgtgattggccatttctcagaatcactgttcattgttctctcccatctggggcccctttctcattgttgtttacttatcaggactccacaagacgtatcattttatctttacaagaactctgtggcataggtactgttatcatccccattctatagaggaggaatctgaggccaagtaaacctgtctgaggtcacacaggtgaggaactgttgatccctagactcaaacccagtttcagctaactctaaagcctgtgctgctcatcatctttttttttttttttttttctgagaccgagtcttgctctgttgcccaggctggagtacaatggcacgatctcagctcactgcaacctctgcttcccgggttcaagtgattgtcctgcctcggcctcctgaatagctgggattacaggtgcctgccaccacgcccggctaatttttgtatttttagtagagacagggtttcaccatgttggccaggttggtctcaaactcctgaccttgtgatccacccgcctcggcctcccaaagtgctgggattacaggtgtgagccactccacctggctgctgcttatcatcttaaagcatggcattaatgcgagtgaatttttcatatatctttcacatctcatttcaatcctaggatagctctgtgaagagagtgtttttacctacgggaaacagagattcacatgagttacgactcttcattctttcagtcatgtatttatattatattagggttctctagatggacagaactaataggatagatcgatatatataaagaggagttaaaagggagtttgttaaggagtattgacgcacacaatcccaaggtgaggtccgacaataggctgtctacaagctgaggagcaaggaagccagtctgagtcccaaagctgaagaacctggagtctaatgtttgagagcaggaagcatccagcgcaggagaaagatggaggctgagaggctaagccagtttagtcttttcacattcttctgcctgcttttattctgacagctgattagatggtgcccacgcagatagagggtgggtccgcctttcccagtccactgactcaaatgttaatctcctctggcaacaccctcacagacacattcaggaacaatactttgcatctttcaatccaatcaagttgacacttaatattaactatcacatatatgtaatggatgtttatgcatgccgatggcgtgccaggcaggtggcaccctgctgctcaggtggaaggcagtgcctggacactggcaccaggcagacccagatttgaatcctggctccatcaatccattcattcattcatttattcaacaaataccttttgggtgccatctctgttctgagcactgtgctggttgcaaaaccagctgtggggccccaggctggcagcccacttccccagtgtaaggagggcacagctctagacagatcttggtgaatgacaaacaccacctctcccttcacggaactcacagcccacttgcctgtcattccccacaccctcataaggtaaatcagagttttccatgtaggaatctgctcaaaaagagcatttcttcaatgtgattctagttctcttccacacagcttctctggcttacacccgtaccctgttttgtccagcatgtggctagagaggaggtacatttcagtcacttaaactttgtgtctttaattggtcttggaaacatatacagtactgatctgagatgacccctgtgtcagggatgatttaaatgaccccaagatggccgggtgctgtggcttatccctgtaatttcagcactttgggaggctgaggcgggcagatcacctgaggtcaggagttgaagaccagcctggccaacgtggcaaaaccccatctctattaaaaaatacaaaaattagccgggcgtagtggtgggcgcctgtaatcctagctactcgggaggctgaggcaggagaatcgcttgaacccgggaggcggaggttgcaatgagccaaggttgtgccactgtacttcagtctgggcaacagagctgtgtctcaaaaagaaaaaagaagtgaccccaagacggattctgtccagttactgcttgaagatttgccaaaaatagcctcacaaggccagatcacttgagtaaaatgtttctcaaaacatctgccaacattgaagacttttccaaatgtcatgatggcaattattgattgataaggtgacatgtctcatccactttgtccatcctggcttatgcctgtcatccaagtgaaatcattagtagcaccctctcccactctgaagcttgagtgataaattataattataggtcctctattcacttagcacttacaatcaattatacttacaatcaattataggtctcctatttacttagcacttaccacttgtgccagatattttaggtacatcatctctttgaatccttcttacagccttctaagatatatactattatttccccatttcatagatgaaggagacttcttcaccctttataaaaataataagcactgtggaatcccggggtaactggatatccgactctggggttctcgaagtcctgggaccagaaggttcttccaaggctgtgcctttcatctcttcagtgagaaattcgtgctgagaagggtgacgaaatttcctcaagggtgctcaatagatactagcaaaactcaaaagcaggtctttttttcttgcagcctgctggttttactctgcccacttaattctccaacgaataatgttctcccctttcccagcgccatccaaaagaacccggagcatacaaaccgggggacttcgggagtccaagccagctggaacccggtaatattgccagggaaggctgtccccaggccgcaggtagggagaagcagtctccagcttgtggaggggccggagagctttgcaccgagggcctgtccaatgctgttcaaagaccagcggtcgccgccggggggcagtaacttcatgtgtgtgctgcagtggagcttgctggttgacttacactttatttcaggcatcaaaggcaaagtgcactttcagaagggagaagtcatgccttgtgctgcagagaagctattattataaagataagtgtgtaattgaacctttcaagtggagagacacccctctccctccagcagaaactgtgcaggtgagaaagccgcttcctgagtggacctattccctgctgctgggagatgctgcccgctttgtttagaatacaaataggggaacgtgctcacctgaaggggagacttttgaaaggaatgaccctcctcctgaagatgactgaaattatcagcattattatgaaaagaatatgaaatatgaaaatatcagcataaagaaatacagagagagaactcagatgaaaacattttatttcagagataatgggaattttctgagctggcttcaggtattaggttactcagtagattaagaaggaaaagcttttgctggtaggcaggtcacccggatgattccagaattaccaccactctagtcaagtagtgacagtgttctgggctggagtcacgattctggggaatttgtacagcttccctcacatgcatcccaacctgtagatctcaggtggtctggtccgcaatcagtaaaactgctgtgcagcccctcaaaacagaccacccttcagaaaaattcactgtgttacagttcatgaactgcctggaaacacctgcaggtgtttggaaagtgattcagggttcatttgtattggtatctctttctagaatagctaaattcaagatgtatctttcaaactagacacagggtgaaatggggtgcgggtatagagcttgttggttgtgggggtgacttcctgcatttagtgaaaggggtggttatgcagaggcagcacagagcattctgtgttgcatttgtggcttggaatgaagtggacccagctggctgccttcggggctgtgcctgagattctgagcatcttcagctttgtgtctgtaaagaggtctagatggtggcttactaggatgctgtgagaattgcatgtagcatggtaacgtttgtgatcgtatcaaggacaggagatactcagaaaatatttatttagtctttatgaaggatcttgttttaatgtcaatgaatatgttgttaccagttttatattaggtcaatgtttaattttttgcttatttttctgtgcatctattttctttaggtgcaggttttgttgctgcttattaatcttagtaattttcatggctcagctgagagtgcagtgagtgtgaaggtgtctatacctacacatgtgatcactgttatctctgaatcctgaatgtggacagcattcaccttcttttttttttttttttttttgagacagagtctcactctgttgcccaggctggagtgcagtggcacgatctcggctcactgcaagctccgcctcccaggttcacgccattctcctgcctcagcctcccaagtagctgggactacaggcgcccaccaccacgcctggctaattttttgtatttttagtagagatggggtttcaccgtgttagccaagatgatctcgatctcctgacctcgtgatccgcccaccttggcctcccaaagtgctgggattacaggtgtgagccaccgtgcccagcctagcattcaccttctttatagatggacacccaccttagtttagagttgttcttgttaaactacatcaatgtacagcagtaaggagggttggtctggattcaaatcccagttctgccagtaaccagctgtgtgaccttgggcaagtaacttaacttctctgcacttaggtctcctggtttatcaagtgggattataaaagctcctacctcctggggttgtgttgtgaggatgaaaagacataatacaaatagagggcttacaataatatcaggctcatagtaagtatttagtatgagttagcaattttattaaaatgcagaaattacagtgtctacattgcttgcagctgcttaacctgttcctgggacagtgcctgccacatagtaggcacttaataaatatttgtgtatcagtggaagtaaaacatcatcatgaacaagaaaatattgttaagtccattaaataataagctttattttcccatgagtaacttaggcactttcagaagctgtgtgcattttttcaggccagggggtcctgcagcttaaaaattttgcagtggtgtgtgcctgcatgcatgtgtgtttgtgaacacacgtgcatgtgtgtatgaaatgaacagatttagatactgaatattcagaataccgcagcaccatatatgctatgccagcagactggcatggcttattaacacttataaatgcttagaaaaacctgtattaatttcactatagtatgttgagactttgctaaaaggatgttttaatgtgaaatgagctttgctacaaagttgcaaacaacttaagactctaaacacttttttgaaaataaatctcaacataatgaatatgaaagcctcatgaactataaagcataaaaatcattattattgaagaaagaaatcctaggcttcttagcacaacttaaaataaaaatattgcaattgagaaataaatgctaatgcttggtggtgaggtttttctcctgtctcctcgcctcctttcctttccctccctctctcctgatcttccccttcccctcctttctcccttctctctctggttcctagaatgccttttagaggaaaaacagaccttttcagaaatacattgtcatctgctaaatctccacctactgcaccagccagcctcagcaccctgctaggaggtggctggtcattctttgccgtatcttaccttaagagagcaaaatcaacttgtgatggttcctatctctgaatgctgccctggtttccattagaatatgctggggaagatgacctttcttaatgaaagtaggcagcaccctgctgtgcttttaattaaatgaactaacctttaaaaacgcgattcttagccctgcagcagcatgccacccagcagtctgtccccagtgatggttctgtgagccacctgtgtcatagggaggtaccaggggactgaagattggagtgaggggctttagcatagcgtgatctggactcttggttgttggggccagttctcgtgctttaggttcagggtaacttatcccttatctacccttctagccagagaacacaacacagccattacaagctgacttaagcaaaaagttacccaccagttgcaataggtctacacctattggtcatgctgcccatgaggctatttaatggcactggggagaaatgcatgaagagcatgactcatagtaagtaccgtttgctgatagtaggcaccaactatagattgtcacattcgttagatgatttttttatgaccaactatcactttgttaattacgcctcaaatcacagaggcgtaattaactatcaaagtaatagttggtatcccatcttctctcaacccttctttagggatagcctctgttgagtgtatgtataccctttcacacacatgtataaacatatgtggtgtgtttggaaagataaatacacttaaataggtaccatctgcatgtttacattacgtagtattagattgcatactatattttgctacttggctttttaacatgttgtggatatcttgtcagtagactcaatgtatttcttttttctgaaacagtctcactctgtcgcccaggctggagtgcagtggcgtgatctcggctcactgcaacctccacctcccgggttcaaatgattctcctgcctcagcctcctgagcaactgggattacagccacctgccaccacacccagctaatttaatgcacttcttttgatgactccctgatgattcatgattagaacataacacaactcaaccagctattcctattgattgtcatttaggttgttgccaggtttttttccctattataaataatgttgcaaatagcattctttgtttccttatgtaaatgtatttgtaagatacattgctagaagtggaatttctgagccaggaggtatggttactttacgttttaatagatactgtcagtttgctctgcaaactgtttatactgatgtattacccccagcatcgcatgagttcctctctgcccacattctcaccagtactggggattagaaatcattttgaatcattgccaggatctctgatagacgtaaaatagtatcatcttgtttgaatttgcttttccttaattaggaacaaagctgacccttccatatgcttattagtcagttgttgctttttttcctctataaactgattgtgtatatcttgcgctacttttctggtgagtttatcgtctgtacttaggaatatgtaagttatttgcttattaaggaaattagtaccttactgcacatattacagatattttctccagtttgccatttgattttatggtgtttttactccatagaattttgtattatttttatttgtagttcagatgcagaaattttgccttcctttctcctgaggttgtttcatacctaggccaagatgtataggagtaggttttcttctagaacttgtacatttttgttgttgatgtttgcttttaattcactggacattctggtatgaggagtgagttagatttctggttttctcgtttgcatgttacctgtgggatgttccaatgttgtttgctaagcagtgctctttctttgaagatttgaaataccacctaaatgatcaaatatgctcttctatcaggattcttctcttgatctttttgttcatttctaagccagtttcatactactgttttcatgactgtgatcttacattttagcgtgatttaacaattaatacagtgaattgtcctattctttttttccagtatttgttttcctggctagtatcatttgctgcttcttctttgggaactctagaagtatactgttactttcaaactgtcctctactcccttacaagaatgaaaacgaaaatggaacatccaaacctgttaatattttgagtgagattgctttgggtttatagttacttagggagagttgacgtctttacatcctaggttcctgtggtgttattctacttatgtaagccatcttttctctactcagtacagggtggaagttttctttatatagaccctatctatttctttaatttgtatttatgttttagattcttcaatatgaacatttttatgtaaatttaagaaattatttaaaaatgggatttttaaattacacttatttttacctctatatagagaagattattgtttctgtgtattaattttgtaaccaaccacctgtgctaaagcctttgactatttctaatagttgattcttttgcattttctaggtataaaatcgtatcacctgcaaataatgatgatttttccatcttgtttataatacttcaaattgtatttcaacattatagaggcagcagatgggtattctcatcttatggaaacacgctagtctttcaccactgaccatagcttgggtgtggcaatatggtattttatctcaccttcaggtatcttgatgactttccctgttacagacctagttaccccaacagacacatctagctttctttcattacttttacataggctccaagctgacacacaattcttctttaaagaagcagcttcccgaacgttctgtgagccacatctccatctgcacactctcgatgctgccctgtggaggactccctagggtggtgggagtgtcctgtatccgcactgtccactgcagtaaccactggccacttgtggccactgagtgcttgaaatgtggtggacatgactgaggaactgaacttttaatttttttcattttaattaattttcatttaaattgtcatgttattgagcacttaaaatgtagctagtactaccgaggagtgtttacttttgctaattttcattgacatagccccatgtggctggtagctgcagaactgggctgcacgggttcctcgctcattcatggaagggtaagatatgaatgctagaaaggccctggtggccactcattgtgcccagagatgctgagattgggcccacatcacacagcaagttcatgacgaaactgagactgggagcccaggattcttactctctgtctcaagctggtgtcactgtccaaccccttctttactcctcccctcccatttcccttctgtaagttatcaccgaagtcccagtgtgtgcagaccaacgcacagcacagtgagcaggcccgagcctcgcagacaccttccctagtgtgggtccagccaagggctgtgcagttgttgagttttcagccgagctccttcactccacagtgcaaaggttctcgcaagataaaggcagggaggcaaagtcctcggccctttgtcgaggtggaaagcaccctgaggtactgtgttggtgttccaacatcatcaggaaatgcccatcccggttcgaatgtattttccagtgcttctaaaagaagactttctgcatcttctgcatggcagcgggggttgctcctgtccctgagacggctctaaaccttacgagaacccagcctgccgtggtcagggagtggagagaatatagaaagcagagccttcgagaaggccctcagctgaggctccagtgggcaaggaggctttctcggtcatgcaggagccacagccctgcttgcacttcgagttttttctactttagccaactctttctctctttccccagtgagggggttccctgcatcagtccctgggcccctgtgggtctcctcagccttccctcccagtcgttcattcaaaagaagcaggagggaaccacgctacagagactctcggctttttctggagggcaggaaggcctccgcttatactggaggtcacctgttggagcttagaggttaagaaggccgggcacttgagcttcttcctggcactgctgctccctggtagcatggacatgggtgcttcagtttgcccacttgtaggatggggctcataatagccacctcacagggctccggggatggggacgtgagtccacagacagaaagtgccgagagtccactctccacagatgtcagcactgatccacactaagatgtcttctctacctgcttcaagggcaggtgacctccaggaagggccccctctgctcctcggccagaatccttgaggcaggcttatctggggagcttggcctgcatctgcgtagatggactgtgtgggggacccccagactccccttttcacacgtatgtcccacccctgccggggggtggtcagcttgtctgacaccacaggtccccagctccttgaggcagcctgtccggcctgcccagtggcccccatcagagccatccaggcagcgtgtgagtgggtgttgggagcagtgcccttccagtggccggcgaaggcagtgtgcatgcctgaatctgctgccagttgagaagtcagctcctcaggtgggacaaggaccctggccttcctgggaacctgagcagattgcgcagtttccttttctcagcacggctcctgcactggcttacgtaacagcaacaacctgcagagcctgggctccggggctcattcccagacagtgaagtctatgatgaatagatgggtctgtacactcttagcagagagccagtaatttgctcaaaggtcaaacttagcttgattcagaacacaaaattactaggattctattctttctgcgggtgttgcttctgtatttttcatggtcaaggaaaagctgtgaagcactttcttagggcttaagagctaagggatttttcctccttttttgatgaccctcttttccagcatctcagcacacccccagatgggaagaggctatgatgaatttctcccaccatttatgccacacccactctgtgcccagttactagagcaagtggtttccaggtgtgtgtgtaaggaaatgctcttagtgcatttgttctgtgtcaggcactgttttccatagtgtttgtccagtgccaggtgctgctgtaagtatggcactgcctagaagtgtgaatgcatttcatcctcacataaaccctgtgaagcagatactatgactgtccccattttatggatggagtcactgaggcatctggaggtgaagtaacttgcccatgttgcacagctaagttggaggagggggcaaggtttgaacccaggccatcttattccagagttagcattcttaaccactacccatgctgcctgtccaccctggtcccccatttcgtttgccacccaggatccctgtgaggtatgcgcttgttacgattccattttacagtgaagacacggaggcctggcgagtttgtatgggggccagtgcctgcttgggattccgatgcaacacctgcaggtctgactcctaacactgatctctgctgtgcacctggcccattggtcattgttatttctgagcacctggactgtgccttattcagtgctcctcacattacgactgtcaaatgcaagtaactgacttaggggcctgagggtcccctaaatgggtaccttgccacccttcgttttgttgttgttgttgttcttgttttgagatggagtctccctctgttgccaggctggagtgcagtggcgcgatcttggctcaatgcaacctccgcctcctgggttcaagcgattctcctgtcccaacctctggagtaactgggagtacaggcatgtgctaccacacccagctaatgcttgtatttttagtagaggtggggtttcaccatgttggccaggatggtctcaatctcttgaccccgtgatccacccacttcggcctcccagagtgctgggattacaggcatgagccaccgcgcccggcccacccttcttttgtgaaacattctcatttttttcagctatgtccctgactacagattattacatatttccatgtgcttgtttactggttctgtttcctcctgtgaattgactgttcatatcctttgcccattcagctctcagattgtttattttacgcagatctgctttctaactcaagggtcacgacaggaactcctctaatataatccatcatcatgtaacatttttgtcccctttctgttttgcaacaactctgaaaataatgacttgcctatactgctaaataagagggtaagaatccatgccccacgcctccagccccagaataaaaaacaagtggaaactaacgatttttttcttacacgtattatagaatttctaagtctgtctggagcagtgggcacccaggcatagaccacttctttagactgagcacctgctctttgagggcagggactgtacctggttccattttccagatatttttccacttgtttatttcctaaacctttttcctactccggaaaccatgcatatcctttccccatgcatcagctggcccagcagccacagcctcagcccgacctcccaacaccttgaggtccagcttctcagtctctggcaggctggcacgtctgctatcagcaggcacaggtgttccgagccaggctgccccatgcccccttctgtgactaagagacaggccaagtgggtccatgcataagagctcttcagtaaatgcaaaaggtggcaggtgtgctagccttatttggcatcgtttcataatgttgtgaaagggtggcacttctgcctgtgtcatataagccaagtctttttcataaagatgtaatgatttgataattggtaatgatgtattgagaaggttggaggaggatgagccttgcatatggtgagaacagttgtgcctattctagcagctccaggcactctgtaacctgtggttgggtgagggctagtagtattatgttgaaacacatgaaattgccaatacttgaacatttttgatgaaaagtattggtgcttcactatagtgttcccctctgtgatcaggtttttcctgtaagactattttataatgagcttctccataactaaagcaagattgggaacatcataaaagatcctagtctatataaactcagggtcaaatgttattgtaatctagatgagaaggatttaactcatgtcagagcaaaggcaggcaaatagtaatttttaatactgcactgcattgacacataaccactgtcctcatgggtcttctgtactgaagccctcatgggtacccagagtccagctccccatcctctttccttcagttcccacatgcgcttagaagaaccagcactgtggtcctttaccatgtcctcctggtgctccaattaagtaaagccattgaggttttcctgtagttgtagattgatatctctgagttaatcacgagagaacatagacatcatataggaaaatctggccagaaacaagacagcctcagccaagaaatgttttttcttggaatcggaaaacacaagaaacagatgattgggttctgttcacgtttgaggggaacgtaaatcatcatgggtttattcataaatgattatcctcttatagactggagtcccggcgtagagtaaaggcaggcatgtagacggctccgggaagggggcctcagggaaggaggtcagggatttgtgagggtaaaaactgcccatgatattactttgccatctaatcctagtgctgggaaaatgggactttgctcccctctgcttgaactgtaatcacctcctgaccagtgtttatgttcagaagaacagcagcccagccctgatccttggggtttatcgaagctttttttagcccagtcagtcagaagacagtgccaaaagggtgtgggcgtgtggcggacgccattatcagggactcatgagagctgtgctgttccaggagtgtgtctgagcccagcatggcattgcacgcagaccagggcagagggtggccttgatgccaggtgcccaggtgggctgtgaggctgagcgctgcccgttcctttccagaatggaaattcagacactggagtgcacttgcgtagttttctcaggttttctggctccccatcatttttctttcgtctgtctaagcccaagcacagggagttttgataagacagatctgaaatgctggcagggtgcaagggaggggaacgcttctttatttcatttggtggcacctttccccccagctttcttaaggcatgactgacaaattgaactgcatgtatttgaggtgtgcatgtgatctgcagtggtggataccaagaaatgactgccacagtcaagttggggaacacgtcttgatggcactttttagagctgaaatcccggtcatgttgtagtttgctatgtgaccacctacattctaatttgggtggggcagggagaattggtgcatcgagatgatggccaggttccctggacctgtgtaaaataatggacatttacgtattagcgcaacatatggatccaccatgcgagaatctcagagtcctttatctagataaatttaatcatcgaattagaacccagtggcagtttaagagacttaatgtgagctctatttagtcttaaaatagttgcactcaaagctcagctttaattttcctccactttattctgatcctccagggtttctcatgtcccacaggatagaaggtgtccctagcgtggctggttggacccttcccatctgccaccgtgctgtttgaatacatcgtgttcccccccagggcccatgcttgccttctcctggagcagttttcacccagaaagccatggctcaccttggttaggtcttggctcctcactttgcaggaaactgtccctggctacctgaccccatcccctgctcttctgtcctcagcctactttgtttttttctctgtgcccctcccttatgtccagagggcacactgtgttgtactgattacagattgtccatcttttcctatcagaatgtggacagcatgtgggcaggggtttcattttgttcacggctacattatcagctcctagaactgtgcctggtatatagtaggtgcataaatacgtatttagcataagctgggcagtgttcagggagtgaggactggatcggggatctgtcttgattccatgccctccacgaggaaaataatttttgtgtgtcctgtcaggtttcttcttcagaacactacagaggcctcgctgtgcacggatcataagggcttttattccataagcaaacccttcttaggacctcccagatgaagacataaaatattgctgtgccccaggatttctagaccatccaaatcaagtattcagagcactccaatatacagctataattctgtagataaacttaatatttcaactatgacatagctgtgtgtatccatgagattccacgcttctcagatataggaagcctgtcttctagtcctcttgtaatctcatcctgaagccctgcactcaggggccatcaaggatctgacagatcagcctttctcagtccctggccccagcagggggaaatgctgtgtaaaaaaagcacagcatcctggaatgtcagacccagtaagggcaccaggtgctgagcaggtgctgggatgggaggaggatgaaaaaatatatgtcaggataatgtggagaaaacactcacttcaggagatgcagtgtagaaaggaaattcaggacagtttttttgcctgtaggtctccagttcttattaccttctagatcagagtaataaagttagtatcctatgaggtgtgctcattatatattcatttatgtattcatttgttcattcaacaaatatttattgaattgttctggcaatgtacctggacccaggggaaaacaaagcaatatctttgctctcgtggagtgcacattttcatgggagagacagatactatttttttagtttattagattgcgattgctgctggaattaagcacatgggggctgtggtaaacaataatgggaggtgctgatgggccctggagggccgctctgaggatatgatttttaaactcagctcagaagggggtggtctggacctctctggtaaggtccaggcagaggaaatggttggcacaagggcctctggcagacagactgtggtgtgctaacacaggaagccagtgtgaacagaaggtaatgatcaaagggaaatgggtattgaagaatattcagtagtcttctgcatcaatcagggttctccagggaaacagaaccaataggatagacatagcggtagatgtgtatatagatatataaagaaatttatcatgaggatgtggcttacataattatggaggctgagaagtcccacagtctgccatctgcaggctggagacttgagactggctagtccaaaggcctgagaaccacggcagctggtggtataaatcccagcccgagggtgggagaagatgagatgagctgtcccagctcaggcaggcgggcaggaaaagggggcagactccccccttttgttctcctgccttttgttctcttcaggcccccagcagattagatgatgcccacccacattgggaagggcagtctaccttgtagagtccaccaattcaaatgctgatctcatccagaaacacccgcacaggtacttccagagataatgctcagtctgcacacaccggggccagtttgacacacgcaattaaccaccacatcttctgaactgctctaaatcttctcttattttttcaacgatcatgtccttttccaggaaaattagcatcctttacctatatctccttcttaaaactttaattaccaatcctgtaaagatagtagtaagatcagagtttaaaaagccttccagttttagcactttgctatccacaaagctttttcacaactgaagcctaatgaaaagcagtgggagaccccatttaatggatctacaattaaatatgttcttcttgatcctttgtatgatccaaagtatgaatacaatctttattatgctttgatttttttctttactaaacttttaaaaattgtggtaaaatgcacataacttaaaatttaccatctttacatgtacagttcagaggtattaaatattaaatatattcacattgttgtgtagcacatctccagaacacttttcatcttgtacaactgaaactctgtatccgtcaaacatcaactccccattttctcttccctcagcccctggcaaccaccattctactttctgtgtctatgaatttgactactttaggtttctaagtatttgttttttcatgactggcttacctcacttagcataatgtcctgaaggttcatctatattgtacatgtttcaaaatttccttcctttttaaggttgaataatattctactgtatggatggactacattttgtttattcattttcccattgatctacactggggttgctgccatcttggctattttgaaggatgctgctgtggacatgattgagcatatctcgtcaggaccctgctttcaattcttttagatacatacacagaggtggaattgctggatcatgtggtaattctattttcaattttttgaggagctgccattccgttctgcacagtggctacaccattttacattttcatcaatagtgcacaacagttctgatttctctacctccttgccaactcttgttattttctgtttttgatactagccatcctaatggctatgaggtataatcaataaaaagctatacttttctaattgaagtataacatacatacagaaaaatacacaaatcaaaaccttgctgaaattttacaaaataaacacacccatatcaggtcaagaaatagaacaatgccagcacacctggaagcatccttcatgtccctccccagctattactcaccagtcaccaccatggcccaccaagttacccaccatgctgacctccatcaccatagaggagttttgcttgtctggaactttatataagtggaagcatgtttttcatcatttgtgtcttgtttcttttgttcaacattatgtttatgaaatgcttattgactacagcgttctccagagaaatagaaccaataggatgtatatgtatatagggaaaagtttgttttaagaaattggctcatacaattatagtgactggcaagtccaaaatctccagggtgggttgacaggctggagacccaggaatgaactgatgttacagttcaagtgtaaaggatttctgctgcagattccttctttcttggggtaggctagtctttttgttccgttaaggcctttaactgattggatgagctccctgccaatatactttactcagagttcactaatctaaatgttaatcgcatctcaaaacacctgcacagaaacatccagaataatgtttgtccatatatctggtatctgggcaccatggcccagccaagttcacacataaaattaaccattatacatgtcatagtagttcacttttattgttgtttctattctgtggtgtgaatatatcacatttccatttgacttttccagttgggagtattatgataatgctgcagtaacaatctcctacatgtattttaacatatatatattcacttttccttggttatagtacagtattcttttttatgactctggctttgttttactattattttcattttgtaattttatgtttatgttcatgaaagatataggctgatcacttttcttttttataatatttttctcaggtttcaggatcaaggttatgctaaaagcataaaataagtagaaagggcccctccttttgtttcctgtattgaagagttgatgtaggattcatattatttcttaagtgtttgggagatttcactgataaagatatctgggtgtagagttttcttttgagaatgtttttaattaaatattcagttttataaatagatatagaaccaattgattttctcttctgtcatttttgtaagttgtatttttctaggaagtagtccattttacttaaaatcttaaatatattggcataatatttatataggctttctaatatctgtaggacctgtagttatgtttcctttttcaatcctggtagtgacaatttgtgctcttttcttcatcagtcctgtcagaggtttattaaatgtattaatattttgaaaagtcaacatttgacttaatttctgtttttttgttttctgtttcagtgttttccactttttttcttctacttttttttttatttttttaaacggagtttcactcttgttgctcaggctggagtgcaatggtgcgatctcaactcactgcaacctctgtctcctgggttcaagcaattctcctgcctcagcctcccaagtagcttggaatacaggagcctgccaccatgcctggctaattttttgtatttttagtagagacagggtttcgccatgttggccaggctggtcatgaactcctgatcttaagtgatccacccatctcggcctcccaaagtgctggggttacaggtgtgagccactgcgcctgtccttttctccttctactttctttaatctcttgttctgttttcttgctttttaagatcaatatgtaaatcattaatttttagtcttcttatcccatatattcacataagactagaaatttacctctaagtatggcttttgctgcatcttacaagttttgatatgtcatatccttattattttccaattcaggatattttctgatttccagtataatttcttcattgatctgtagattgtttagaaatgtatcactttgttcataaacatttggggttttttttttaatgttattgattcctagagtaattccattatgtgatcagaaaacactctcagtcctttgacattttttcagacttgctttgtagctcaacagtaagtcggttttgataagtgtttcatgtgcacttgaaaaaatatgccttcttaacaacaacatatatagatgcagtcatgtaacaacaacgtatatagacagttgggttaagtttgttattcgtattgtttatgtcatctatggccttactgaatttcgtctattcttatcagtggctgagagaagtgtgttaaaatttcccaccatgatttggatttgctgatttctcctttttgtcctgctagcttttccttcatatagatttgaggctatattattggatatatacagatttaggattgttgtatcagcctggcaaattgacccttttttattattaaatgtccatcttttttgctagtaatgcttcttgtcttaaagtctattttgcatgatgtgccagctcttgtttggttagtatttttatagcacatttttccatccttctatttcctgtcatcttactgtttgttttctgtttgttctacttgttctatattccttttctttcttatcttcctttgaattatgttttttttttttttttttttttgagatggagtctcgctctgtcacccaggctggagtgcagtggcacaatctcggctcactgcaagctccgcctcctgggttcacaccattctcctgcctcagcctcccgagtagctgggactacaggtgcccgccaccatgcccggctaattttttgtgtttttagtggagacgggatttcaccgtgttagccaggatggtcttgatctcctgaccttgtgatccgcccacctcggcctccgaaagtgctgggattacaggtgtgagccactgcgcctggcctgaattatgtatttttaaaaattgtttcattttccccctctactaacttgcctgttagacattactgttcttttagtggttattctagatattacaaaatgcatccttgacttattttattaaggtctaatatgaatttaaaattaaagctgatatcttagcatgtgctgcttctgtagctaatgacattagcattattctaagaatgcttataaatgtgtttcttttttgtataacaaaatggcccttaaaggcctcttagagctgttaatgttataaataatcaccaaagtaagtgattattaccttaaatacattaaaagagtgaagttgaaatcttaatctttagaaattattcaacttttttgaaattctgttactaattctcctaaaaaaattttgttttaaacaagaatgatttataaattatttttcataataaactacactgtttgtggaaactgaacattgcccttggagcaggcagaagtaatatccattaaatgcatagcaaaacatgaccctcagataatttttgttttcagtttctaatgccacagatttacatgaagcgattaaggacgggtggttagtgtatatttaattttgttatttggattcaggatgctcttatgaatcctctggtgaaagtcagaaagcagaattatgggtacaggttgattttcaaaaagactttgtcaccaggcaagcaggtacacgcttctgcaatggtttgaggaaggtattatcttttcagtttttacctcctttggactgacgtcctctgtgtcctttgtagttttccccctggctgtccctaattacaccatctcatctagcaatttgatgaaaacctcaataggtgttactatcaacaggattatatttcacagtggaatgtaattttccactgcagtcagtgatggaagaagagtggtcagtaagagaaaaccttttttgcaagagggatgtatttgaggatttattcacaagaacgaactatcattatgaagttttatttttgcaaggtacaattttttttttaaccatggtgacatctgttttcttagatgtggtagaaacattcaaaaagagaaatactctggtgttggaaggcttatttttcatcatcattttgctttgaagttgtttggtgaatgcattctgaatgagacagtttggctatttctagcacaattgagtttctgatttccctttggattcttaatatcttttgagggccagggagggatattaatagagattacttgaaataagctgtgagatttttctgcgtctagaatacaggcaacaaattgttgcacgatgacagcagcaggctgtgattgttccaggctgtccttggccagtcctatcttcaggaatccaagtaggagcaggaacaaccattcccttattccattcaggaggaggctcaaagaaaagttgttccaagttaattgggagtaaacagaaactcatagttagactttatgattataatcaataacaaatatgtgtgtatgtgtgtgtaataataaattgtgtgtgtgtgtatgtgtgtgtgtgtgatataggagggtgtagttttttcagtggtcagccttcaggtctctgcagtggctgatatggtcatggggtctctaacttgtggttaactttgtcaactcatagcaattcaaagcaaaattgaggctatctctatcagtgtgctagggcagctctaacataataccacagattgggggcttaaacgacagaccttttttctctcacagttctggaggctggaagtccgagatcatggtgccggcagctttggctcctcctgaggcctctctccttggcttgtagacggctgccttctccctgtgtcctcacatggtcttccctctgtgcacgcacatgcctagtgtccctttatgtgtccacattctctcctcttacaaagacaccgatcagattagattggggccccaccctcatgacctcattttaacttaattgcctctttaaaggccctatctccagctgaggtgggtggatcacctgaggccaggcgtttgagaccagcctgaccaacatggtgaaaccctgtctctactaaaaatacaaaattagccaggcatggtggcacctaactgtaatcccagctacttgggaggctgaggaaggagaatcgctgaacccaggaggcagaggttgcagtgagctgagattgcaccactgcactctagcctgggcgacaagagtgaaactgtctcaaaaaaaaaaaaaaaaaaaggccctatcgccaactgtgtagtccagttctacggtactgatggttagggcttcaacacataaacttgtggggagtgaaggacatgaacatagttcagtccataatgctgttagagccagctgagctctctcagttatattcagagtgtctgcaggaatttattagccaacactgttgttcctaaaacaaccagcaagaggctctctctctctctctgacactctttagaatggcatcagcctccatctccacaccgcacagccaacccagcagccagtcctgggtgcctcttcagatgatgttctgggctcctctgctttttaccctccctctctcacccctgtctaaaccagtgtcctcccctgcctgtgttatcgcggaagcctccccattcttgcttccctcttgtcactctggagctctgcctctcaatggagcagccagtggtgttttgaaaacatgaatcaaacctggccactctcttgctctgagtcctctgagcacatttagcgcgggctccagatgcttgcctgggcatgtgaggacgtggcccgctctgccctctccagattcagctcctcctcgcgtctccaataccacagctgggctactctggccttgctgctactgctcccatgtgccaagtgtggtcccttcctcaaagcctggaattcccggaaggttcttcccccagatacccacatggcttactccctcactcctcccaggtcgctgcccagatgctccttcctcagaaatgtcttcccgagcccctagctaagcgagcgcaccattccccccaccccagaccatctgtcctcaaagtgtcttcatagcactggtcactccccaacatcagggtatataattgcctgttgtctgtgtttgctagaacgtcagcttcacgaaggcttttgtctcatttaccactaggtgcccagtaccttaggagcttggaagttcttagtacctaagaatagcacttgcttcatgaatatgtattaaattgataaatgacattctgtggctcaagtgagtccgtggtgtcaaaggttatgctgggcagactgcctttggtaatgagcatagacccctctttaggtccaaagcaacccccgggagaaacttgcatcttcccctacctcgtgcccagaatacaccttgccttggatgatgagttgagaagctacccacaagggtagatgactcgtctggcttgaaagagatcggccctgttggcattttgatagcaaatttagagttgggaggtcactaacaaggctagtccccaattctgcgacctaaatggagaggcagttgctttgcaagagtactgtagagcccgtgggagacacgcttctcagcctgccttttggtccacatgtaggccagccacttcctgggctgcctttttttcaaagatttttttcatgaataacggtattaaaactttcatgcaaagtgccctgatagtgtgtaatatttttagggcctgtaggcaatggaggctttacatttttagtgattttttttcctcatatacactggcattgaccctgggaatgatggctgtttttcttttaggcttgcttgactgccataaccagagacgtggagcaggggatttattctgtttcctcctcctccttcttcttcctcttattcctcatctttgatttgagggggcttttcaggtatgagggcagaggggcatgaataatacttcctcagactgaaagggtctttgggggcaacagcaattcatttttcagctctctgagatactcattttgttttgtttttgaatactccttaacttgtagtcttcctttctctacccagtctgagaactgcctaagcagaggcagtttggaccctacaaacagcgtcttgatttggctgggatgttggaatagggattggaccctagaaacagcatcttgatttggttgggacgttggaatagggatctttccattctaagaccttaaaaaaaaaagttattagagaagtgaaaacattttagttatttagactttccagtctagaaggcattttcagtggttttccctgtagagactaaggcatctctgagacaacggtgggtccatctccacaaggacttagaactcccgactcgtgacttctgggtggttctcctagtgcttgtctaaagaacatttttgagcttttggcctaaaactctcttcttccttctcacccctccttttccatagacctcccctgtgttgcctgcctgcctgtgctttgccttgatttacagcatccatgtgcatacgtaggtgcacgagacagccaggtgctagaaagtttgcaaggccaggagggatatcacagggtcctggatttgggtcccttcttcgtgcaagcaccagccagacacttgacctctctaggaaggattccttcatctatagagtggggcggagatcatggtgagccatgcacaaaggtgaggaactgtagagaaagcatccgggagccaagtcagcccttcacaggtgtctgtctgtgcaggcagtcaccacacccatctctccacccagcttcagctccaaggagcctgcctggcctgcttttgcaaacactgtctccagctgcttcgggttgcagcatctcattcctgaaacccggaggacgtgactggataatagccgggcaagtgagctgtggtgatattttaacacaggcctgatctgatcattcctcactcattcaaccctaggcaagcctggattcatactttccatggccacccgtgccagccagtttccatatcagccagggcctcaggaaggtggaaggacacactgtcattctttccatttgcgctgaccctgcctactatcaggcctgaatgccagcaggtttagctaaagaaagttgcaactgctgaccaggctgtgcaggccggcctctgtctctagcatacccgggggtagataagatggttcctgatgctctaaagctgggcttgacttcccaggaaagtaaatcaaacagggcctcttccattctcactgggaatccttggttgggctcttttttattttgaaccattgaaatatttgtgcagacacggtgggtctgaaagtaatgcactgtgacactttcccctctgttctctgacaccgggtgttagtgggagaatcagacggatagtaatttccctgtggattctcagcagccctaggagataggttagcagtggttatttctattttacagagtggaaaggcaattttaaagaaaaaaatattcttctgctcaaggtcacaactgcaaaccagtggcctggctcatggctctggacctgccaacctgtcgctctcctcttctgaggactgggttgtggctggtactgtgtttcagttttagaaaatgtaatttgaaggaaatgggagactggggtctattttgagactctcgaataattcattttactctattttctataaagcctaagagtgattcattagcaagcataagtaatgtctgagtgatgcaactgtactaggttaggttttgggacctggttgttgaattggtcatgaacatttgtcacatacatgcattgagtcatacattgctagagatggaaggcagcttagtaatcatttagtccagtgggtcccaaatctagctgtttatcagaatcacctatagagcttattaaaaattcagatgccctggtgctacccaaggcctggggtcaaagatctggaccctttatctttaacattgcatttttggggggtgggactctcgctgtgtcacccaggctggagtgcagtggcgcaatctcagctcactgcagcctctgcctaccaggcccaagtgatcttctcaccccagcctccagcctcccaagtagctgggactacaggcatgcaccaccgtacctggctaattttttgtatttttggtagaaactaggttttgccatgttgcccaggttggtctcatactcctgagctcaagtgatctgcccacctcagcctcccaaggtgctaggattacaggcatgagccaccgcgcccggccataacatcgcatttttaacaactcttccaagcagttcctaaacaactggcctaaaaacctttgagggaccccacatttgagaatcactggatgcaagtccttttttttgttggcttgtttttgtttgtctgtttgttgtatgtgttgttattcaggtgaggaaccaggggcccaaagggtagatgaccttgcctggagtcacacaaatctgtcactgttggagtcgggatgggaaacccagctacgctcttcccaggcatggtgtgaccacagcccaaccgagtggccaggaggacccactctgttgggcgctgtatttagagcaaccgagaccacttctggtaacacttggtaacatgccctgcactcttggaaaggcactcttgtcagggcgggtgtcttagagaacccacaaagttcaggagattcttccagagcccttagcaaagggccatctgcaaagcctctcttcctccctgggcaggtccattcccccagggcccagagtggggccaccaagaccagagcagacaccaggaattgaccctggtctggaactagtctgtctgttctgatctgccgccctgtgacaatcacctgcctgggaaccctgctcacagatgaccaggcccagtggagagatgataagaataggtagtttgttctgatgcagattcctaggggatctggctgatgctggctgatggctgcttacagcaggagacctcaagtttctcaatctaatgttcttagttctgcatcaaacagatgggtttattttctggatcctgtctattcacggaactcatttaatatggagggcgttatgatgtcctgcctcatctgctactcaagctatatatttgcaggtgaggggagaagaatcataaggtaagctctcagagatacgagggtcaaggagaatataagatcttacattccctaacgcacctcttgctcttttgtgtttttgcatgtggccttcatgctggttgtcctctggactgtgtgaccttggtgccctcagtttcctcatcttattggtccctgtacttctaatagtcagtgggctgacagtccacacccctctgcagggctccagacctggctgtctgactttccagcaggctgtcccctcggtcatgccgcagacttttcacactgtgtccgaagctgagccttgatctgttcctgaacttgctgcccctcttttgtcctctcccatccactccactgtttgtgctagaaagtggggagatattgttggcaccttccctctcactcctacatattagccaaaggttttatagatttcacacctaagcagtgatgtttcagcctgcttccactctcccgtgctcaggataactgccttggttcagtcactttcatgtaacactcctgcctggagtacgcagcagctcctacctggtattctgattcctctccggcactcttcagtggccctctagtgctccctgagtgatcttttgtttgtttgtttgtttgtttttgagacagggtctggctctgtcactcaggctggaatgcagtggcatgatcacagctcactgtagcctctaccacctggactcaagtgatcctcccacctcagcctcccaagtagctgggactacaggcgcacaccaccatgcctgaccaatttttgtatttttttgtagagacagggtttcaccatgttgcccaggctgatctcaaactcctgggctcaaaggatccacccacctccacctctcaaagtgctgggattataggcacgtgccaccatgactggcccaagcgatttttctaaaaacctatgtatgtcatcatctcactatcctgtttctagatactcttcagtacttatctgttgttcataaggtaatgttcaaaatccttactttgtgaataaggcctctcatttggaccctgttgtgtctcagctcttgcttctccctcactcagctcattagtgcagtggtgctcaactacctgaggttcccaggacacagggcaccgtaggatggaaactgcagttgcctccgcctgggatgccccagacctcttctccatggagctgacccctgccggccttctgatggccttttctcagtagagggtgactctgttcccaactaatctctgatgttctggaatgaagaaacaattttagtattgccagctcctagcacagtcattgccatgttatatgtgatcaatacatgtttgatgagtgaatgaatgagttagcagctcctttagaaaccaagtcctataattgaaccaaagacaaagtattatccattagctatctttggattttcttccacctgcttgtttgtgttataatattgatgtgattagcatagatttcttgctgagcggtgattagagtctcagtaaactccatccagtttaaactttgaaacattcacagacattgaccaaaatgttcagacttctccagtgctagtacattgttttcaacctcctgtgacttatttcttctaaagactacttgctggctgatttgcgttttatttttaatattcatcattcttcctgtgtgcacacaagacaatcaaagactgatttaaagtaaagggaaaaataccatcaagcctggaacgtgtcacagccacccaccccacacttgggtttgtgtccgagttggacagtgtccctggggctctttttctcttgtcctgggttcctctggaagctgtccagatccctgccgttggaggggccccaactcttattgccagaaaagaacagctcgggtagaggacacagcctccagagaggggtggtgcaggtacgaacctgcagagctctgtgacttgtttattgcacttatctgacaaaggtaatgcaaaaccctgtgcttttattgggaaatagaaggaggaacttgttggacaattatggaatcagagaatgatgtcactgggtggttccttagggatcatctaaggtaaactacattgttgagctgttgggtatgaataaaaattttccacaagctttcctgcatttcttcccctccagtcaccatattatagggcacagcagttttggagaattccacaggaccctggctcactcagagttaaggatcccatgcagtgtgatggaaggaacccagactctagtgctagacagacctaagttgggcctgtccaaattctttgagtttatttcctcatttgtaaaataatgcctacctcagggctgtcctgaggattaaatgacaccttttggggtcactagtggtcccttaacacaccgctgtctcgtctcttcttctgaggttcagctacaggagctcattttgcacgtgtcgttgctgttaatggaactgcgcttaggaagtccagtcaccaatcttcctatgttaaatgccttttgaaaaacactttcacctggcacggtggcacacacctgtaaccccagttgcttgggaggctgaggtgggcagattgtttgagcccgggaggttgaggctgcagtgagccatgatcgtaacactgcactccaacctgggtgacagagtgagagcttgtctctaaaaatatacatctaaatgaaataaaaaacactttaactttgcataagcttctttctcacccctagtcatcaattctccgggctgtaggtttgacctcctttcagtgggctcgccttgagaataagaccgtctcagccatagtgcttggcatacgctagaagctcagtaagtaggagaggcaagagggaaggaggaagagaaggaggaaaggagggaagtgggaaatgctgctactagcaaatgagcatagccgctccagatggggagaaggtgaactgtgtttgtgctcccatggagccctgtgatgcacactgtgcaggctcggatcctgaagaaaggccaggtagctgtgcagacagaggctcctgaccacatcctctgagaaaccccaggaccagatgtggtagagagtgacccacgggtgctgttcgcaaacatttgatgtagatgaactagttttagcagatgccctcacattttgcagttgtgagtttcctcccatttcttcttgattcccatctgcccgtgcagttctgcctccatcagccatgcgttgacatttaggtgattaacacttgatgccgtaaccattgtccatgttttattcataatttgacgctaaaacctgaaaagttgtcagtacggtttatgctaatacagctataaaaatgttcttcgatgccagctaagcagctggtgaggattacgttccttctgagtaggtctagcttctgacgcgggaggcacccgaggagaacgtgctcagccgcggaagcagacagacactccgtgtttacactcaaacaactgctgaaaatcatttcatgtcacgttttacttcatatttggatctgactttcttgaatggcatttttatttttcttagagtttgtattatctttttttgacgcattgtgtgctttatcagatcctcaagttcttgtatcttctcagttatgacaaacattctattattcacgtttcctattctggactggcttttcccaggacctgaggctgatctaccttctgggggctcttcttcgctctgtccctaagttgggtctagtgcatcctaaatctcatgtctttctcctttatggtttatgccatcattttgctggactacatttatattttctcccctagaaaagagaatgaaaagtcagttgtctgatttcttgaaaatatacgtagtatctcaccctcacgcttgattgatagcttatctgcaggtagacttctccagtggacattgtttctcagaacttctaggaaagctcattggcttatagtgtccaatttagctgatgcaaagactgatgtcagtccaacttccactcccttgcaaatgactgattttttgtctctcttgaaacatccttctttgtcttggatattctgaaatgctttgtggatgtgtcttcacatgggtctgtattcatagtaggcttcatttggtgagtcccttccattggaaaattcatcttctttagaacctgaggatttttgtagcgttccttaagctctgccctttgatttctgttctttctgggcctcctagtaatgctgggcctcctaaataggaactctgtatgtcttatattttcctcctttatatgttttcatgacacgtataattttgacggttttctaattagaaaagcaatgtatattgtaacagcgacaacaaaaattacaagtaggcatgattataaaatgaagcaaggccttggaggaggcaggaagatgcagaattgagggaacaaaagatggcattatctttgggaggaagaggaatgctccttattgacataccagagaaaggaccaagaaagagtccagatgcaggaacatgttgtagcacacaggggagcagtgaactcgagtcacttggccttgctagttttataaagtggaagttgaggtcacctacttagactgaagacttggggtcataagaaggtgtgaaacatgtacagaggaaaaaagtggtgactggcagtttgacccagagccttgaagacctatctgcatttgtagtgggaccagttggcctggttttgtaatgttcgattattggaacctatgagcaggagcagggttgaaatttggcaaggcaagcatggtaacaggacattgatgagggaactcagtgaaggcaaaatatttccatcagtgatggttaatacaaaagattagctaaataatcctttttccatgtttgtgacttagtctgtctgtgtctccctgccccattcaccattaccatgccaaaatgtgtcccaagaagaaccgagaaaaaaaggatgttgggaacttttggtcccagaatggtctctgctaaaaatctatccatttacatcaagtcagttttcaaaaagcatcctttgatcactgttgtaaaaccaacatttcacccaagagaataatttcatcttgcatgcagaatttttagctgacatttgcttggatctaggaggagagtccagataagccaaggatatggtttggctctgtgtccccatccaaatctcatgttgaattgtaatccccagtgttgggcctggtgggaggtgactggatcatgggggtagattccccccttgctattcttgtgataatgagttcttttgagatctggttgtttaagagtgtatagcatctcccctttcactgtctctctcctgctgtcatgtgaagacatgcttgcttctcttttgcccttctgccatgattatacatttcctgagacctttccagccatgcttcctgtacagcctgtggaaccgtgagtccattcaacctcttttcttcataaattacccagtcttgggtagttctttgtagcagtgtgagaccggactaatacagccaaattcaccctttttcatggactttagaatgttgagactggaagaaaccttagagatggtcaagctcagtggttttgaaacagtttcattttattttgttgttgttgttctgaatgtcagatctttataagtgaattctttcactgaactccaacacataaaacagcaaagtggagcagcccctcatgaagtaggggtccaccctggggccccctgattagctcctagtcaccccctgtgccacctccaccagccccaggatgtcccttattttacagttaatggaactgagccagaaagagggcacatggtgtcggagctacaggcgcctccagtattctgtgatcttctgcctgccactggagaagcagtgggtccgggacccaaaaggcatgtggatgagtccagccctcggacaacctagtcctcattgggcagagggagccatctcctggaatttttaattcgaggactttttaccttgacctcttgcgaaatccctgggccatagtgggttaactgtttgtattctggtcccactgattttctgtgtttgcttcagagaaggtgaaggtgaattctgcagattttccatcctaccgtctttggaacaactgggtactgtgtctccttaatgataaaagggagctcttcttgaaataggatgatcattttccacagtttcttggtaaaccaattacactagtggtgattaaattaggtctttgataggcatgcaagtaaaagcatttgttgtaatttacaacaataagtaaattgtctaaatggttttaatatcattaaaaatttttatctggcaggcacagtggctcacacctgtaatcccagcactttgggaggccgaggcgagagggttgcttgagcccaggagttcgagaccagcctgagcaacatgctgaaaccccatattcacaaaaaattagccaggcatggtggcacacacctgtagtcccagctactcaggaggctgaggtgggaggatcacccgagcctgggaagtaacactacagtgagccatgtttgtaccactgcaccccagctggggcaacagagtgagaccctgtctcaaaaaaaattttatctgtattctgtgtacagttctaatttaaaacaaactgattgacactgttagggaaatttgctctctttaattaaaaatacattaatattttaacacaatacttctgttgaagaggtagatacaagtttaaattttgtaaaatgtatttaattgattttaagtggtaactttttttcaggataattttgcaagtatgtcagaaaactaaataatgtgacaaatttaaacatgttacatttattttatttatgtatttatttatttttggagatggagtttcgctcttgttgcccaggctggagtgcaatggtacgatctcggctcaccacaacctccgcctcccgggttcaagtgattctcctgcctcagcctctcgagtagctgggattataggcatgcatcaccatgcccggctaattttgtatttttagtagagatgaggtttctccatgttggtcaggctggtctcgaactcccgacttcaggtgatctgcctgcctcggcctcccaaagtgctgggattacagggttgagccaccacacctggccacatgtttcatttgtttataaaggaactcccctctaagaacagatcctttttactcttcttcatcatggttaatttttgtgaatttttgttaaagtttgcaacttgcttgagtcaatgattggggaaagaattttttaaaaaatatattttatcctaagtcatgtaaatttctataaaaaaaggatattctagcactgtgctaaaagcagtttgtagctcttttaaattgtatttggagcaagttcacttgagaaaattagatgtggattctggtcacattctatttttggtttatcgtagtgttactgggttgattgtgcacttcatgtatcatattttggttttgagtgttccaaaaaaaaaaaaaaaagagtccactatcatcacaagacagagatgtatcagcagaaaaaagtgttctagatgaaggcaaaaagagttttgagccactcagcatggatatgtggaaaacatgctccacgtgtttcagtggtagaccactaattcaagacgtcagtcatgctgctttataatcttaactcatattgcctaagaggttgtcatttacatcctgttcttaggatgttttttccatatttaccagacctcttacaccactggtaagtaacgaaagctatatgcagaagcaaatcactctagtctttttgagaatccttgtgcttaaaaagctccttctttcttttttcttaattattattcccttacttgtctagttctcttattttctccagatcatattttacctataacagtttttaacctctacatctttagaaaggaaaggccctttttcactatctagaattttctagactggatggtttttaaaaaaaatctctacagttactacacttattgaacactgcatttatatagggatttagggtccttcagctaccccagggagcttgggcctgggccctcccgtctgtccttcaactttagtctgtagttgggctgtgccaccagcttccagaagaagccatgggcaggcccaccactaccttcacctcccttcctccagcccctttgcctctaccaaaccccacccgaagccccttgagtggatcttgtgagccctgtggtctctgcattcaaagactggatccgggaaggaattaatcagtgtccctgggcaaagtcttgaattctttattgtttgagattatgacatgagattatttcctcatctgtaaaatgtaaataacacctacctcagagccaagataagaaatttaagatgatatatataaacacctagcacagttgctggcacacaggatgtgcttaaattgtgagtcgctttttccttccttttccttccttttctctccagttgttcctcccctgtatcccatcaggcactccatcctgaaagctctgccacagtgatttctccaccttagcctctggcagtgactccagggtaggcaggtggaggaaggacaggccctgcctttctgtctgagctcatagatgctatcataagtgggtttctaatctaggatatggtaacacataaaacatcaccatggaagaaaggtgcgtttgttagtatttgtattaaattattttgagataaaagaaaaaagctcttatttgaggcccagtcttttaggatttatggtgattcctatatagcaattcttccaacttcaaaaataagctatagtctaaaaaaattctctctctgcacttgctgtttagtgctggaaggcattttccacagagacaatactgtattctcaagcccacagaaacctatgcaacctatagtgtgactaaataatactgctcagaggctactctaaaatttacacactaagtgatatggtttggctctttgtccccactcaaatctcctattgaattgtactcccataattcccacatgttgtgggagggacctggtgggagatcatttgaatcctgggggcggtgtcccccatgcttttctcatggtagtgaataagtctcacaagatctgatgggtttatcagaggtttcacttttgtttcttcctcattttcctttgccgccgccatgtaagaagcaccttttgtctctcaccatgattctgaggcctccccagccatgtggaactgtaagtccaattaaacttctttttcttcccagtcttgggtatatctttatcagcaacgtgaaaacagactaatacactaagaaagatcttgcagaaaggaagacattgaagaaaaaagggatgaaatgaaatcagacttgaaatggctctgggccttctcagagctactggaaagcaggcccaagtgcacgctgcctgctggttctgccccagcaattcatgagtatgattcctcagagaagcaaggctcctttcttcttaaagacctccttcacgtatgattagcatgcaattcctccagtggatgtaaggagagccctctaagagctcattctgctgtaaacacagggaaccaaggtggcacaaacacaccgtgactccgggcatcgctgccatctcgccaacaaacacactttctagactcaaagttacaagctcacttcattgtgaagttggaaaaccaaattctcaaagttaactgaaaagttaaaaaaacatttgaggtcaagctcttgccagctcatctaattatatatagcaaggtcctgtgttggatttgtgggaggcaggggggagatttgcatcaaaggtagagcacttttagttcctttttctaacatgagcacaaaaaagtgtctagatttcaaggctgaattccgattgtaggggctgatgaggtcagtggaagtggccccaggcagctgcagtgctgaatgaagcagaggtcagctttcaatgtgcacttcgggcttccttctaaagggaccatggcatgctatgaaagctggggcagaggtcccaagcaggaggctcacatcctggtggaagctgtcttaagagtattgccatacagatccgccaacaccctcactgctcccagagccgagccccttctgtgcgcttagctatcagatggaatttggtccttactttgacattgaccaaccaaatgcagaaggaacatagggaaatatctatttcactccagttatcttctgtccatgtagcagaatgaactctggaagataagtggcaaaagcaagcctcgtggctccaaccccattttcctcttatgttgcgatttccttgcatcaacagcagcgacaagtgggaaattccagtggcgcccgtgctgctagggacttcttaggtgtaggtagaaccttggcaccttcccagtcagtaactagaccgaagttctgaatttgaaaatagatttcagattagcatgagtggtgaaatattttttttctaacagaagtatgcctcttagagcttgtgttctcaactttcgaagtattcaggagtttctttcttttttttttttttttgagatggagtctcactctgtcttccaggctggggtgcagtggcttgatctcggctcactgcaacctccgcctcctgggttcaagcaattctcctgcccctttcccttaggccagaaatatttccacttctgctgcagtgttgtgtagtacattccagagtctcccgagtagctgggactacaggcatgtgccccccacgctcggctaattttttgtatttttaatagagatagggtttcaccatgttagcctggatggtctcgattctcctgacctcctgatcctcccgccttggcctcccaaagtgctgggattacaggcgtgagccaccgcgcccagcctcgggggtttctttttagtggaaattacttgtacctttcttactttgaagcattttgtttgtgtctacacaaattttgaaattttacatagaaccacagcaggatttagggggtggggaggtgggaggcaaagcagtaccattgatcaagtttgttagtttaaagctggtgtagtttggatgtttgtcccctccaaatgtcatgttcaaatgtgatccccagtgttgcagggaggcctggtgggagatgtttgggtcaagggggtagatccctcatgaacggctgggtgctgttcttgcagtagtgagttgagttcttactctatgagttcacagaagagctggttggttaaaggagcctggcacctcctcctctctcgctctttctcttgccatgtgacacgcctgctcccccttcaccttccaccatgagtagaagcttcctgaggccacaccagaagccgagcagagctggtgcgtgcttgtacagcctgcagaaccatgagctaagtaaacctcttttctttatacattacacagtctcaggtattccctgagagcaacacagcagggaccaacacaaaaaccatcaggtcagagaacagtgaagtgagtttgcttggtgtgcttctgacccctcctctgcccctttttttcaggtaaggcctgggtcttcaggtgaggcctggtcccactctccattctttgtccattccagtgagggactccagggagctgagaatcctaaatttgaatgtggccttccaggtcactgtgaccacatttgttttcaaggaaggaaaatggaacatattttatttacagtttgttgccatgaagtgtaactttcagccatgtggactcagggaatgttagtggccatttgttcaggaagggtaacctgccacagaccctagtcctggaatattgagtgggtctggggttcgcacagaatttggagaccctggattaggagaagactctgggagtcatttgcccagaagcaatccactctggggctggactgcccagccacatgccacatggttgcccggcctctacctactcgcaggaaaaggcagcttcctctgtccctagacagcccatttcatctttatgcagctctgaaatagtgcccctttcccttaggccagaaatatctccacttctgctgtactgttgtgtagtacattccagagacgtagcaggttcagcaggtgacggaaagtgttcctgcgtgaacgtagtctccagccccgacacctggtagatggttcacacgaacacacacacattggggagcaaaacccaggtgtgagctccgcccttgcagagcttcaggcaaatgtgtatacatggtcgctggggaagagatactgtgaagtgtattatatcacaaggtataccagctctttgtgctagttatgtaagccacacattttgccgagcacacatagaaggaggctcattgaattcacctaatactgcattttaaaatgacaaaaaatgaatgtgttggtcaggaaagagttctggggctatgtagtggcaccatttcttgtgtaggccatgttttcccatctgttgaacagtttgttcaatacatatacacacacactcatataagtggttattaaagaagcatcttcctcagttatggctgtactcctgtgtaatacagctgtttcagctgcagcgccctcaccttcccaaccagcgtgtcagtggagcagtagcccccatttgagggcacgggataggataggtgacattgccacagagtgtgagctggagcaggctgccctctgtgcactgccaagccctgaaagcccagcaggaatgtgatgtctttagttagcacttctcaaactatctaccagggaaacctggtttttgtttaaatttccaacctgttgccaacggataaacataatatgataaaagtgaattactagaagaatgaagtggaacaaaaagagacatggaatacaagccttagctttttcttttctttttcagacaaggtctcactctgttgcccaggctagattgcagtgacaccatcacggctcacttgttgactttgacttcctgggctcaagcaatcttccccagtagctgggcacaggtgcatgccaccatgcctgactggttttgtttgtttgtttgtttaattttggtagagatggggtctcacttgttgcccaggctggtctttaactcctgggcccaagcaatcctactgtcttggcctcccgaagcactgggattccaggtgtgagccaccacacccggtcagctttttcttattagttccaacagtcatacaagttttctgataaatttaaaggttttaaaggctaattctctttttctggttttccctcatgacatgttggcccctccccactgatcacatattgggtagcactatcttagatgacaagcagaggtcaagcccaggattttaaaatataaatatgtatatttatagttatgaggcttttataaacttcatagaaaaataattaatgaatattgtatccaacttacattacttcagctttactttaaattttttccagtgatcacaacccacatttcatgtggttgtgactctccgctgtgttgctattccactcttattcactggcctggccctccttgctaccctggctgtctgtccctgcctccctgttctctcctttccccagtctcctttcacatcaggctctgggcggcccagggcagtcttcccccaaatcgcagcctggctgcattccttccttctggcagtctcacagttcttatgggacagtgtccgggttcctccaccaatggatctggcccctgcctgcctctccagcttcatttcttattcatttcctgccctgtgatccccccgcctgatatggtttgctgtgtccccacccgaaatctcatcttgaattgtaatccccataatgcccacatgtcaagggtggggaccaggtggaggtggtcagatcgtggggacggtttcccccatgctgttcttgtgatagtgagtctcctgagatctgatggttttataaagtgtctggcatttcccctgctggcactcattctctcttctttcaccctgtgaagggtgccttccaccatgattgtaaggttcctgaggcctccccagccatgcggaactgtgagttgattaaacctcttcctttataaactacccaatgtcgggtagttctttttttcttttttgggacagagtctcactctgtcgcccacgctagagtgcagtggcactatctcggctcactgcaacctccgcctccctagttcaagtgattcttcagcctcagcctcctgagtagctgtgattataggcacctgccaccatgcctgcctctctctctctctctctctctctctatatatatatatatatatatatatttttttttttttttttggtatttttagtagagatgggtttcaccatgttggccaggctggtctggaactcctgacatcaagtgatccacctgcctcagcctcccaaagtgctgggattacagacatgagccaccgtgcctggccattgggcagttctctatagcagtgtgagaatggactaatacactgccctaccccatggacttcagccatgctaagttcaatgcagttctggaagccttttcatgcttccctgcccttggtgctgataaaccagcactctgctgagtgaacggtagctgtttcttcatttccccacatgttttttctgtcataaacagcagacttaaacatctttatacaacttatcttttttaatgtaggaataatttccccaaatggaattaccaactctcaagactacggaccctttataaatatgattgcattttgtcaaatggttttccagaaaggttggattacttttcagtgtccacatcaataaaccctaaattttaactcaaaaatattctgtcagattggccccaagttgagttttatgctagattttactgtgtattctcaggtttctggtggctaaagtgagagaactggctttctgctttagatgttagttctaacaagttggggtctttgtctccccatgttcctttaccctgaaaacagcggacaccacaatcaatactgatggcaatggtgtgcgtgtggaggtaaggggaagttaaaaggtttgtttatggaagagtccctgttctgtgtgtcaaacaaaggtggaaatgaagaggaacaaaataggcaacttaataagataagctgatggcgtgctggtggcagcaggttgccatggatgcaacatgaataggatctctgattatcgtagataagaatatcctactgtgcgttattataatatcactgggtaccatgagcattttacacctatctcattgaatcttcatcaccactgcacaagctaggtaccatgttattattattgtattttatggatgagaaaactaaagtacatggagatcaaataacttaccaaaggtggcgagggctgagcgaatctgggatttgatcctgggtagcccagagccctgataccaccgttgacaatggagaatttaacttttgcatttgcctgagttgatgtgaaagtgtccttttgaaagtattctagactttcaaagtctaggataagtttcaggtgagtgagagcaccttgggaagagggactgaggtggcaccacccatgtcgcctctgctctcccacatcactccttggggaccctctgtgcatgctccccttgcccacagcatttgtcacctggctttattcatatgccaccatggaaatacgctttcctgggaatgcctggcacatggtaggcatctaatcagtgatgaccaaatggagcagaatattcggggaagtcatggaatatagagtgtttgattttccaggagcgtaagaatgtaccaaaagatgtcactgcagagtaaatcggtgctccatgaagtctttattgacttctggccaaaacgtagccttaagaaattgcccctgaaggaaatggagcaagatgattgttttatatgccttcataatggaattcatggagcattcagtcagattttcttgaagtgcttgttcagtatgacctcacagaaagtatggggcagatctgggagtgccccactctggttaatgcagtcacatggaaggaaatgtaattgagtgtggcaccagtgcactgcagtgataaatgaccagggattttctgggtagtctccgaatgagaagggataggatctcgagccttttaaggaaccaaatccctcaatcctgtgtgcctatagaaaattgcagtgggcaggagcagcccagcgtgctccagctgtcctcagctgtgggaccaccgtggccctgaacgtcgggccaatattgacggaatattcttgagttaaaattcaggtcttgagttagaattcagtatcaaaagcattgacactgtgcatggattcatgtttagcttctctttttttcataaacagtttactgaggtagctaacttctttataaaattatccagaaagaggtcaacactttccagaaagtgctagttcttgcagttctgctttcaagtatttcagaccagccaagcaaaactagctccagcatttttaactcttggagaaagatttcactatttcaaatgtatttttgtttaggtagagagcattagaataatatctaaaataagttggatattgtaggtgaatcacagttcctgacatcaaaaatagtcaaaccatagcttacaaatacacttttgggatcattttcccttgtactaaaaataaagttttaaagtaaccacttgcccaaaaaaaagtttctcctgctggagaaagttgcatagcttgggaacttttatcccgtatttactctgatcatgatgtcaacacagcactagtttgtgaattagtccattctcatgctgctataaagaactaccctagagagggtaatttataaaggaaagaggtttaattgactcacagtctgcattgctggggaggcctcaggaaacttacaatcatggaggaaggcaaaggagaagcaggcaaccttcttcacagggcggcaggatggagtgagtgcaagcaggggaaatgataggcacttataaaatcatcggatcccctgaaactcactcattatcaccagaacaggatgagggaaaccacccccatgatccaattacctccacctggtcccacccttgacatgtggggattatcgagattacaattcatggtgagatttgggtggggacacagagccaaatcacatcagtttgtaagagtatagtcagaatggctttatagtcagaatggccttactggacattgctctcttttgtttctttatttgaccactaattttccatttagcttcccccaggctcttactgtacttcctgcacaaatgtatcattcttctgatgtctttgtgaaatcatgtcaatatttccaatttttcacacatgattttctttttgtcatcacttcaaccaaattttcttctggtgctaattattaagtattaaaattattaaagaattgagaaatggtttccgttataaagccctgtcttcatcatttagaactttacaacaatcctcttttgtaaagttttccaggaaatggatgtcccacaaaaatcaacaatcttaaaataagtatcagtatgggcactattgtttgcctctgttctttctccttgatttttattcttattctttgttacttctttgttctaagcgtaaaagatggaaaaatgataaagtaagatcctgctttcaaattcttagggaagtctaggttgctttgcttatgtggagcagttcacagaaggaactttagaattagccacctgtccgaagcttttagcccctcccagtgtggacttctttccctgggactttcatgggctgcctgcatctatcctagaatgtgcctgtaccggcaaccccgtcagactaaaccaggcttgttacagtcatgatttgtgcatcctcttttgctcgcttaggcaaattctggatttgtgttagagtggtcagaaatgccaagaacctgacttcttagattaaaagacaaaattgttggggggagaaaggttttttaatggtctgaacattttctcagttcagagcctgagatctgcatgagctcaccattgctctcgttaagtaatgttcactggctcaccgtggaaacttgaaggcatgtcagtgtacctgaaccgtgcctttttcaggactaactcaaagaccttcaggaagaaatatttgggtacagccatccgggaccacagaatcacagggcaggaatgtgaatgttgatgctggcgattgtgagctgcctgaccttaggcaagtagtctcaattcaccaagcctcctttcttcaaaggtaaggatagttaacaccttccctatatcctctccaggttttagagaaacttgaaagagttaatacatgtgaaatgaccttgtaaactgcaaagtgtaggttgactgtgacagaattattatcagtcagaacctgcataataaactggaaaatgtgagctatgttccaaagaacatcaggaccctctgtgggacccagttccggatactttggctgactcaatccaccgaaacaaagggttatttcagagcatggcatttaaattgttaggcttattagaccattaccagcagggcatttgtataccttacaaatgagttctttatcttcttccttgcctacgaaagttaaagaagtgctgtggtggccgcctacgtaattggattcattgtggagctctacttgaagttgcactcatctgaactcattcttgaacatataagccactgcccagaacaaacagggctcttcttacagaaagactcctgcgctgtgaatcagtcacagattgtattaaacttcccaacactactcaatttgtcaggcaagttttgttttattttttccctaatcctggccttattccaaattttccaactattcctggaataagtagactacatccatccatctttgcattctctcaatttccagtggccctagtgggaatttcatgtagctagactgacagcaatttgtattttgttaaattatgattaattggaaacctgtttttagcatttaggtggaatgtttcttgtagtattccattagcatagatattaatacacttgagtgctaatacctctgccttgctttcccacactttgttcacttatataagctgaatgagattatccatgattgtgttctttccggtcacatccttttggattccctgaattccattggagcattggagcccagggagcctttaccgttgattttgcgacagacagggcgagatccaggagatgaaatgttctccccagtgcaactcagtttgttactggaaaagcgagagctagaaaccaggacttcagactcctagaaccagtgtccttttgaagatgccgtggttccttgaaaaaccagagtaaaactctacaattcaaaatctttaggaaatacgttaagttgtttgagatggccagattttctgtagagctgaagggtatatagcctcttggttgttagaaatgtgatgtttaaccatttgaggaatcagtgtctaaaatggacagtccaaccctgccttcttaaacaatgatgaacgttttcttcttgatcatttcctttcctgatgattcttagcctttcttgatcattccagctcatcagtcatctcaattctcagtcacggtggaggtggagttgggtgtcagcttaaacaggtctgaacctgaggcctgctttcctagaggaagtcctggcctggcaaacctttccatctctgactgtctcatggagttctttgtcagagtgttggtgcagggctcctgcaccgggtagcagggcaccccagctgcagagtggtttggtgatgggaacctgaaacagccttctccctcggagttcgagagggagaatctcttttatggaatagccaaatgtcttgtgaatggtcggcagcatgaaaagcattatccttttctatcagtaacgcacaagcacctcctcaacagcttgaacttgtcaacatagttcatcacaggcttgatggattattcttcactattttaagaatttgtgttaggctgggtacaatttcattgtcactttacctcaaattctgattccaggtcggacatccaagagaattaagcacaacatgtagccttagttcctcacctataaaaaagtgatagtacctgtctcctagagtggcttgagggttacatgagagagtgagtgttgactgcttacatccatacctgataggtgactggcagtcaatttcggatcgctgctatttctcatcatcttcatcatcgccatcttcatcactagtggctgttaaatctatcagcatcatctttttttgtgaaagatggccaccacctttctcatctttcaagtatgttaaatgagaaagttgtgttgatgtttactattttaaaaaattgtctcaaattttaaaaagccaccacgtgttacttgctaatgtaactgaatctgtcactcattttagcatcttccccaggcttggcaaaggcacactgtgatagttaaaggtgcctgctgggatctcagggtgttgggttggactgtctttctagccttccctttgactcattccccgacttgagcaatcacgtgacctgcaccagccttccatagatggaacagaaacatgtgggctgccacctgcacacctcagtggggcgttgtgggaattatgagttagtgtttctgacataggtggctggagtgagctatccaagtgtgaggtgtccatgtggcttatctagccgaatggacattacctttaccaggggctctggtgtggtcttcacagcttttttaaatttaatttaattttattttatttttcgaaacagagtctcactctgtcaccaaggctggagtgcagtggcgtgatctcggctcactgcaacctccgcctcccgggttcaagaaattctcctgcctcagcctcccgagtagctgagattacaggcgtgtaccaccatacccagctaatttttgtatttttagtagagatggggttttaccatgttggccaggctggtctcgaactcctgacctcaggtgatccgcctgcctcggcctcccaagtgttgggattacaggcgtcagccaccatgcccagccttttacagcttttaaaggaccataaatgtgtccccatattttcatcaggagtgcagtgaaagcacccttctcagcatggccctgcaacctcataggtaatgtgattgacgtcacaccactgggctcagtattcttctgttacattggaagaaacaaaaacttcaataatacttggtcttcacctgaacggtgcactgaaacgttctgtcatatttttttagccttttgaaaagtgttctaaatatttttgctactgactgtattacaatgattgcaaaaataaactatttccaagagagttctgttgtatatttttagtatcatcagagtatcagagacctcacttgaaaaatcattaaaaattaaattacatattttcaacttgtatgaattgtacattttattgtgaaagccatcttatgccacatccctttagaattagcatgggtagtgctgaccttattttaaacctattattattattattattattattattattttttgagacaaggtctcagtctgtcacccaggctggagtgcagtggcacgatctcagctcactgcagcctcgacctcctgggctcaagcgattctcctactttagcctcccaagtaactgggactagaggcgcacaccaccatgtccggctaatttttctattttttgtagagattgagtttctcaccatgttgctcaggctggtccgaaactcctgagctcaagctatcctcccgcctcagcctcccaaagtgctgagattacagacatgtaccacctcacctagcctcaagtctttactgctcttttttttttttttttggcctttaattatttatttatttatttatttatttatttattttttgaaatggagtctcgctctgttgcccaggttagagcgcagtggcacgatctcagctcactgcaagctctgcctcccgggttcacaccattctcctgcctcagcctcccgagtagctgagacgacaggcacccgccaccatgcccggctaattttttgtatttttcgtagagacagggtttcatcgtgttagccaggatagtctcaatctcctggacctcgtgatccacctgcctcggcctcccaaagtgctgggattacaggtttgagccacggtgcccggcctgccttttatttttttaaaaatacctttttattatggaggttgtcaagtgtatacaaaagcatggaagatattctaatgaactccctatattcagctcctcacccagcctcaacaatgatcagtacatggaatcctccttcccacacttcccaccatggagtaattttatttttttattattattattattttatttatttttttttttgagacacagccttgctctgtcgccaggctggagtgtagtggcacaaccacagctcactacagtgctgacctcctgggctcaagcaatcttcctgccttggcctcccacagtgctgaaattacagacatgagccaccctgccaatcatgggatcattttaaacatatcccaggcatcatatcatttcatttgtatgtatctctaagagataaggacacttaacaaaaataaagtaaatgtactttcttaatatcaccaaatatccattctgtgttcaaatgtccccgattggctcatgaatgtctttttataattagcgtgtttgcgttagaatccaaataagaggcactcactgcatttcagtgatctgtctcttctgtctcttttcatctggtttctccatcctttgtcataggtccccagtgaaactgttttcatatgtctcataggctgtcccacagtctggaaacagcaagtgcactgttagcactgtttagcacatctctgcattccctctgatatggtttggctctgagtccctactcaaatctcttcttgtagctcccataattcccacgtgttgtgggagggacccagtgggagataattgaatcatgggggcaggtctttcccatgctgttctcatgatagtaaataaggctcacaaaatctgatggttttaaaaatgggagtttccctgcacaagctctctttgcctgctgccatccatgtaagatgtgacttgctcctccttgccttccaccatgatagtgatgctttcccagttacatggaactgtgagtccattaaacctctttcttttgtaaattgcccagtgtcaggtatgtctttatcaacatcatgaaaacggactaatatacatctatttatctaaactcagaggcctgggagcttgctgaaaaatcagagttttttgtttttgttttgtttttatttggacaagactacttcacacgaaatatcctgtactgactattgctgtacaccaagacgcatgtgatcactgattgtctccttctgtgatgttaaaagcaccatccctggcttcaggtgtgttcagtctggcccagcttctgcaattcctgatccgcctctcacctggtggtttcagcagccagtgtttaccccagcctccagatgtatcagcagctctgtggtttcagcaccacactttcagcacctaatacagaattcactttgaaagaaagatttctaaaaatgacttgctagtaggtagttagaaatactgagtgattcttaataaaataatgatttcaaggtgaaagcgatggcataattcaaaatgtgtttacattttttccatagaaacacatacttgattactaactaggaaaataaaaagatttctgtctcaaagaaagaagatgagtatgagaagcaaccagtagagttatcttgtttactctcctcccgagagctctagctaaagattcgaatagtgcattgtttctgagatttttgtcttaatcataagtaattctaaagcatttatcttccttaaaatgccagcaaattgaggcaacttaaagtactccagttcctttaggtaataatgtaaaaaatcgctgattaaatattgaggagtccctttgagtaaggtgtaatgacatgccgtcttacagagccagggtgtagttgctgcttcttatcccctttgcatcctcattatgtttcttctcgatttcagacctctctttggtctgaaaagatttcgctttataggttatttgtttcatcacaagtagagctgactctggaatgaactcagtgcgttttgatcatgaacccagcactgtgctacaggcttgcttactggaatatacagtgtcctttagaatccagaaacagtggttcatcttaggaatgtatggccaaatgttgatttgggatttagagttaagatttttaaattgtacctaggtgtctgggttttatatattgttccactttttatgtggaataagcttcatcagaatcatttcaggaaatgagaaaagtaggatatggttatgaatcagccatggaaaactacggtatggaatgaattagtcagaaaaaaggtttcagtggccagcgtgagctgtgtgctatcaggaagtggcatgactttccatgattttatgtgctataaatcatgtggcatactgatccagacacctagagtctttttttttattattataatttttgaaataaaactgaaaagcaccaatgaagcaaaagcaccaaagccctttcagtagttgcttgctcgtccctactatcagctggaatggatctccacccccactgtgagctccgctggtgagggatcattcatctaaaagtccattgtggctgctgggtcaggtttgagaagcagttggcttccgcagagttgctgctacaaaaatgtggcatctgtctgtttcttttgtttgtaatactttttctcataccccttgtctggccgcttctagatctctgccatttatggtctagaaggtagttgcttctccctgtgttgtgctgtgtttagaaagatagtctgaaattcagaattaggcagttatgttccagtcttctatcatcctattaaagagaaaaagaaaaacttgcgcaaatggggtggattaaaagtttgggtcatgtgaagttcataaagctatatctccagagggaaatgctaaaaatatactcaaccactaaaattgcccatggagggaaataagtttattgctttattggtcatgtaagtcagttaaaatataatcaagtcagcctcctcactgtcttttattatcgatacatccatgaataggcattcaataatgacagcttggtatgtgtctatgtgtgcatgattggtttttttttttaataggcacatgtaatggaataattcagttaggaatggagtctgcatgtgagtggctacactactattgaatattgatgtcatttccattgattctgatgcctttggcaacctggtaaacattttctctggaaaaaatctcgtaaaccaggtttgccctgtttctctgccctgtttgccgtttgtggtaacctggcagggttcctatggagaattgttggtctggaagttaacccaacttaacatcgcatagtatcacttagcaatcacgtggtaaaaattggcatgttcttcctccccctctaccttagaccaatgcctcccagaccttactatgtacaggagtcacttcggatcttgttaaaatgaaaattctccttgagtagatctcaggtggggctctagattctgcgtttctggcaagctcacaggtgatgccactgttcttggacactatataccaaacaacatctgtagagttcaacaagaagccaaaccctaaagggtatcgtgcctctaacgctagtaatgcagagccagcccttctgtatccaagacctcaaacctctctacatcatataaacaccagccctccagcaggagtgaggaacaccctaggatggagaggaaccctgatagagacatcacgtgagtcctactggcctttccaccttgtatcttaaacttcacttgatcctctgagcacacagccatctgtcccaaattctgccaaagccttatcaagagctaataatgccttcctttctccattgactggacactttctgagcaaggaaggtggttagaactgttggtcatctaagtcttcccctgggacccatgatcgctattcctaagtcttcattctaagattttttttttacacagcccacttgtcttcatcctccaacattcagggagagttcagaaagtttagtgggataagaagggattttgacattagtggcaagggaaaaatgctggaagtccaatgaacaaaggtttgggagacttcagaattctttaagattgacttaaagaatcaaaaaagaatgttcactaggggaagtgtcccagtgtggaaacttcagcagctgtatttcagaatcaccaatcaccagaacatgggttttggactagctgaagaattgttgaaccagtgagagagctgccttctgcctcctcctgttttccctcaattgtcccagtaaaagtaggttaaatatttaattggttactttattaccatggaattttcaaataaaccagcaaatcaacatcattattttaaaattttaggaaatgtgattcagggtttgtcattattttttccaaggaagaaatgattatagatattttctgcaagggtaaatatctgtgacttttccagtttagaagccagccacagaccttcatacacaccatccaaaaaggaagagtgttcaggacataagattaaaaatagttactattggtatgcacccattctaatgttttcccttagcgtcacgggtgcctttaaaagcctttctactattttccttgggtcttcccagttttaaaaacaagagccccattccagatgattaccaaaatgtggcatttgaaaaggtgagtttaatcgttgtcatagaattccttgtctgactttatcaacatcattgagttatgtgcattgagttgtgcatatgtgaatgagttacttacagcttggtattagttgatagcaggatacagattctatcggctatatgataaagctctgcccactccattggatggatctaaaggtagtgggggcatgccttagtatgggggactgaagctacattcattacattcctgtctcatcattttctttcagaggcttttccttgagaacattaaagccaactgtagagacctataaggatgaaggtggtagtttgagatgggcatattttatattgttacatgctcttaagttggcagtggtgttagtctgcttgggctgccatgatgaatactacagactgggtggcttaaacaacagaaatgtgttgtttcacaatcctggaggctggaagtccaagatcaaggtgatggcagggctatttccctcagaggccttgctccttggctcatagatgacatgctatctctgtgtcctcacatggtcttttctctgtctggtgtccaaatctcctcttcttataatgacacccagcagattggattgggctcctccttaatggcctcaatttaacttagtcacccatttaaaggccctacctccaaatacagtcacattgtgaggtaccaggacggttaggactcaacatatgtatttttgggaggagttcatttcagccaaaacaaagttcacagaagccactttgaatttgcaaaactgtttctcaaatggagattacttcatggttcttccatttctttttgagaatagttttgtcttcatcttcattgggagatgacacatctgctgttttgtcgtggaagtaagaattgggacaataataacataattgtctaaatgatattttagggtatcaggtggttttgctctgtgagaaaacctctttagaaatacaacgagggtgtccacagataatagaatgggcctctgccactcaggagtcttggcagtgcttccattcttccatactccacctcatcattgatgtgccgccctgtcactgccaccaccagcaggcacatctcggggaaggagcaaggtgggcctcagaacttcacctgggtctgtgttcagtgcctcctggagtctgtctgggtggcatggtcatctctgggttctagtagctggcatggtcagtgcctgtaggtgttcggtggatggatggatggatggatgatggatggacaaacgaataaactgataatgttggcaaaccacttcccccttagctccgctcagaaatatttcagaacatcagccattgaggctgctgacctcctcctggtccccatcattgtcctccatcttggagacagctgctgtagatgccacagatagagttaaaccttgttttgcttgatgtatattaaaaacaaggcaaatattttgcttacctgttttagcctggactggagggtcaccagcaccactctggctgtgagagagtactacttttctaagtttccctccgtaatttttcattttgggatcctcggtattcaccacctcggcagccaccatgaatcatctggtagatgcattttcaaactcaaaagcagattagaacatcacctgaaccaccttcaggttagaaaatgaacgttgctataaaagaagtaaaaataataattatacaagggcataggttaagtctttgaaactgcctgcatggcagattttacatttttgaaccgaggctgccacagctgtggctagtggttgtctgaccctcttctttcacctggtgccttcgagggccactgagagcatgagtcagagcacaccaacacccaaacaaagcacacatgctcatggcgccttagtccctggccagagacacgcctgtctttcatcacgtgggatggagacagtgaagagcctgagcaacagaagactgatgaagagcttcaggcgtgagatgattgaacaccacctagcacctggcaaacggtctcatagtccctatcctgggtgttggaccacaacgaactgtttgctgaccgtgcaatttggcaaaatcatcaaacctacacaaaacaagaaacaagcgcacaaaataagtgcaaagaggaaaagtaggcatttttctctaattgctatatattctggcatagtcctttgctttgtttacaatagaacttagaagaaatacagttttatttagatggcactaagagaatttaagattcctttgccggcatattttgaactaaactttagtagatttactgacagatgtagaagttaatagcagctttttaaattatcatgaataatgttttcaattaaaataatatttcttatgttaagcaggatatcaatgttatcacaatacagttaaagacaaaggttttacaagtgctaaaatgggatgtaaggtatacctcagtgaaactgtttttaaaagttttatatttcaaaagtttcgacattgcagagaatttaaattctcagcagtactgccttaacttttttttattattatttttactcttttgaaaactctactttccagctttctcagtttgagaggacactgaagagcttttgcagaaatcagacatgtcattttattaggaaaactgatttgattattgatatgccaattataaaattcttagtcatccagcacatatctagccatgcaaaaaaaatttcatatgtaactttgaaagcaaaagtaatgaaaatcaatgtgaaattacattgattggctaaattcagttcttctcaaagagtagtaaaatgcagttgttaagaacataggatctataggctttggttcagaatcctggttccaaagctgagtggtggtaggtgtcttcatctgctcgggctgctataacaaaatgccctattctaggtgccttaaacaatagaaatttatttctcacagttctggatgttgagaagtctgaggttaggctgccagcatggttgattcctggtgagggctctcctcctggcttgtagactgtcaccttcttgcaaaaaggactctactcacctgacttcacctaaccctaattacctcctaaaggcctcacctccaaataccatgtcttagtccattttctgttgctataacataacaccacagactgggtaacttataaataaaagagatttatttggtttgcggttctggaagctgaaaagtctaagagcatggtgccagcatctggtgagggtcatcgcatggcagaaggcagaagctgaagcaagcacaggagacagggagaggacatggagccaaactcatcctttttatcaggagcccactcccaggataactaacccactcctgcaacaatggcatgaatccctttgtaagggctctgccctcgtggcctcctcaccttgtcaaggccctacctctcaacactgttaaaatggcaattaagtttctaacacataaacttttgggggacacattcaaaccatagcaccattgcactgggtgttaggacttcaacatgtgaattttaggggaacagaattcaatccattagcattggacaaagtacttaattgaggtcatttgcctggcctcttcatgacagcctttttctcttgggacgatgtttttcaaaattgtgtgtttcctggggtgcattcccatacatggcagtgagcaggtgagggagggggagaaaggtgaggggaagctgtgatgtggaaagagtagtagacctaggtaaaaacctggctgctgtgatgggcctggactcctggatatgccctattctcttggcatgtgggacagtccccgctcctgggctcaggctcctgtagcacctgggtgacgtggaacccgaacccttcgctgaatcctcagctactcaattttggcaggggtagtggctgcagctgagtaggagtttgtttgcgaccctttgtgttccaaagaaaacgccagccacagaatttactgtcttactcactggagaccttgcaaaagtgtgggccccaaactagggtttggggagagatttattcacgtaggtattatctggtctctgttacccagaaagtcatttttaataagtcatgcactcatgactaatcattttctccacttaaaaaaacttttttccaggtaggacataataatgggtcaagctacttatacttttcctgtttcccccttttaatgggaaaaacacgctctttttccatatctaaaatggaattgaatgcttcttgtaaaatgtacatctcagggaaaaacccattgctattctaaacctgcttcctcctattcttcagttcctggtacggtggatgttgtttgcgtcttctgacttctaccctctgagttggagactcataattattgttagtatgtgagcatgcagtgtctgtctttaaactgctaagacggtgttgcttttaagcgacagcgattgttttcttgttcatgtttgtgctgtcttctttgcgtcagctcctaaaatagaggggagttgtgtacctgttaacaacgtgttaacagcattgttggggtttttcagacaatttaattgtacaagtaaattattttaagttagagcctattcgtttgaaacaaagaaaatagtttttacatttctaaaaaaaaaaaaaaactaataagtaactgccaacaaatgctagactatatacctgtaaagtcagcattttaatgtcattttcttctagagccagagtttagtaagttcttggcctgctgggaagaaatgtaaggaagagagtgttgttaggtggggattttttaacacaaaaatataaacttgcctgacgtgatttctcgccattttctaagtcactgaaatgtttgttatctattttatttcagtaaatcactttcttttagcatccttcagatggtcaaacagcatgttgtatctctgagaaatctcatcttattaaagattgactgatgtccttcaacatttctatgagcgtttttcaacccacagagatccagttaagatacagacaaatatcaggatcttcttaggacctgtttgaaatgacatgtttcaaagcagctctgtattaaaagaggtcattcttttctgttgaacaagaaattaagtgaatgcatttggtgtgctggggctattcttcgaatgttagagcaacctgtttcattttagggcctggggtcattattctccatgggtggcaccgctatcctcccagtggcatttgaaaatccttgcgagactttgtggttgcagcaaggactgggggaaagctgctggcatttgtagggagaggggactgaccagcagggaggctaaacagtctagagtgcaaggggcagggccatgcaaggagaagctgtttcctccacaatgtcgttagtgtaactgctgagaaacagcgggagaagtcacaggctcagggaacacaaaggatctttgtgcctggcctggccagccccccacttcttcaaggaagcatactgggggtcacatctattttctcagtgtttccctttcacccatgccccacattgcagcatttttcatcagaaaccacaggagcccaaaatacacttcctcatttctgagatgcctttcttagtcagggctgaaattagttttcagtggacacccacactcaggcactgtactagcaaagccttttgttagaaactgtcacactggtgttcagattgtcctctgcccgagttttggaagggtgggtgacaagggccagcaaatagtcaacactgcccgttgtgcaatgctgtgatctccctctgagagcaagaagcaaacttgaggtgacactgaaacaaggggcgggggcactgagcctgctttcgtagctttgctttgcttttgcctcttggtttactttctatggggaacatatcccactaagaaggctggtccagcccgcaccatgatggcaggcatgggactcgggagacgtggtcccagaggctctcgctccactgatggtgaggagtaaatgacacagtaggctttgcagaagtgaagtcagaaatcagagggctccatctttcaaccactccctggccttcaaggatagatcttggagttcacgtcatacagtctttaaaaggctctcctgcccacaaggtgccctcactacccctcttccacgtgcgtccctcgcactgctgtttgctgagacttacagccccgtcccatgtgtgacttttactccaacccgaggcgggtgcttcctgacagcagggctgggtctcctttactttctatcttggggaccagcagtctcctctgacaaggaagagattcagcaaaggctcgttgagaccagcctgggtgacacagtgagaccctgtctcaaacaaacaaacaaaaaccagcagagtttctgattcagtaaatatatattagttttctattgctgtgtgacaaattactacaaatctagtggcttacaatgcccatttcttagttgacaggtctgtaggtcagaaatcaccatgtgcacaacagggttctctgctcaaggttaacaaggctggaaccggttctctcctgggctgcgttcctgtctggagactcttgcggagaatctgcttctaagcacattcagatccccgtggccactctagctccttgaggccactctcagtccttgccacatggccccctccatcttcagaatcagcaacagagaatgtctctcccatcctttctccgacttcagaaagaacccggtcccttttaagtgttcaccccacataatctcccagggtaatataacctaactgtggaaacagaatccatcacagagtcccgggatcatgcaaagcttgtccaccagggggccatttgagaattcagcctaccacaataggtagggcaagaattctggcaagttgccaagtaaggcagctactgctgctgtggcagccacagtctgaaaagcacctacctatgcacattctacaacaacctttgacttagattgttcccaaattgcaaatgaggaaactgaagttcataggattcagtctagagataatattcatagcacatagtaactggtacctcgtgggcactgaccactccgaatggctagcaggcaactgactctggctgtcagtgccactgtggtcatcttggccagcaccaccagttgactgaggacccccagcaagtaaggactgcagccagggttcctgcccaggcccatctgacacccaagcctgagctttggccacttcacatgctaggattaaaaagaaaatgtcatccctcgaagcctaagtcaggagaagaagaaataaaaggacagcagtttattgattccaaagcccaacttcctttgaacattctagctgctggatgttctataaagctacctttctccagtcttaaatttgtatttgcttcctgttgctgatgtaacagattaccaaacaattttagtggctgaaaacagcacagatttatgactgtacagttctggagatcaaactccaaaatcagtctcaatgggctaaaatcaggtgtcagcctggctgcgttacttctagggcaaaatccgtttcgttgccttttcccaggttccaaagactcccactttccttggctcatggccccatatcactcgaatctctgcttccatcatcctgtctccatctccgactccagccctgccatatcctgcttataaagacaccttgattacactgggcccaccctggtaatccatcatctcctagtctcaagatccttagcttagtcacacctgcagagtcccttcttccatgtatggcaacatatttacaagctccagggactagggaggggctgtcattcagcccagctcatagtctgaggcccacacctatgtggatcataacagtgaacgctttcatggaaacttcctatgcaccaagcctcaatgtaggcattaggtcaatttgtgccaccaccaccacatgaggtaggtcctgtgattatcctctttacagatgaagaatctgaagcacatgggacttgagaaccttgcccaaggtcacacagctaagaaatggaacaccaggttcagacccaggtggcctggctccagagtccatacttctacaactctgttgtacacctctcacagatgtgcaagtaaaaggcagaccctacatatgtagatggcaagaagccccacacccacccatctctccttcctcttacacccactgttccactaaggaccctgcttactcaggtgacctcgccttctgagtctaatgagttacaatccttgccacttctgcccatcgcagaaatgttgttccagttactattgctgcacaacaagccacccaaaacgtaatggctgtaaataacaatagtcatctgttttgcttgtgaatctgcagtttgcacagagatgattcttctctcctccatgcatcatcctctgggtttcccttggctggcgactggagggtccactcccaagttgtcacacttatatagctggcaaaaataccagctgccagtgaggagctcagccagagctctgggccagcagcctcagttcgtctctgtatgggctcttcatgggctgcttgggcttcctgaaagcatggtgggcaactgggttccaagaggaagtgccccgagagaacaaggcagaagggcatggctttttatgacctaaacttggtgtcttttccaccatatagtgtcacttgaggcactcacaaaggtcctccacattcaagggcaggggacatacattccttctcccaacaggaatggcaaggctgtaggagagcatgtggagtaggagacagtgttgcagccatcttcagagaatttgttcttccagaattgtctttatcatagctacctatgacatcccaccacaccacacatggcatcctccccacctcacctctgtttataggcactttccaagcccaaatttgggtgtatgcagaaacacaagattttgtccaatgtatttatttttatgtccttaccaaaattttaaaaatgtgttgcatgaatagcattaaaaaaattttttttatttattttattttttttgagatggagtctcactctgtcacccaggctggagtgcagtggcgcaatctgagctcactgcaagctccacttcctgggttcacaccattctcctgcctcagcctcccgagtagctgggattacaggcacccgccaccacgcctggctagttttttgtgtttttagtagagacagtgtttcaccgtgttagccaggatggtctctatctcctgaccttgtgatccacccacctcggcctcccaaagtgctggcattacaggcgtgagccatcgctcccgccccgtgaatagcatttatttttaaaatgaaatatgcaaaggtaggatttcctaagaaatccaggacatccgttaatagatattagcactaacccaatgccatgcaaaaaaatacaagccatcaaatttgttcaaaatgagtaaagtatatatgtcctttaataaaagcacctgcttatttgatgccacatgacagtggatgatagtggaacgttaactaactagtataagcgcctacactgagcagattcttgtgtaggttgattggggaaagctttccttataccttttctttttaggtagtaatgaggaaatgcagaggtatatctttttcccacttatttaaagcctaaccctattctcaagtccttcatctgtaggactttttgtaactggaccaattggaggttgagatgggattcttatatacctagctagacttttctgattgctacgctccacttctagtatcctgagctctgagtgtctgtgacacacaagagagatcatttatattatcactggagctgcagtctcatcactcaagcttccatcttaagcccctgtagggacagaaactgaggcttttggaggccctagtagactactgagcacctggtcatggcttagtatttcttgattgatttcactgtgagcttttttttctttttgagacagagtctcgctctgtattccaggctggaatacagtggtgcgatctcggctcactgcaacctccacctcccaggttcaagcggttcttctacctcagcctcccaagtagctgggattacaggcacccgccaccccgcccagctaatttttgtatttttagtagagacagggtttcaccatgttggtcaggcttgtctcgaactcctgacctcatgatctgcccacctcggcctcccaaagtgctgggattacaggagtgagccaccacgcctggcccactgtgagctttttgaaggaataaccataccttcctcatctttatatctctaaggaagagtcagttacttggctgcatgcatttgttcaacaaatgtttatgaagggttttaagggttccagggtctctggcttggtctacccttagttcggtgaaggaaatcaattaaagtgtggtaaatactaagaactaggggtaattttacccagccaaggagttcgagaagtcacgtgggagatctttaacaaatggtggttgaatgaatggagacatgagtgatttcttggaagtctgcccttaatcccagtcagtccatgcaagaatctgctcagtgtaggtgcttgaacaatacgtaggcagcacccagccccggaagagcccacctgtgcagagaattttcccctgtaactgacttactgcctggaattttccccttagcaatgcattcctttgagatgcagactgatctccagaatttgctgattaaatacaaattctctgggaaggccttatatattaaacaactgtcatcattaatgctgtaatggggagaagtttattatgtaaccttccagtcttgttagaaaggagattcagaggaaggggtcatccagggagaaagaaaaggggcttggatgtgattctgggactgcaagaagaatggggaaaataatgcaggtgagcaaggaatagatgtagggacatggcagtgacaagaaacaattcagatgagtgtcccctggcactcagacagccctgactccagtgagaatggctcagccaacactactgattaaatgagaatttcaccagataaagatggcaggcaggagaggtaatcaaagaaagacaaaatcagtattttctggtgaaatccctgtttctaggtatgaaataggattctttcaataactagcactccaaaatgttaatgggttaaaatgagcaggtttagagattgtgcataacagatacagagcaaatattaaaagccgtgataccaaaccactacacaaaaacaggcaaagtcgattttctctccaactaacctttacccttacatattgtgtctgttaaccacggttaccttgaccattgatatatagcatctagtgagggaaggggaaaggagaagcttttttgttattataaaagtaataagtgttcattgtggaaattcatgctagaatctaaataatccaaatccaaataatcaagaagaaaaacacaggagtcttctaatactatcacacatattctttcttttcaccaaaatgagaacaataaacattgctttgtaacctggttttttctcctaacagcaagtcttgaacatcttttcatgtcattagttttcaccaccttactatgagtggctctatagtctactgaatgaatttagcatgtatattatctgatcacggatcttgatgtattttatttacataaaactatatttttgcatattttatttgccttgcaggaacatatttgcatctaatgtttgcccacagccatgaggatttctttagaataaattcctaggagtgaaattgttgagtcagtattcgggatttgagttgatgcggtttatactgaaagtttaaactgtttgaatttaccgctaatcttaccgatattcttcttgaagctccttacatggatgatgagctaatgatttggagtggaataagcagcatttttgtagtgttcagtttaaaggctgtcacatttctgagacttcagatgattaacttagggtgcaagtctggagccttctaattccttgagcttgggccttgcgggttggtcggttagctggtcggtgcactggtcacagtgacacaccccaggtcacttcagaaaaatagaatttgtctcccagcctcccttgacagtcagccctgttggggcagagcaaagccaccttgcccaagttccacccccttctcagggtagccccttcccagaactgaccaacgtgggggtatcaaggcccggtcctcctgctccgataagggtcgtctcatcctcaaagctccctgtagagtcggctaggcttccactaggaccacttggtagcttcactctccctctgcccagtttcctttcccctccccaccactcgtcctaataacctcccctgcgcaagaacctctgtcttagagtctggaagcggccagtacccatggcggggagtggatggggaattggctggggagttggcagtagctgtggttgatcacagtatgtgccacataatttcacctctacagaggacagtagagccactgtgtcctccctcaggatggaggagcccacggtggcttggaccaacagggagcgtttcttaaatgggtgaaacaggcacaatcttcccatcattttcaacataaggaataaaatgtaccatagatttgtacaagagcagtttaaaatgctctcttctccgaatgatcttttaagaaactatcttaaagaccacactctgaaaacacctggacctcaggctcctttcaaattgtttttctgtgtcttcgaatgccattcctgacaaaactttttttgcctccatgaatcatgagctaattctgtagaaatctgtaagtgaattacagttcagattcttcctctgtcttcctctgacatggcccaatcatttcttaataattgctaaagaaaccaactgtggtttatgtttgagcagaatcaagatcgtcgctataaccatgtcaccaccattccctggcatttacagcataatttcaggagtgggagacaacatttcacagatgcccagggagtcacccataggaatgtgatgtgcccatacatgggccagatgaaaaaataagtacacacacacacacacacacaattaccatgtgggagtgagggccatgccctctccatgtataattcggtgtaaattgttaggcatagaacagcttgagccccagagctgggtaaacttctctgcctgtacgcctggcacctcacaccatggctggccctagcaggtgactaatctgtttttgatgaattaccaaattaagccacaaattgaaatgccctgggggctggtcagccagcagccatcattggtggaggggcgagtagaccacagacagtgatgaggcctggggtatttgaagagcatgggttccccaacaaggggcatctgctcggccacagtgaaatggagctctgggcccagggtggccacatctccccgggccaccaccaccaaaaagaagtcagaagttctatttctgtgtgacacctcccaatttttcaatattaacaactaattttccgtcaatgttaatgggctacagttcaccaggagaaaactaactgggccattctaggcctgatggaaagggaacagctcttaggaatcagatactcggtgcaaagatgtgtgcccacattttagtcacttgacgggaacacctagattttcctgatgaaccaggttggcacagttgttctctctttgggtggacagagataatatccaagttgtggtggggtcttgcttgttctttgtatgtagtttattgttccttcagtatgttttgaatcattggtgaccttcatgaagatgacaggacatgcttcctcgtgtgacttgttatcaggcttttaagtcatcagcaaagaatgcaggccaaatgcagaaagaaagcgtttgcagtgccctgttgggacttctcaactgcagacatggaaacagggtgtgtgtatggtaatggaaatagcaggtaagagcacataactcacttttctcccagcacttggtgaaaaagaaaaaacaaaccaacaacagaaaaccatttctgacctgcctcttgagttttgaaactgggtgtggatacaaacgatctttagcgaagccattcagaactgggttttctgtctttattgaagagttgcagattttgatcttgctcatttttttccccttccctccatgaccctctcacctttactcctccgctgacattcagccagctattcaccaggtgccggcgtggtgtgtgcctggacccctcactgcgccagcctccctgggagaatcatctcctctaaggagagtatggaatgctgcagcggaaggaaaaggttttccaggcagcattaaccctggaaagtagaattcctactttgcgtgtgaaggactgacttgttgagaatgaaccagccgtggggttgtgaaagctgcttagcgcagggatgagggctaaccagacactggtgttccctgggcctgagtgaccacagccagcccactcctgggtgattgttcttccccaggtttttgctgctgcagtgctgtgcccctggctgagaatggcatcaaagcagaaattaaagtcagtaattaaagcaaggtggctctggaaagagagaacaaataaagggtaattaattagggtggctttggccccagtaatctccaaataaatgttgcctcccctaatcctcatctgctggtctccaagtcattaagtagagttttgatttgcctgtggctattttttcatcttaaacattgcaagcagtgcgtttccaagaagttacagtggggtggttaacctttacatattaaggaaagattgaggcaatacggaataagagttaatggaattctgagcgcacatggaatttaacaaacaagatgaaatctagtatgaactgtgacctcagtcttaagatgtacatttgtacacactcttcctccctgtttttcccaattattttatttttctcttttcttttttattcttttttttttctttatacttggattttttttttgtttctactgtgttaacagatcatgatcaccattctgctaaaaaaaaagtctttagcattttcacctttaacaacatgaatatagagcaggcataattgcagccatcattttggtcactggcataaatcagccactcagattttttatctaaggaataaaagttctgtgttatcccagaaatacatatttgtaaactctcttgtagtaattcaggcaaagtatcaaaagatacttcagcgtttcttatttttttttcaaagtatcagaactgtgcctggctgaagtttaatatcagttattgtgttttcttacagaaaattaatactcattaaacttcaaagtgtttttttaaacaatttcattatttcagatttagaattcttagttgtcattctctgtagttgcagaaccagcacctcccgtattttctccggggcattctggttaacaccttcaaagcccatcaaaaaaaaaaaaggttatgtgttttgctttataccacttccctgtggccaagcaaattttaccagtaagagagcaatactaagagaaatacactcctgagcccatttcctgattgccctaaaagtgaacaaaaatagaaattcctttaactatatcaagaagaatgttcttctgttctctttcttacacttgcttatcatgaaaaagcctaaagaaaactgggaatttaatcacactattgcttaaacacatggtctccaagtgttttggattatgaacctccttggtagaagattttttagtacatctgccagtaaagcattttatttgtaaattctatacaaattctcctatatgctggatactttatgaaacatgccctaaagacaggtccttaaggtggacatgcatccaattgactctgctcttcctcttgtcatggggttggtgctggagatctctgcagtgtacccataagaagaatcctggccctcagcagtgtccatgtggtcgggcctcccagtctccatgtgatggtgcgggccagtgcctggcatcctgctaggccccccacagcaaggacataggaagcacatccgggaatgtgacacccacagagcacacatgtggccctcaagcacagtgcttcccctgaggcctgtgagaaatgtcatcacaaccctacaccacctcctgtgaccacaatgaatggcctggcctttgctcaaaccacagacaaaggctgcccttcagtctgtcacaccagaagccatggccttttgatgccctggtgaattctggctcttggtttgcatcagatgagcccccactggtgcagttctccgaattttggtgtcattgacttgcacaagcttttgtctacatctctggggagctgcagaataagctgcattgtcctcatgaagcttttgttgtagtatgaagattgccaagtcccaacatgactatgatgccaagcagactatggtgacagcgggaggtgggagtcaccaggttacaggtgggaaagaacacttagttgggggatgggggagctcctggaggaattggacttaatgataggctttaaaggatgaacaagagttcaacaggcaggaatgagacagggaggagctggctgaggagctttagaaagtgggtactgcagagggggtccctggaggaggtatggacactggttggagaagaagctcccactgccctgcctaccccagctgtctcctcatgggtaccttgcttccccctcgccccttcgctgtattctgaacacagaaaccagagtacttctgtaatatggaaatcatgtcataacagaccatgctaacctttgctcaaacccccttatggctcccacttctgtagaatacaagccagggtccttccaatggctaaaggtctctcttgtcctcattcccaaccactttctccatgaccctcctccgcagccaccctgagcctccttgctgggcttgcagcatgccagattctcctgcctcagggcctccacacctgctgttccctgggccagaatgctgttccccagcatccaacggttcactcccctacctgcttcaggtcctcatgcactcgcatgtccccttctcaaggatgccttccctggccgggcttgctttcaccacttttccagcttttctgcccctccgcgctgctctgttgcccacactcaaggctgtctaaacatactgtggattgtacccatctatcttgttttgtgtcttttttccccatctggaatgtaagctccaagagggcggggagttttgtctgttttgttcatatttgaattcctagtacctagaacagtgtttagacaaatgaatgaataaatggagggatgcgtgaatgaatgtgaaccagaaggcttaggttcaacttcaggagcaaagggaagtcattgaaggtttgttttgtttaaatatagcatgttaccttttatttacttaaagtgggggaaataaaatcataattgcttttatttgattaaaaaaaccccaaaataataaaaatggtttaaaaaaatgaggttacacctaacaggcagagtgagaatggagtggacagggacagaggtaggaaaagctttctcagtgtatcctatttaagtatattttgggcctggcgcggtggctcacgcctgtaatcccagcactttgggaggccaacgcaggcagatcatgaggtcaggagatcaagaccatcctggctaacacggtgaaaccccatctctactaaaaatacaaaaaattagccgggcgtggtggcgggcacctgtagtcccagctactcgggaggctgaggcaggagaatggcgtgaacccgggaggcggagcttgcagtgagccgagatagtgccactgcactccagcctgggcgacagagcaagactccgtctcaaaaaaaaaaaaaaagtttattttgttttttatcatatgactgtattatcaaattttaaaaatatttgtttaaatgagactgataaggtgggcagtggggggttggaatttgcaatgttcgaaagtaagatccaggaaaactatccaaagttctactcatcttagtggcagggtttacacttcatttatctattcttttctagagtatctacaatcatatctatcatgtaaaaggctattcagtatttgctgatcaaatgaatggatatgtgaatgagatgacatctgtcgtcaaatgtatgaatgactcttgtgtcaaagaggaactagtttttagttctatgtgatcaaagtagaagcagtggatgacagtgacaggaagaaagacatcagtttgtttctttagctggcatttttgagagactattttgtaccagcaccaggactatcaagtggaataagatgtggctcaagccgtcaggaggttcaccgtttagaaccagggtgtcatcacataggtggtcacctactgaagtgagcacggtgctggagacagacgtaggaagtttggagagtgcttaacaaaccttggacaagggtatgagtgggtttggggtgacaaacattttttgcttggccaaatttgggtcaggtttctgaaccttttcctaggctcacctgtgcacttccttataaaacccagttttagcaaagaaccccgcaaagtcagtttaacaggaacccccccacccttaatatctgattgggttcttcatcttctaccatccgtcaggtgatgtctgatcacccgggcctgtcttcagcaagaatcctattaggtcagcttagccagagtcctctttaccccgatgcctcctcttagtaattttccaccactgaccctgacactgcttcttggccatgctgtattcggagttgagctcaatctacccccgcccccagcccccactgcaagacctggttgtggtggtctctatacccatcgtggtggtcctgaataaagtctgccttgtcgggcttcagcaggcatcattgaataatatttttttaacacggggggtcattgttggcttcctggagaacgacatgcctgcactcaatcttaaggaaggaaaggaaaggggagaaaggaggaataatccagggagagggagagcacgagcagagacttggggaagagaagaggggagtgtgttttgaggcatataagccatttgtcttggaggaacataaaagtgagagcagcactggcaggatatgtgacaagaaagacacaagacgaccttgaacagtctgcctgggctacagcaggaacagtgcttatcactgaagcttatacagcgggagaggaacgtgaccgagcttggtcagcatcagggatttttatgtgtcagacttgcacattatgttggagtggtaagacacaggccaagcgaggccagttgggaagatattacagttgctgagggctgcctacctgcagcactatgcacggtgaaggatgggatagagaacctacaggactttctgtggacctgcagggcacataggaggacatccaaggtgccctggaccacccagagagatggggaaatgagctacagtaccacagggcattggcccaaggcgggcatagttccttggaacaagcgtggaatctgcaatgaaaagcccagagtgagttccggctctcctaaacatagtgtgtgccactctgaacctcaatatctttatcgatgaaatcggaaatagaaaggcaactgatgtgctttagccgccacctgtgtttcaggcattgtgctaggcactttgccaccatcactagatgaatcctctccacaactctgaatttgatattaatccctcttaaaagttgagaataagaaccttctccttagttaataatgccttttagaccacaaagtggtaaagatgaggaagagagcaaacccttgtggggttgttttttgttttgttttgtttttgtgtagtaacttaggctggggaacaatgctccacattctatagggaatggttacacatgtgaagtaacagtaaaactactttaccactttgggaggccgaggcgggtggatcacgaggtcaggagtttgagaccagcctgaccaacatggtgaaaccccatctctactaaaaatacaaaaattagctgggcgtggtggcaggcgcctgtaatcccaactacttgggaggctgaggcaggagaatcgcttgaacccaggaggcagaggttgcagtgagccaagatcacgccattgcactccggcctgggcgacaagagcaaaactgtctcaaaaaaaaaaaaaaaaaaaaaaaaaaactatttcactatcttagaagcaaaaaactgaaataaaatgtaactgtcatcatgttcattcacaagagagcctttgcaagttgcctcattttttgctcagtgttggaagtcaaaactcagtttctgtctttggtcagttcatgttgcagacagcttcacagggggcacattcttggtgcagttgtcaactccttagagttcataatggatgtgctgaagtcatcctaatgatgctttcagaatgctgtaatgggaatgatggaattcatcataaaccttaatttttcctcactgaaaatggaaacttcctaatggaaactgtttggagccagaggaggcaaatgcaggttaaaaagactcatttatgatttttatggtgtgagtggaagaaatgcaaaacttctaaagctctcagttgactaaaacattcatttactttaacttctgggttcagttttatcatgttgagtgcaggttttagaatgcttctcaagagctctaatgagactatattagtccgttttcacactgctgataaagacaagacatacccaagactgggaagaaaaagaggtttaattggacttacagttccacatggctggggaggcctcagaatcacggcgggaggtgaaagacacttcttacatggcggcagcaagggaaaatgatgagaaagcaaaagtgaaaacccctgataaacccatcagatctcgtgagacttattcactatcacgagaatagcacaggaaagactggccccccatgattcaattacctccccctgggtccctcccacaatatgtgggaattctgggagatacaattcaagttgagattttggtggggacacagcccaaccatatcagaggtcttgctgtgggtcttgctctgctttcttcagatcactgacatccaaccagcaagcaagaatcaggaatatacttgcctccaaaaccacaaggaatatacaagtaggaaagtcagctttttaaatacttgctttggatccgtttttattctcagtggggagaatcactatttataaagtaaattcatttgcataggacctttagaaatgcaagttcacgtataatagacatgcagtcaaagacagactctcttagcaagaattgtcagataagcagatgaggaggcattgatatgagcataaggcagtcttaccctatgggtacagggacaggtgtcccaggaaaccctgtgctttgccctgttggccaaccagagtgtccaagtgccactaaggattcctgctactcagcaagacgcactttggaaactcaaatctgctccatacctctcacattttagccaaggaaaaccaaggtggcagatcctaagtgccctccccctgatccagggctctggtacaatttgtgaaccagtgatttttttgccagagaacatgcattccagtctccctacaaagtggcagccaccattttgaccggctcttactcctgatctaaaaatggaagtgctcaagtttactaaattcaattcagatagatagaaccgatcaattcaaaggcagatatagaattacatgtttttgggcaatctagtgaaagatttatcatttctatgagcaaagacagttgaataatcttcaaatacctcaccgttctttttttttttttccatccatataacgaaatcaaaattgtatattcgggtgagcccacactgttgtctcagatgaacagagatgtttgagatttgcccacaaaattgagctggaactttgtgtcatgattttaaaagagaaaagaagacagtgaaatcagcctcttgtgtctaaattagcctcttctgtctcttctgatcaccttttaatggaatttgcccaggtgcatgccaggagaagagaaaagggggagacaaagagttggagagggggagggaacatcagagaagttccaagcccctctggaggagtggaatgcaggactgtgtctgctcccctcacctctgtttccccttagcctctcctgcccaccaccacaatcttcatgtgcctgctggacagacaaaggctccctgtactgaaaatgcaggactgcaagcatacacattccctctcgaagcatcatccaggatgaccacttccccttggtgtttgatgcatgttgcattgttcagtattctacacttttttggaatacatgcgtttatgtcttttcaggttgggagttatggataatttggcaaagcaaacaccataactggtttcttacataactctacagttggcagcaaggcacagtgcgttgaaattaagcaacactcactcatccaaaaggactttgcttttccttttttggaaggctaaatgccctgctttgtttcttcctcttgcatgtattttaaattattggctgactttaatgattctttgaagttaatttttaaatgtgaatggcaggattccatttaacttctggaagcttgagagctgtccctgtgtgcccctaaatcagagaatgcttaaataacttgagtgcttttaggtgataataaaattggagagagtgagaagaacataggacccaggctgccatagggatctaaactggtaaaatacttagaaggttcaagagttgcaaccttttgaaagaactagagtcagtcttgcatcgcagagcacttctccaaaccaggcatcttccctgcatcttccctttcaattatagtgtacattctttccatttcttcttcctttcctttttttttttttttttacatttagtttatgagtctttaagcaggacctcttaacccatttatgcctagtgttccattattggaacgctaagcatgtgggagttatttatatcctattgctcaaggtcattgccaaggtctgatggcaaaaattcaaaaaattgcaacctctggcataaatgggttaatgcttctttgctcagtttcaaaggctagattgctcagtttcaaaggctagtgtttttgtatcctttgcctgaattcagtagtgctttgaaaatgatcgaagtgtttcatatccccagttctcaaattataataatgaagttttcaaatgaaaatcctaggattgttttaggttctgtttgctccattccactgtgggatacaagtagaaattgggacattcatccaataaaatgtcactggggaaaaaaattttaactacacttcaaaatgattcctctttttgtcctttaaaatttttattgaccaagacagatttcaaaatgttttctctaataccccaaagtgaaactttgattgaggttttcaggaaattccagggatcaagtatgtcacccggactttggtttccaggtttcccaaagccttgaaatttccctacagtctaattgctgtttattgccacagaccttcatcctttttcttttgtaacattttccatcttaagaagggtcgtcccattcggccgaggagcgtgttgtctgagtagctgaatggaattactaccagtggaaactatgctgcaagagaggttgataaagcagctgtgaagcaaacctcagctgttttttccattctccccaagcaaagttaattagcatagggaaaatgactaaggtgttgacgtcacctctttccagtagaaacttacactttgtccctgtctgcctgcaagcatgcaggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggtaaggcttctaatataacgtgattttctttagttttcaaagcattatgctaactgggactattaactgaatacttgggagaatgtggctctcttgtgggtttgggggttttgaaagaaatccaaagtctttcgagccttgaaaatcaaaagctgttgcctgaggaattaactgaggaaggaatttctaaagatctcaatatttgacaacatccaggcccctgaaccaactcactaggaaggcgagagttggggcatcgtgtgtttttcattctgtgtatgttgtaagtgaacttttcagaaagaggcctcttctgacagtgaatagtgttttacttttgtagccagcgttgtgaataatttcatttcgtcttaggaaataaatgttataaagatatttgtatgtttgtagtaattatgagggcctggcctcaagctcccagatttctctaacaagagaaaatgccgccagagcaaataataaaactggagaaattaagtgtgagatcagtgtgcctcctgggcagcagctctctttgatggtgattaatataatcattttaatcactacacttttcttcttcatttgattaaaatgtaagttttttcatcagcagctatccggctaattgagctttaataatactgtataggaatgaatcctgtatgctctatttgaggggtggtatttgtgcctggtggtgttatatgctttatatccaaagccatattgggacatgcgaaggtttctttttttaaaaaaaatcaaatgtaactccataattgtatataatgcttatgggctcgcaccatagtgtttggactagattgcagagcacattctatgtttttaaagtactacaaagtgagttcacttaacatgagccttatgtgagtaaaatcactattttttaaatgaagtagagatgccatccaaaagctataataactaggtatcagttattagaacaaataagattcttttataagagaaaggcatcatagtaatctagattttaaagataatgtgaattctcttttgttctggtcctaagccctgaacctgtattctaaaaatattcttcaaagtcatctctcccaaattctgaatcataacttcaaaactaaacagtgggtcacagtgcctattgatgaggtcatacaaaattccaaatgtacgaagacacacttttgccagaaacttgcccgtgctcaagagaggtggggaaaaagagtgagaggcggccagatgaactctaccgtccgccagctccgcgttccttcgcacgtgcctctgcgggatccctcgtgggaaagtctcagaaatgtccctaaactgaagaaaagccggggaatgcaaggagagcaaggtcgtaggttgttccgactgctccttaacgacctgcctggcagggaccgactaccctgctcctacccgcagccccatgtggagcaggcatccaccagtgcctccccgcgcttgctagcagtgaacattcctgaagacactctcctctcttatcctgaatcctcgctcccactgcagagacactgcgccttccataggttctccaaggtcctcagtgagctctgtccgcgctgcctaccatccacaccctgcgccatccccttcttcctggccagccccttctgcctttcacacgggctcccacaaactgtcctaagtgtttttgcctggtaaaaagattcacaaaacccggcgactagaagcccatgcagtcttccttggagctttgactgtccaccagttaaactccctctctgaggagttgcagtggcccccagctgcccccaccgacagccacactccaggacccagcctagggggctgtcccctgagcaacctaagcttgtaatcccccacctcgagctttgcattctaagagctcaggacatctcctaattctcactagccctatggcaccagagcgaggtgtgcacagacacgaaagccaggatgcagaaaatggtccatttgcagaacattaatttttaaaccagtatcattttagagagttaaaaagtaacagactgagataaaagcgatcgtggaaatttttaaaaactacttattttaagaaatgcaaaactttctaccaactttgttatttttcaagtcagtatttctttttttcaaattagctgcagttcttttaagccttaaagaaatctttgatatatgcaacactgccctgagctgaacggtggggttggagttggctagccggggaaggctataggacagagaaaaaagggggggtgagtgggggaaggccataggacagagaaacatggggagcaaattaccaaactgtacctccctggaaaatgctcattctactttttaaaaaagtttgttaccgtaagtagtgtctatgtattggcaactgttctgctgattcgatgaatgtaataaatcataccttcttaccttcttgtaaaatcacctgcattgggactaaaggccatagtcccctaagaggggaaaggcttttctctaagaaagaagttaggagttcttgaaaggattgatgatccacttcctcagtaaaaaatgtattgaggaggccaggcacggtggctcatgcctgtaatcccagcactttgggaggccgagggatcacctgaggacaggagcttgagaccagccttgccaacatggcaaagccccgtctctactaaaaatacaaaaattagccaggtgtgctggcaggcacctgtaaccccagctactcgggaggctgaggcaggagaatcacttgaacctgggaggtggaggttgcagtgagccaaaactgcaccactgcactccagcctgggtgacagagcaagactctgtctcgaagaaaaaaaaaaaagtaatgacatcatctagtcaagggtcatatgcaggtaaatttcaactccttttatttttattgttatttttcaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcaggtgagttgggttcattgctatgcatgcttctccctcctccctccctcccttttgtaaagcagcttatacgttgcttatgttatatgctgaccggaaactctgagacttcaccttgagaaagacaaaattcctactctgaatgttcagcgtctcacttgttttaagaagatatcaaggtgcatttgaaagcaacctcagacattgcccctgaccttcctgggttgataatgatgggggaaagaaagccttccctgttcactggggagcttgcagggtgcagcggggtaggcgtggctatgcaaacaccctaaggtttgcgcagcaggtttccatgaatttgctcaagggttggagctcatgacccactctagactgagcagaccagagtggttccctgctcatgtggtgctgggggtactcagcagagaaacaggagtctgcagaagatgcctgcaaatcagcccaggactgccaggtctggcttgaaaggaaaataggggataaccagactgggcgcagatgctaagaaaccctctggttggcagggttcccagccccagggcacccacggcagggagaggggtagctggggttgggcttgccttttctcctgcccactaccattttgaccctcctctggggaacttaggacaggtgacccaccttcaaggcagctcccagagttccatttgatgtccttaggggctgacagattgtcagggaagaagagaggagcttctagaatgcagccagctcctcagtaaagcaagtccccctcaggctctgagcacccccccaacccgcccccaccacacacacacatacacacataccttgctgggatgggagaggaccctgtccaaaggcctcccccagtgggaggaagctcatctgacaccacgccagagagccaaagtgtcttttcttcctcaaagtgaggacagcgaacttgctgggcccttcaagtataaataaagcatttgggatccccgccccacccctgacctttttgccctgggaggcacaggctgagctttgaccttgggtgcctaggccttcctgtgtgagtacactcctttctgcacgggataagattttatgcaaataattacttagtactcctctgaccttttctgtttgtaaaacaatgcatattcattgtgaaaacttggggagggcaatctggaagtgcagagaaaacctacaccgcgcagcttgagatgtaagagctctatggacagccctctcatcactggtcagcatttctaaaaccaaactaggatcgtaggttattgttccttattcttatttcttaaagtctcctgggaagtggcttttttttttttttctggcatctgatccagagtcccggagagggaggtgcagagctgctgctgggtggggaaccctaggggcaggtggagccctggctccctgtccctgagaagctgtgtcctctcagaactgtggcctaggctttggactttcagagcttgcctctgtggtatgaggagcggggagagactgattccaagagccctcctgacctcaatgacagtgacttaaatttccatatatactaaagtcacctctgctgattttctgtccatctaggtcaagcgtaattatttgcagtccctgtgcctgtgactcccatagccctgggagggggctgtcatcctatctgtgccacaaccagagttcatatgtccttttgccctccccattacagaccatcttacaattggtcctggaatcacacctgtcctgacgcctggacattgacctgcccatctcccggaactggcgttaggtgctgttgcctcactgcagttcttccctggcaacaactgacctgtgcttattttctctcctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggtgagcagggccctcgggtgggagggaggcagggggagacacagctgctgccctgcaccagggagcagtaccaccactacccccgtagctctcctgagcccatgccggcatgttttgtgagcttctctgtattcttctgcgccaccgtcccttgtgctgggagcatgcctgcctcttggcaccacctgcagtgttagagagactgcggctgatcgtggggaccctgcatcacgcccctccaccccccgcagtgtcccaggaatccattcctgtgtccactgagcacagcctgcgtgggaggcctgagccccggccccaggttctgtcgctccggatagggatgagtgattggactttggaaagggaaaatcgatgccccctttaagaaatgttatttttaatcaaaataaattctccctttcctgtgattctcacctggccttcttaaaggaaaagggaaggagaaccataggccatggtgagggaagggccgcggtcgggctgccctaccccagggcctgtgggctggtcccctacagagcttgctaaagaaagaggaagttcccgtcctctggagggacaaaagtgtgagcactgcggggagggggtaggttcctcaggctctttgtccaaaatgtgggccttaactggtggaattgtgagcagtagatgagatcatcgagtgaaaggcacttccatcagcacctggctcacagtcagtgttcaatgcaggatttttgaaaaccataaaatgttggtggttcctgtcctgtcctctagggtttgggtgaggaggcaggtgtgagggagagtcttggggtgaagaggtttgagccttctcctgctctgtccgtggagcaagtcaaataaatgctgagaccgtcagctcctcatttctccttgaccagcaatctgatgttcccttgggttgagggttttgttttcttggtccatcagcagtttcatattgaaaagattacatttctgaaaacattgtccaaacggaaattccctctgtgggataaagcaagactcacattacttactgctaattgtggcgtgaaggtcaagatcagaaatggccattttgaggaagcgtgtgctccccccacagcagctcctggcccgggggcatgagcatggctgagggtgtggagtcttcccctaggttaggaatgggagaaaacagggtctccacttgcaaagaggtgtccacagttccagaggcaaatgctgttaataaaaattctgcatactccagaatataccacttccttcaccgagggcttattggagaaggctttttaggaaatagacgtaataaaatcagtttgtccttggttcacttaacagtgagcttgagtgagatttcatatttcacctgtgcttttcaaccaacaggattgcggagattttgcaaattatggtcctaaaccctgagctttctggattttcgatgattagtaggtagataagagacttgcaaagaggtagatttgtaagaggctcttaaccagcattttcagcaatccatctgacctcccatgcctgaattctctctctcagagagctgagctcctttgcctttttcagtgcagttataataacattccagtcccacatgtgatagagaaaagatcaccaccttccttatcagtaaaagtaccttccaggtttagaggagtaaccagtgtggctggaggtaggaagctctcctgggccgctcttgtcgggcggaaatcacacagtggttggtgcggtgcctcctcgcttacccgaactgcaaagaaatcccaagcacaggccgggcgcggtggctcatgcctgtaatcccagcactttggaaggctgaggcaggcggatcacgaggtcaggagatcaagaccatcctggccaacatggtgaaacctcgtctctactaaaaatacaaaaattagctgagtatgatggcatgcgcctgtagtcccagctacttgggaggctgaggcaggagaatcacttgaacctgggaggcggaggttgcactgagccgagatcttgtcactgcattccagcctgggcaacaggcaagactctgtctcaaaaaaaaaaaaaaaaaaaagaaagaaagaaagaaaaagaaaaaagaaaagaaaagaaatcccaagcacaaagccctggaagaaaactgaccatgaggccacaccctgtgggtggagcaggttgaagcaaacctcctgcccctatttcagatccctgcccagcagggcaccaataacgatgcagtctccattcttaaacatctttctaggtgacatgggctggacaagcatgtggtgagccgggttctcattgcctcgggcactcactcatgctgttagctccatgaagtcaatacctttaccgtctcctttactgaggagggaactgaggtgcacagggaagcagaataaagtgcccatgagccctgggtactaaggagccaggctcagagctgccttcatgagcaccagagatgcacactcttcccgtggccagagcggcaccccagcgggaggccccagtcccttcattctacattgccgggtttttcagttgcagaaagctctccccacccttgctggaccagagtggcctgaacttggccaacctggtagaactcaggctgacatagaacagcaggacactcctggtcccggggattagaagttgttctaaggaaaagatgcccaggtcaaaaacgtttccagagcacctggctccgtgcagccacccctgcgtctgctgcagggcctcctgtggcgcccttcctgggcgtgcactgcgaccctcaaataggagctgcatgagggaggcccagggttctgtttccaaatacgtttcttcatccatctttttcctgaaccgaagtttctcacattcacacttgaggaaatgctgacagaaagggagttctctgggtagtttagatatctggtggacatgtgaagtataactagaaaaatgcattccttctatacttctcatgtgcctggactcccagaatgtttgactaaaaacagagtcatgcacaatggaaatctctctttttctgaatgagctagcaaagaaatacaaacccaaaatatgtctggctgtgtctctcagcccaatcgaatggtcacgagcagctggcccagcagagccctgaatgctcttttatgtttgccttttgactcccaaggacttgtctgagtgaccctgcgattattttccctccttaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacag

SEQ ID NO: 36982 - DNA, 15942 bp, Homo sapiens
gcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccaggtgggcgcgggccctgtgggcttcccgccctcccctgcccagccgagccgcactgcctcctcgccgtgcgggcggggcccgggttcgggccacggtcgggcgggcgggccgcgctcggggtgcggcggcgactccggcaacatggcggccagcctggagtccactcgtggccgggccgggtggggagcgcgctggggggaagcggacgcgcggttcccagtggctgcggggctggggcccccctcgaagtgttgcaagtcgaggtgccttttaaaagtgcatcgtaattcctagcctcacttggggtcggaaatggggacgtggcttccttccgcgggggcagcggtggggttgaggatggggccgggcgtcgcgcctctgaggttggcggtggggccgagctgcctctccctgccactggttgttcaccctcccggcgcctctctccggaggtagccttctccggaagtccgggaaagagaaacttaaagacggtaatgctcgttcgtgtctcagacttgagtctgagaaggtcgcttgagatttaattacattggttttgcagataggaatagaatgtagctgacgtttgagcacgtagttagtgaaaacttcacacttcaaagtatgcgaaaaggaagaaaagtacccatgtatgtaccgggtgttttgcgtacgtatcctaaggctaaactggaaggtaggtagtgaaacctaggaggtagatgcagagacggagatgagtaaactctcctgacattgtatgtttattcttttttcaattgtttttaaaattttcttaactatgtcctgtgctcagatagcgtatgtttagtaggtcgtggaacgggggtttgtgcccaggtctgtgggttttctaaaacccgatcaggagcgtgtcttttgttatgtgcagtcgcatagggctggttaaggcatacatacattttaaagcagaaattgccatataccgtgacaacacaaaagagagaaggaagataagtttgaggtaataagcgggagaaacactagaggtttaaaacctgcagtctcgtatgattggttattctagttaacattagttaaggagtaatgtttacgtagttaacattggcttcttgaccgaagaatgccgaagtgtaatgatttttatcacggcattcatattctacaaattctcctctagttttagtattttataaaagtttaataaagtatatagtaaacttaatgttttgtttttagtttaaggaagatgtaatggtaacatttcaaaacgagggaagtaaattgcagtataatactgggaattctaaccgcactattttaagatgatagagcagaatatgtttgtctcagtcttaatttgacagtttcctttcagaattgtagtgtgtgtgtaagagaaggttggaagtatcaaattaatttgtctttgtgtaattgaagtgcgtgcaaaggaggtatgtattttctggaaatcataagtggatgtagtgtggtctgaaaggtagcaagtttagttcattgtaaagaacatttcagacatttcactttgctacacccgtcaagcacaaaggtttttaaacagcatgttttatctatacaaacttcagaaaatttatttttactttatgaacccttccccaccccaccgtacatgtcccagtctttaataagtactaatgatgaagtattgaaagcagtgcctctgcagaactattttttaggcaggagcaaagcaaacgagaatgtttggaggcatctagtttctaggaaaatgaatggagcccaattcttttttttcttttattttgctgctttttctcactggaaaatagagcccaattttatagtccgttcttctccagaaattgaattatggtgatgagtacttgtttctggattgtttggcctaggatgaactattgacaaataccttgttaacctgaattgtatgcacttgaatatgggcttttagatgttgtctccagttgtggaggatcctgtcgagagtggatcatttatgaatcgagaatccctgggaaattatctttgtttgcagcagaatgggcatcatcagtgcttgggttcaacctgttaaactactactgttactactaaaaatctcagggttttatctgatgtttgggggtagtggttttcctatgtgtagtgttggtattatatcaaagcctttttctcgatatttttatgtattaaggatgctttgaaatgcctaaatccttagtggctgtgggtgtcttccaatagttgtcctgtgaaaaaggattggttagacagataccatcaggcactgtactgagagtgaccactagcttgtttttctaatgcgtttacttacagctttgtaatgattggaatttcttagtaaaccagtataaagttttatcatttatctgaattagtaattttgatgctgtatgtaatgcttattgttcaaaaagataagtaatacagattcaaataagatactaataaaatcattgatttcatgcatctctccccccaactccccagaaacctgtgaaggtcgaaacagctgcgtttcctgttttaatgttagcgttgttaatactacctgcttttggatagaatgtaaaggtaagaaactttggggatgcaaaactgttttgttatagcattttaaaatacagtaattcttgaacacttgaaagttatgtaggacatttaggatattgtgcactatttattttgcaaatccagtactcctttaaagtgccagttgcctcgcactccccctgaaaatctctttttgtctcccatcctccctttagattccttaagacttgataattaaagctcagtcgtttgttttttatgagatggagtctcctgtgttacccaggttggtcttgaaatcctaggctcaagcaatcctccaaccttggcctccctagtagccaagactacagatgcgtgcttcctcacctggctttttttaaagcctgttctaaggattgagagtactttaatacactggaattagctgtgagtgaaggttgtgttgaaaactgtgtcctgcaacatgaaatataaagagaccttatgaaactgttggatgcttaggtgtagagaagaaagaggtagggagagttgacttcctgtgcttttgttaatacaagaggtagagcgctaaagggacgtacattgaaattcaataagattcttattagaaccatattactgcatacattattttaattgttttttaatgtaaagtggttgcacttatcagtaaaacaatctagttgttttggcggttttttttttaagtaaaaacaaaccataagtttttttatttggtaaaaattttaatagttctagaaattatatcactacataaatttcaaaaagctctttaaggtattaactaaattgggccaaattaacttttttgttatagaagtgtctcttttttttaggtcataaaatgggatttaagggcgtactctttcccctttatatgggagtatgtaagagttggtgaattttggagatggaatgctctactttaagatttgttgggaaaggttctccccttactcttgttccaagtctacctatccaggaaagttgttttagaaagtatagaagactaaagcagtgagatttggaatagagtttctacagtgttatggggtgcctcatctgtttactaacctcttaatacagaccctgaccacttcaacttactgtctccgcctttttttttttccctgagacagagttctgtatttttggtagaggcagggtctcaccatattggtcaggctgatctcgaactcctgacctcaggtgatcttcccaccctggcctcccaaagtgctgagattataggcgtgagccacctgcccactttttagatgatggctgcctttcttgattgtacagtagtcttcccacaattctgagatctaagtgttgcagatttattttttcagtatattaatgtggatttttaatggataaaagttagaaggatcctgcgtaatctctaagtcagtgggaaaaggagaatgacagggtttggtctgtgggtttaactttaggtcaaaacacctaaagtggttccccctgcccacttctaaagtgtttgggtttgatttcatagagcttagtagcagagtcaaagataatacaaatgggtggttgatgctgtttgtctcttttcccctgccccccaacagatgagagctattgttcacataactcaacagttagtgattgtcaagtggggaacacgacagacttctgttccggtaagtattcatattggctgcttggaagctgaccgcagagaggtgaggaagatcattgcctcagaaagccttgtttcagtgctttgtttgaagcattgccataattctcatcttgttagaattggaatatgaatagtatattcatattgattgattaaaggatgatatttgaagcttggtttagtgatttagctatagtgtggatgctgtaagtgtggatgcgttgtctgcccccacacttttttttttttttttaaacttttctaggaattcatcacagtttagccgctatgtttgcatcttgcaggtctgggaaacctcattctggcacttttggtgttgcgatactggggattgttgattgataaatttattctgcagcatagttggtgctgtggttaaatgagcttttctatacccatccattttctgtattttaatctgagtaacttgattaatttttaacctttactattcgtccagcaaaacgttaaaattctacttgaagctgctgatttttccaatgagattgtaaatcagtgggaaaggcatattcctaatttgatgcatagataataattgaataggaaaaagatttttgtgcagtgtgtctaaccttgaaagactacctttgactctttaattttggtaggggttgccccatcccaatgtgaattttgtaactgaacatttcattagtattagatcagttttacttcacacagggtgcataatatagttaggtggtacacgaacaaactttttttgagacagtctctttgttgcccaggctggagtgcagtggcacaatcataactcattgccacctcatattcctgggcttaagcaatccttctgcctcagcctccccagaagctgggattacaggtgcatgccaccatagctggctaatttaaaaatttttttgtagagatggtgtctcactatgttgcccaggctggtcttgaactcctgggcttaagcagtcttcccactttggcttcccagagtgctggaattacatgcttgagctactggacctggctgaaacattttaagtaattactttaatatgtgttagataaactaataactgtcagacctgtggttttgtaatattgcttagagacaagattaatgaagatttcattagtattagaacgtttttgaaaactgatttaaaggaaaactgtatttgtactgctgcatatttgatgatgtaccagttagaattagtttcagctatgaaggacataaacccccaaattacaatggcttaagcagtggactgatttacttttctctcatgtaaaggaagtctggactagagttcagctctgcaaccattagggactgaggcttctttaggtttttactctttcacctctcaaaaatggctttgaccctactgtccaaggtgggtccttatgttccagccatcacattgattattttcctgccagcaggatgaagaagggaatgaaagaggcttgtatcttactttaaggatgcttcctagaggttatgcgtgatggcctggaagcactggagactaggaaatgtcttttcaggaggaagggaggtgttgataaaaattggtgattctatttctaaagaagagactggtatttgggggcaactgtcagtctcttccacaggtagtatttaagtgttgtaaaaattgtgaaaagtactcaaatgattgcaggtcaggaactagcgttatagattgtgatattttaaatagctttgatgtatatggtttttcttttttctttttttaatagtttccacggccactccagtgccaacagccaattctacaggtaattcaagatgactgttttcttccttttccttcagtatttttaagctttcttgatggattagttttaaataattatgtaaaagttgttagtataattttaaagatgagtaaaaacttaaaagtcttggaccacagcaattaacgttaatctctaccttttgtgacagtgacacatagctccagtgttttatagtcggtgaatgtgagcagatttgctgaggctgtgtacattgagtctataaagtactttttatagatttagtggaaatcttgggaaatatagaagcctaaagcaaattataattctcatcatccagagcaaccaaaatgttttcagtgattaatttcttctagtcttttttatgtgtatctaaataaatacactttttatgaaattgtacgataacgttcatgcacctttgtatttctttttttcttttctttttttttttttggaagcgaagtcttgctctgccgctcaggctggagtgcagtggtacgatctcggttcactgcaaccttcccctcccaagttcaagcgattctcctgcctcagcctcctgagtcgctgggattacaggcacctgccatcatgcccaactaatttttgtttttttagtagagtcacggtttcaccacattggccaggctggtcttgaaatcctgacttaaagtgatccgcctacctcagactcccaaagagccgggattacaggtgtgagccaccgagcccagcctgtattttctctcttaatgtaagcattatggtatacactttacccatcctgctcttgattagagaattaggccgtctctcattctccatgcagtgaacatcttacatggaattgcatttgtatttatctctgataggtttgagtcaaacagaatttctaggtcagagggtatgattattttaaggctctccagaaagatttattattttcattcccatcaacctggaaagtttttaccgtgccctcaacagcatggataagaactccttaaaatttactaacttgagaggaagagtaaatattaaatacttaacattttaccaatattaaatgcgtctattccaagacaagtactagggtaaatggtagggttaagccagcattttgtctactgtaggaacaatgaaagatctcagtgagcacagcgtattgggaaatttgtaagaaggaatgtgtattgggtgggatgcagatgtggtgatagcttggtagtgaaactgcactggaaaacttggagagagcctctgaagtggagcagcgggtcagcacatgcggaggagatgtgaagtagtacggtgagttcaaagagtgtcccatcctgtacaaggtgagaaggagttaagctggtccatcaccagttgctcaccaggtgagcagaattgggaaacacctttgtatgccttgctggtagacttagatgttatcctgaaagattttaaagtttataggtcatatgatcagacttgcattttaataaaacaacttattctggcattgtggagagtagattggaacgatgccagaaggaactcaggagattagatagcctgttacaataattctagagaacagatagaggtgggctgcagatgtttgcaaataagtttaggaagtagaaggggtaggacttcatgactgagaggaggagaggtagagtgatagggagaaggggaggaattttcaccaaagtaagcaagaaagaggaagagcagtctattgatggttgggcctgtcatttgggattttagtttaagatacctagaatccatttaagtgggatctgttcagtattcaggaaactgcaagtcaggcaagagctcttggctaaaaatataaataggcataggcagtagtagaggcactggaggagcatatagaaagaagggatggggcttgaagaccagactctaggaaacagtaatgtctaagggctaggaagaagacgggaggaaatagggatgggggtagggtagtaaaaaagcccagagaagtatgtgcaagaaactaacagtatgtggttgtgggcgtagtttttcaaaggaagaagtagtcaaatgctgtaacaaggacaactcatcttgaaacacttacgcagtggtgtgtggagctggcttggaccagcttttgctagccagttattgtgtagtagctcttcccagcccatgttcagtgataccatgttggtaacttgaaactggttaccatggaaatagtcatgccatggaagtctgcaaatgatacaaaacttattttgagctgatgattatatggtgatgtggtcgtaaatatttaacactcattagaagacattgactaagtaggatgttgaaggttgctgaaaccagaggtgtttggagaaaagtaattttcagaaggttggttatgaaaagaaaatggggtgcagggagtgggggaacaatttattcagaactgttgttcatttcttgagaactgggttcactcttgatgtagttctctgcagctttctccaccctgggtcctcctgtgaattgccatgagtcttttgtgctatagctctctttggtgctgtaaagggggaaagcagcaagggcttatctgcagaaaatgcatcagttgactgacactagttgaagaacaaacctttaggcggtttcttttccgggcatgtgtaccgtctgccgaagagagcaagtgagaagtgaaggggtagttaaacaatgcaaagagaatctaatttatatagaagggtgtataatgaggttaattataatggccctccttcagtacaaataatagaatagccaaaatatgtcagatacagtggaaaatgttcatatgaagtggaagatgaactgtattaagcaattgtaatacaattttagctcttgttatatacatgcctagaaaaatggcaagaagtaacctgttactctgatgggactaattcagtattttttttggcattttctagattttcttaccactaatagcaacttttataacttatgattattattatttttttttaacctttcctaatgaatctttttttttcagtaaaagaaacagtaggtcaacagaggtatattccctaagtggtgcttttattttgaaaatattgtcaatgcaatacttttttcaaaatcgaaaataaaatattttgcctacttattaaaaagaaatagtttttaccttgttctgaggctgggtaatgagaaccaaattgcaaatttgcagaatttttttcctaacattgtcaaacaattggtaatagtgttttgagattgaacagaatttgatgtgtttaatttgtaaagtgtatttttttgtggttacacagaagcagtaaaaaccttgacagaaataatgagctttaacataaccacagcctctaatctaagaattctgtgtaaggaccagtcttaccagagataaggtcaaatattttcctgtaagattttctcagcatggagagttgagagaactgtttaatcaagagcaggatggatggaagtatgtacaacaatgcttgaagtaagagggaaaaaagaaagcaaatgggtctgaacatatccatcagtattatttgtatatcacctattagcttctaagtagtatcaatattaataaaagaagtcttaagctctctgtgactcatggtcatgtgaaaattagaataccttagtttcctaggattcagtcaaccttgggattatgggtagtcagcctgttacgagagtcctggtctttaaagatctacttttagcaacaattcaggtatttagcaatatctgaaaactgtcaagccctgctcttttagtgtatatttactgttaaagcacagaacttcctcttttatattagtagaatttgggaggatgctgattcctattgaggtttttgttcgattgtttgaaagtctaatgcagtgaaaagattactcatttctgtgcttcatcaacagttatttggcaccctttccctgtctttcgtgggttaagcatatcactttgaagtctgttcagttatgtactttaaacagaagtaacatttgttttccaaattctctttagccttcaaacccttttttctgaaatagtacaaaaatgaatgtttgcatagcaccttacatttttataaaaatataaatctcatatgattaatcttcctcatctttccccagatcatccctagcggcccaccagcataagcatatcctcatattgaagcccttgcactctgaagcctgacttacctaatgatttcctgagacaaaataagctctcttagctagtgactcctatagtgcactttccaaaaatttgaaccctacccttaggacaacctcttaatgaaacctttctcaaatgctccagcaaactttgaatttatttggtagccatttggatgttagaaaaaatgttaatttgtagaaactatattcacatccttcctttctgaaagccttggtcagacttctattagtattcatactaccaatagaaacttaataggtgatatactggctggacgaggtgagtcatgcttataatcccagcactttgggaggccaaggcggcagatcacttgaggtcaggagttcaagatgagcctggtcaacatggtgaaaccctgtctctcctaaaaataaaaaattagctgggtgtggtggcacatgcctgtaatcccagctacacaggaggctgagggaggagaatcgtttgaacctgggaggcggaggttgcagtgagctgagaatgcaccattgcactccagtctgggtgacagagcgagactccatctcaaaaaaaaaaaaagagtgctttagtccctaaaatgattttacattcaaactaatccttctcagagtgtacatttctttagcagtatcatcagctattaggttggtgcaaaagtaattgcagttcttgcctttagtaatggcaactcaaatagtattttggcctcatgcagtgtggtggactagagcttacttaaccttgggctcttagaatcttacgttggggaactgtgggcccagggcccctgttcttataaagctttattggaacataccatgcccattcgtctgcatgttgactttggctgcttttgcatcacacagtgcccaaagagtaaaatatttgctttcaacccatttaagaaaagtttgccaactcctgaagtgaagaagataggcaaatctcaatacccttgtaagagagaacttacgactttaatagtttttgtcttaggagaaagattatgaagaacctatagtttcctcacctaaatgttcttgcccttggcagtgagcaagataagagttttcgcaaattttatccagatgtatacatagattttatacaagatagatacatagatattaacaattttatgattgcttattgttttaaaatacacttaaatcctagtattcttgggtgcatagctatgttagtgaaccattaactgaaatttggcttttggtctctaaaaaattgaaagcatgttgaagttggcaggattattttttaaagctgttagataactgggaagctagaaatttaaggttttttaaaaagacattttgttttcattccagctaaacccacagttcagccctccccttctacaacttccaagacagttactacatcaggtaattgaggctttttagattagcaatgatgcaggatgtgtgcacgatgttgccctttacaatttctgccatcattttccagctttcttcgttaatggttatggaactgaaattcttctcttactcttaggggggatcaaggtagtgctttgttaacacaataatgatagctttgctgagattcctcttctcatttttaaatgtgtaatcacatttgacgtgacactttagaattaagtaataatgtttttccaaacatttcagtacaacttgtatgtaaaatctaatttgtaacttctgattaccgttagggattggttgtgtgctgtatgagagagcatggcgatttgagggaagataatatatccgtccttttcactgagaaaggtctaaaaagccagaatcactaccagatgtgcacctcactttcttaaccatttcttaacattgctcagtaatgtgaaaattagcttgttattaaatgatgatttgacataatctaatttaattcatagttaggttacgccacaggatactgtaggtacacaggttaggaatcctttcctccctccatatttttaaaaaactgatgctaatgaatcttctacctgctttttgtgatttctttttcttcatgcttatgccacctttttctcagtttcagtgaagccattctgtcttcacgagaaggaatacaaaacagttgtcattaaagttaccaacttgtacagccaccagaaccagtgttctttgataactgttacttttttcttagattattttaaatggaaatcgctttttctgtttcctcttgaaacattttactgcctgaaaagaattcagatatttgttttttccttattacttgataatactttctcatgtgaaatttgttggcaggatatgcctttaaaaacagttattttacttgttgaaattataaattgcatattattaagattatttttgtaacatgaaaaattgcaaccaaatattttaccttatactagtaaattcaaaagtcatgtgaattctcagcactattgacgtttacactcacaattaactaaaagtacatagtctgaagaaattgttgcatattttagaagtgtttgatacattcccagggcacaatttatgtactaggagaatttttcccattgtttttatatttgtactagtacagtagcattgaccactttgtatccttgggtggaatgaaaaatgggatatggttgtcttcctcaattagggataaattctagctgtaaagacttgaggaaatactttatagaatttaacacatggcaaaatagaggctcaggtgcatctttaaattacaatagaggaccatgaaacttaggattgttgtttcttttgtcttatctaacaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaatt

SEQ ID NO: 36983 - DNA, 8338 bp, Homo sapiens
cctccgagaacggtgtccatgacacagggcgggaagagataaggcctagggaaggcgcccctcgggcctatccacctcttctggggctcggcactaggaagcagcttccctctcaggcccctttgtctccaagccgttccaaactgagtaccgggagacgacacaaagggagggcggtgacggatggcgcaggcgcgggagccgcctaggctgctgggagtggtggtccggccgcggaatgggtaggtctcccgcgcactctgcggccgcagctcaaaggacaccgagagggtgccagtgcgcatgcgccgccacttccgcccgtgcccggccctccccttccttccgcctcccggaggacttgggtttctagtagtaagagtccggggggcattactcacggtctccccgcctcctcttcatcgtgattgggctgtcaaagtgatgttggcaagtagattggctactgcggttgccagttctgtttcgggccctacttatactgctctgtggggcggggacgaagagtcaggggctgaggagcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctggagcccgcagcccccagggcctgggacggtgaggggcgtgaatgcggcggggggcggggccgttgccgggggagggggccggggcgcatgcgcgctgcgcagcggggctgaatgtttcccaagtgtttgaaactggtatttgggttttccacgttggacaagtgcggctcggcggccagcggagcgcgccccttcccgctgcccgctccgctcctctcttctacccagcccagtgggcgagtgggcagcggcggccgcggcgctgggccctctcccgccggtgtgtgcgcgctcgtacgcgcggcccccggcgccagccccgccgcctgagagggggcctgcgccgccggccggggcgtgcgcccgggagccaccgccaccgcggcccgcgccctcaggcgctggggtccccgcggacccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaaccatgttgagtcctgccaacggggagcagctccacctggtgaactatgtggaggactacctggactccatcgagtccctgcctttcgacttgcagagaaatgtctcgctgatgcgggagatcgacgcgaaataccaaggtacggccgggtgatggatgggcgggggcggccgcctccttcccggcgggtccgggcgcgccgcggagccgggccggtcctgccgtggaccggaggaagcggccggctccgcagcggcggccctcggcaggggcaggaacaaaaggtctggagcgcctttgattcgccaaggtccttgtgtgcaaagcccgggacacggaggaggaaggaggcgcgagaggtctcgctgcaaggctgcgcgaccaaagcgctctttgtagtgaagtgatgaggcgggtgctgcgggggagggggcggcgggtccaagccgcgtcctctaggagggggtgcagattacggcgcgagatggagggatgtgccggcgcctggggctatagggcgccgagacggggctgcaggaggagggcggctgtgggccggggttcccgcggacccggtgcctcggtcccgggcaacgccgttcctctggcccttcttcgtcgccccccactcagtcccgaatctgagtgttacataaagtaccgggtagtactccgctcggggtaggtcggccgcccccgcccagccccctccggccctcacttggagctggacaccgagtaggggccgactgcgaggggcgacgccgccggttgtagtttgcggaggacgagggcttttctctgtgtgccgtagggaagggaagggaaggggaggagcggaggcggggaaggcgcccatctgcgctgcgctcgggggggcgcgggcagatcgctggcttggagaggactgtggcaggtgagaggacctgtgcgtcgttctctgcagacctggccgccccgggtgtcagagagaggtggcgagttcgtgtccgccgggaattgttggctgttggggaaactttcctgcgaggtcagtcaaggctttgggggctctgttttgaatgtggatcaccactcggagtttactaatgtttacaaggctgcgcagtagggaaacggaagagttgggtgggggcaaaaaaaaaaattgaccgctatccccgaaagtactagacgcctctgccgggaaggcgcccctgcgcgttctatccgagacgtagcttcgcagcgaattttataggaacttcattagcatattatggaacgtcccgcctcagccccccagtagttggctgtgatgtccttcgtggaatgtccttatcattcccctgcggaacgattggtcgctgaggcggatgaaggcgggcctagcgcaataactggtatgggtctgtgtttccgctgtcttcttttttctttttcggggaggagcggggtggagggtggacgagttgatttgaacgtcttcgggtcgctcggcctccagccttggattggttcttctcgctgctggggcgggccgtgctcttccgccctgcggtgtggttggttctcctcctggcctccgccctccaaatcggcgattcccataggcggcggctctcggggtgcggggcgagtctcccgctggcctcctccccattggctggaggcctggcgggtgtcgcccctgcccctctccccgctcagcccggccactttcgggcgcggatttatagcagtagcagtgatcccgggcctgtgggctcggggccggggctgcagttcggaccgcctcccgcgacccgcggggccggctcggagacagtttcaggccgcatctctgctgacccgagggtggggccgcgcgtggccgtggaaacgtgagtgactggggctgcgtccacgagggggaccctcggcgcagaaacttttctggaaggtgctgtcctcgggccggacgggccccgtggggtgaccctggggctccggacggaaggaaggcaggggctgagaccactttgatcgttcgacgatagaaaaaagtagcgcggggcggggtgcagggttccagctgtccagacagcaaagttcatggagccactttgtcctcctgtcgttgctggggagagcctggcttgctgcttgcttcatgttcacctagggtgatgaactttttggcttcaggaaagatcacagtcctgcccccccgggagtactggagcggcgcagctgggagcgccgagaagcgagcgaatctgtcgcaagggtcacagctccttggacttcggtgtaaatgctgagctctgccgcgtagttctgaaagacttccacagacctactctgtaggaagtcaaacgtcttttgcttagtaggcatcagttgtatgttaattcataaacttggattataattagtttgtcgatttaaaatggtgtttgaggttgcttgaattatttttcaaacattatcataaaaatacccacccaccccctgggaagttcgcttcataaagaacttcagtgcaacccgtatgtaaaattaaaatacatttaaaataattggacaaaccaatttaaatgttgctacaaccccatttaatctgtaaattgcatgtgctgctgctttccatggtaatgttggtgtggaatatgtttggaaaaaaggcagtagtgtctgaagctgagttgctggcattgaaaaagcagagtgtctggaaggatggcttcctatttagcagtggtgttgttcctgtttataaatatttgtacttagtggctttgttgataaaatactttgcttggagtatcaaagaaatattaggtaacagaaatacttcttggtaattttgcgatgggatatctgtttctcttgcccacaaattaggcttcacctggatggaagcttgcttgtgatgtaaaataacttctgtgttattaaattttaaatttatatgatacagttttctgtgaaatgacaatattgtctttagaactttgattactgatgaaaagaagtgataccattttgtaaccctaaatccatttaaaaataaatggtacacatattttaacattatgataaataagttgaataaattggtattacttggatacgttgaacacagctatttatttttataattaattactatatgagactagggctttcctcctggtggcaggcagcctgcattgttcctctaggagtcttcaaagctgtctttagtttgagaatatactctggaaaatattaccatttagagaagcttcagcgttggcctgagttcttatgtttactctagtgttaggtatatgtcttataactatttggagataagatctggaaaggaagggggtaacattttagacaatccctcccactctcagcccctcccctagtttacaagtagtattgttggccaggcacggtggctcactcctgtaatcccagcaccatgggagaccgaggcgggcggatcacctgaggtcgagagttgggagaccagcctgtccaacatggagacaccctgtctctactgaaaatacagaattagccgggcgtggtattacatgcctgtaatcccagctactcgggaggctgaggcaggagaatcgcttgaacctgggaggcaggttgcagtgagctgagatcgcgccattgcactccagcctgggcaacaagagtgaaactccgtttcaacaacaacaaaaaaaggtagtattgttgccttgtttaaagagactgcaaaaaggttttaggagaataatctggtactgtttaatttaatggttactgtttgaggaaaaagaactctggaatttctgtgtatttaagtagcctttttagcaaggctgtttacttcaactagattttttaatagcttttgtttcttgagaaattgcctaattacacttgccaaattacactttaaaatcatatacactgtcctctaacatgcccaggaaggtttacatttaaatactgaagaggttttcttttgtttttgataacattttaaagtccattgactttaacagatgtgaagatgtttttgtttaagcagtagatgcaaaagtaaaacctaccagcttcgctttaaagcaaggctagtgcattcactgcagttaaaaaataataataatagcccatcacagtggtgcttctgtagtcccagctactcaggaggctgaggtgggagggtcccttgaacctgggaggtcgaggctgcagtgagccgagattgcaccactgcactccagcctgggcgacagagacggaccttgtctccaaaataataacaagtcgtaataataataaagcaaagctaggttttctggattattgtggcagaactgttcttgctgtcactaatacagagggataacatgctagaataaatgtggggactgaaactgaggacctaagtcacaaagtatcctggacctttactgttaacccggttctttaaatcatagagagctattatataaatttatacacattctctcatttaacagggtattctagatgttggtatattaaaataaagaaaataaagaccttttttatttgaaatattcaaataatttataatatattttattaatgtttgtatattgtgtataaatgtaataaataccatgtttatataatgttatatgtatattaataattgtattcaaatagaaacatttgagtaaaaatgatggcagtatagacatagtcattaatagaaagtattaataaatgttgggtcccgagcactgcacctcatttaaacgtttcctcttaatggcttcgggcgttgtcacccgtgcgtgcctgggaactgttctcaggttccctggggtggctggagcggctcctgccgctgtggaagctgggccggcatttgtgttgtgttgtgttgtgttgtgttgtgttgtggttagcacaggaacagataggcccgggagagcctgtggctggtgggctttgttctgggcaagccgtgcgctggcccctaggctccctgccagccctctccgtagacccgtccggggccgtgtgggttgtcccggtgtcctgctcgcgagtgacgcctgtccttcttgcccccagagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaacac

SEQ ID NO: 36984 - DNA, 398085 bp, Homo sapiens; identical to SEQ ID NO: 36796

SEQ ID NO: 36985 - DNA, 22522 bp, Homo sapiens
gggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctggtaaggaccaagttgggaccctgactagacctcacctgcccaggcggcagagtataggagggatggggtcgccgcttgagctcaaacagactgggggttggggggagagggtgcagctctgtgactagcctaccccacgggctgtttccgttattttacctctcgcgggagggtcacgttcattcttaccgtgcggtggggtggagtcaaaagatggagtgtgaggcgaagcttctgcgtttgagggcaagggctgggggacccaatagatagtggctgcatagagcgacgagaggggaccgacgcttagccagggcggtagggacacgtggcttggctttgctgttgagccacccaggctggactgggttgcttcagctcttagactagcttgcatttagagagcctacctgcgtactgagctctcctggtctttcttttcctagagtccaataagcagctttttgattcgaaatggtgttggtccgttcggcttggtgttgagggaaactgacattatatactgcaggcgccaaaattattacgacttcccttagatcagcaagcgttggcttttctcatcttatgaatcatctacctgagtaattggagccataaatctagttgatttgttaaagtgatgcgttgactctgcatccttgatagccagcatctcagcttgagccatccaaaaaatcttggaaatctcaattctggaatgtttgaccttccccagtgcagctagtggtacagataatgcaaaagcgtatttttcagtaaccgagtccatcctggacttggctccttctttaagctctgtgtagggaatttaggaaacaattttatacctgaatgttaaagataattgaggacaggcaatgtagtggaagactaggattggacagtgcattgcaacttgcgttttttccattgccttgccagtaaaacttgcttcctcgactccgacttacaccctctaccggcaccatgggactgttttagagatgacttggttacctgattatttcagtgccccttccacctaagtgtgggatctttagtttctgataggtgtaatttgtattttattgttaccctatcgattaaatcagagccctgcccacaatcttacagatttgttaaggggaaagttttcacctaataatcagataagaatatttcgaatattttttcctaaatgtttttgcttacttttttgctttctttggactgatttccaagtttaactcgccttatctcttttagacccagctgataaagtaatgtcaccgataatggacagcttcttcccgaattattgtgctactgattgtgatgcaaatgatagtgtaaacattgccatctgtaaccaggcaataccttagttaaaagaggcttacaaactgctgtctttagatttttccaaaccattatggctcatgggccttaataaagaatacaaaacaggactagactttgtgattggcaatatagttaggggacaagaatgtttttcatttagaggttttctttggcccctgtggatatttaatccttttcctatgcgtctaggaaaaatgtgaaggcatgaaagctttattttctccttgtgttaatccttctgccctctgcataatgcagcaccccagaacctgaggctatattgggagaggagagggggaggacaacttagttttctactgattgatttctattaagtccaacatggataattgctgactggttagattttcttgtttctggcttaatcattagcttcttgtttcctagatattctgaaatcttcattgaacataatcacatttttttttatggagttccccctatctttgtttttcctatactgaagaaatggtaactgctccctataactgctcccccaggtgactcttggttgatgctctcttgagcagagtagcttttcttctaacataaggatcatccttggctgtctggttatttaggaaacacacacacacacacacacacacacacacacacacggagggggtgggtgttaaaagtgctgaaatcagagaacttggatctgaatccttaacctttctttgccccaataatctaatctgtaaagtagtacctacccatactgttgttatgaggattaaatgagatagaagtaaagttcttaggatcttgtccaaaacataataagtacaacagtaaatgttgacaagaaggggtggtgataatattgcagaaaatgtggaaaatttagaacacggaagggagaagatatgcctcttaattctgccacctgacataaatgtcacattatcatttctgacctcccagatatttgtgtaagatacactttttcaagaatgtttaatacatttatagctctcttcacttagcaatatattttgaacagtttctccctttaatatttagtatatatgattttctttttttattattaaagattttaatttattttttagagatgaggtctcactatgttgcccaggctggagtccaatagctactcacaggcacaatcatagcacactgcatcctcaaactcgcgggctcaagtgatctgcctgcctctgcctctcaagtagttgagaatacaggcatgcaccactgaggtgggctagttcatgtaattttaaatagctatatagtcttaccttatggttatgccataattttatataaccaaattcttattggacatttccagtttttgatctaatgcttttatatgaaaatccatgaacataaatctttgaccatttctgattatttccttagaataaatccctaggaaggtaattattaagttaaagggtagataccatttttcaggcttttgatacctgttgccaaattattccccagaaaagttgaacaaatctgtctcatcagcagtaatacaatattaataatatttatttatgtatttattttttgagacggagtttcactcttactgcccaggagtgcagtggtgcgatctcagctcactgcaacctccgccacccaggttcaagcagttctcctgcctcagcctcccgagtagctgggattacaggcacgtgccaccacgcccagctaatattttgtatttttagtagagacagggtttcaccatgttggccaggctggtttcaaactcctgacctcaggtgatcccccacaccttggcctcccaaagtgctgggattataggtgtgagctaccgtgcccggctataatatttaatgtatagtgaatgcctaagatgtgctagtttccatgctaagcatttagtatacattgtgtttaatcccctcaaaactgctatgaggaataactcttactatccctattttacagagaagagaactacagtaagatgcagagtaacttgcccagctctgggtattattgttcctttaaatttttgctgacaagatctctcacctggctttaaaaacttagatattctaaaattttgactctattctcttcaatatttgtaaataactttggtttatttggttattctgtactagctgagaggaggaagacttgaactttggttgcctagggttttcctgagaactgtatcttctggttgtggttagttaatcccatgtattttgcacatgccaatatctccataatctaaattcttcagattttcttaagactactatccaccttttagattcacttttggtgtttcctgacattccatttcaattggatacacttatgcctgaccttaaaggaaagggaaaagagaagctagttttttcactcattggatagacatagccagtcttctggcctcaccaaaacagctgagagaatgattggcccaaagccatttggagaacactccattaactagagggagagaacaaggagtattactctctaaattgctgaattaggtttttccacttaatagattatgttaggagcaaacaggttttaggcacaaatattcttctcgatcactgccataacttagaagaagccataagaataaggttaagatttttagaggacttgttgaaccaagctgtataatcagagtgcaattcacggactttttaagactttgtcaaacaaagtctgtatgttatagtactactatagggaaagattggttttaataagtgaaattagaattatacacattaaaacaaggcagtatcacctagtttacttgcaccaccttattttatttatgtatttgctttctaagtttctctacttttatttcatttttgtaagatcttttcaaaagccccacattttttaaacagttaaataaccttttcaagttattagatacatgccttataacaaacaccttctatgctgaaggtagcttttaattttaaaaagtttgagccgggtgcggtggctcacgtctgtaatcccagcactttgggaggccgaggcgggtggatcacgaggtcaggagatcgagaccatcctggctaacacggtgaaaccctgtctctactaaaaatacaaaaaattagctgggcatggtggcagacgcctgtagtcccagctactcgggaggctgagacaggagaatggtgtgaacccaggaggcggagcttgcagtgagctgagatcctgccactgcactccagcctgggcaacagagcgagactccatctcaaaaaaaaaaaaaaaaaaaagtttggctttgagaaatagctgagctgttgattgattattaagtgatataataacaaaaatggtactagcgactgtattgggtggtaagctgataagtgatttttatttatttttattttttgtttgataagtgatttataaaaaattattattcaagccttatgtgatgttagaatatgtatattttaaaaataatcaccttggctgggtgcggtggctcacacctgtaattccagcactttgggaggccaaggcaggcggatcacctgaggtcaggagtttgagaccagcctggccaatgtggcaaaaccccatctctactaaaaatacaaaaattagccaggcgtggtggcacacacctgtagtcccagctacttgggtggctgaggcaggagaatcacttgaacctgggaggcagaggttgcagtgagcagagatcacaccattgcactccagcctgggtgacagagtgagattccgtctcaaaaaaaataaatacaatttaaaaaataaaataatcaactctattaaagctatatatttatcagatgccctttgatgttttaattagcagtgataatttaatttttaaatagtatctcacctgctttcaagaaaggatttgaagtatgtttgatagtcactagtacaaaccgtttgttaaggtaggtatcagaagccttatagaaccatggactacagtaattgtggcaactatttggcataaaacaatttctaaagtttagtgttactttttattttatttatgtatttatttatttatttttttgagatggagtctagctctgtctcccaggctggagtgcagtggcgcgatctcggttcactgcaagctctgtctctcgggttcacgccattctcctgcctcagcctcccgagtagctgggactataagcgcccaccaccacgcccagctaatggctaattttttttttttttttgtatttttagtagagacggggtttcaccatgttagccaggatggtctcgatctcctgacctcaggtgatctgcccacctcggcctcctaaagtgctgggattacaggcgtgagccaccgccccagcctagtgttacatttttttaactgtatcccttggcttcctgacagccagagggataaaggcatatgcaatcgattatgtggtttttattttcataaagttatttagaaacttccaggcaaaaaatcctaagaattttatgggtgagacctctaaatagtgatatcgagtaacatcatggacaatataacaattttgtgggtattttttatattgactgatagttgaggcatttgtaaagggagataagccactgtggtctaagaatgttgttttctggtcttacttgataatgataaagttttttgttttttttttttttgagacagagtctcgctctctcgctctgtctcccaggctggagtgcaatgacttgatctcggttcactgcaagctctgcctcccaggttcacgccattcccctgcctcagcctcccgagtagctgggactacaggcgcccgccaccacacctggctaatttttttgtattttttagtagagacggggtttcaccgtgttagccaggatggtctcgatcacctgacctcgtgatccgcccgcctcggcctcccaaagtgctgggattacaggcgtgagccaccgtgcccagcgataatgataaagttttaaaaacatagcagaatagcttgtcccttatactgtctgatatcaattgtcaaactacatttgttcatttgttctccaacttttaatcaaacatcctgactctggcaagtgaatgtctggagcacagatgatactctgtgttcttgactgaaacaagagccataggcttctgatacatgattggaaatcaatatgcctgcctgactttcattctcctccagggaaatgcatattttggtcaaggagctgatatatggaggatgaatgtgagcagcattaaaattttctgattttttttttttttgagacagtgtctcactctgtcacccaggctggagtgcagtggcatgatcatggctcctaactcctgggctgaagcaatcctcccacctcagtctccccagtagctgcaatcacaggcacttgccaccatgcctaatttttaaattgttttgtagagaggaggtctctttatgttacccaggctggtctcaaactcttgggctcaagcggtcctcctgcctctgcctcccaaccacagacttgtttaacataaaacctaaaagtgactcttttagcttgaaatctctcgaagggcagagctagtagtaaagaaagatctgggccagacatggtggctcacacctgtaatcccagcactttgggaggtcaaggcgggcagatcacgaggtcaagagatcgagaccatcctggccaacatggtgaaaccccatctctactaaaaatacaaaaaattagctgggcgtggtggcgtgcggctgtagttccagctactcgggaggctgaggcaggagaatcacttgaacccgggaggtggaggtcgcagtgagccaagatcgtgccactgcactccagcctggcgacagagcgagactgtctcaaaaaaaaaaaaaaaaaaaaactgaaaacgtcccaaaagtcccttgaaatgaccactgcctgtttgttttgttttgtttggtttgagacggagtcccgctctgtcacccaggctggagtgcagcggcttcatctccccatactgcaacctccgcctcccaggttcaagcgattctcctgcctcagccccctgagtagctgggactacagatgcatgtccccacgcctaatttttgtgttttttggtagagacggggtttcgccatgttgccaaggttggtcttgaaatggggagctcaggcagtctgcctgccttggcctcccaaagtgctgggattacaggcatgagccactgcgtccagtcttaaaaaaggtttatcctaaactagtgcattttcttttttgttctggctgccaggaatctcagcttccttgattttaattggtttctagtttgattttttttcacttgcttttatttttcttgctttacaacataaactaaccccatttgtcttttcttgcttttgagatgagggtcttcctgtgttgtccaggctagacttgaactcctgggctcaagcagtcctcctgcttcagcctcctgagtagctgggattacaggtgtgtgccaccactcccagctccctttcatcttgggttagaaaggaataaataagtaattatctcctatgtcagcttcttctggcaatagaattgcctctgccagttttcatataagtcccttttggagttctccttgaagttttgtttggggagagaagggtgggtaaaagtgatcttgacagaaataggacagtaggtagttcctgaagccacacagaagatagtgcttagagtgagatagaagtatggatcttttatttaataactctattgccttttgatttgaactgaagttttctcttgttcaataggtattgtcagccattctgatctacttgtctatatacacacatacacctctccttcacctagaggattagttggaatataatgttgtttgaggtatcactaaggtgatttttaaaaatttttaaattattttcttttttttttcttaaacctggtgaacaggagaggtgatttttttttcttggtagagacccgagtatgggcactgaaactttcgtggtaaaatatagccctacttcatacttagagtaaattcctatggagttacttagtaattggaccagagtacagttaacacagaatgagggcaaggaccacattttattcaccattgtttccctagcatctagtacagtgatgagcatatgaacatttaatatttactgggtaaattgccagtatggtagaggtggtactgtcttttgttaaagtgtcattatagaacagtagtgattcactccttatgatatttctacttcttttgctatttatggactctgtaacagtaataggtgatgcatcaaattttatgtacatcacatgtacctatatgaaatgagatacaggccacctgctaaaattatggtccggttatttgtaagtactttagactaacatgtgccaaccatttcatgcatctttttcgtgtctgtcacatggtaatattagaaaatattaccatagaaaatggtaatatttgtatagtgcactggagtaaactgaggcagtgaactgcttctggtataaggctccttcagaggatctcctgaagcctaggtgatcaatatccacatgtagctgtaaccattcacagcatactagtagggaagctgttcttagaccttattgtctatagaagtatagtaaagtcatccctcagtatccacaggggattggtcccaagaccaaatctgcagatatgaaatagtgtaatataaatatatatatatatatatatatttttttgatatggagtcttgctctgtcacccaggctagagtgcagaggcacgatctctgctcactgtaatctctgcctcccggttcaagcaatttttctgcctcagcctcctgagtagctgggactacaggtacctgccaccacactcagctaattttttttttttatttttatttgagacggagtctcactctgttgcccaggctggagcgcagtagcgtgatcttggctcaccgcaacctgtgcctcccgggttcaagtgattctcctgcctcaacctcccgagtagctgggactacaggcgtgtgccaccatgcacggctgatttttatactttagtagagatgggttttcactgtgttggccaggctggtcttaaactcctgacctcaggtgatccacccatcttggcctcctaaagtgctgggattacaggtgtgagccaccacaccctgactaatttttttatttttagtagaaacgggtttcaccatgttgactaggctggtcttgaactcctgacctcaggtgatccgcccacctcagcctcccaaagtgctgggattataggcgtgagccatcacgcccggccatatgaaataatctatgcacatgttcccttatactttattgttatttatttattttttgtagagatggggtctcactgtattacccaggctggttttgaactcctgggctcaaatgatcctccttctaccctgccccctgctccccaaagtgctgagccaccatgccaggccctcccatatattttattttattttattttatttttgacacagagtctcactctgttgcccaggctggagtgcagtggtgtgatcttagctcactgcaacctccgcctcctgagttccagcgattctcgtgcctcagcctcctgagtaggtgggactacaggcgcctgccaccatgcccttctaatttttgtatttttagtagagatacatggtttcgccatgttggccaggctggtctcgaactcctgacttcaagtgatccacccaccttggcctgccaaagtgctgggattataggcatgagccactgcgcccagccctgccatatactttaaatcatctctagattacttataatacttaatacaatataaatactacgtaaatagttgttatactgtatttagaaaataatgacaaagaaaaaaatctgtacatgttcaatacaggtgcaattttttctccaaatattttcaatccacacttggttgaatccatagatgtggaacctatggatatggagggctgacagtacagtggtttaaaatctatttcatgttctttctttcctcattgtagtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataaggtaggagcagaattttattttttgagcagaggaagcaggagcacttgccccaaatcacaaataaattccaaaattatcaaatatatatttagggggaattttaaaaatcaccttttcttaggtattaccctatcttcaaaacaatagaaatataattggtttgtataaagcaacacatttgtagtctgtattttattacagtgatacatatataactttcagttagctcactggtatttttaattgtatcagtaagactaagcaccaactcctctggagtactggagtatatttttaaaattacggtagatcctctcaaactgtaagattgggatcctagttgtgacctcttcataaaacttgaagtctgttatatgaatacttgatctgatagatacatagatagatagatagatagataaactatatatatctctcaccttatcctggtatattagaggataaggcatatacataaaactttgcaagtctattgtaattaatgcccaattttacacacaatgcctcgaagaaggtcagatatttttattccaacagagtataaagtaaagggcatgggccgggtgcggtggctcacgcctgcaatcctagcactttgggaggccgaggcgggaggattgcctgagctcaggagttttgagaccagcctgggcaacgctgtgaaactccgtctctactaaaatacaaaagaaattatccaggcgtggcgctgcgcgcctgtagtcccagctactcgggaggcagaggcaggagaattgcttgaacccaggaggcagaggttgcagtgagctgagatcatgccactgcactccagcctgggcgatagagcaagactctgtctctacaaaaaaaaaaaaaaaaaaaaaggcatgcatggactttgctattttacagtgcagcaagtatgttttatttgaggagttcatagttgttggaaagttgacctccagatgagtaagtagtgatgtgatttacaaaggaaactataatatctattctgtgatgtatcttcaaaccttgacatgttaggtgttaaaggtttacatatgtatgtgttgaaagagattttaataaaattattttttaaagtctgcctagtttgaataattgagcattggaaacacttgaataggattgaaaatgtgtacattaagaaaacaaaagttaggaaagcattttctttattgataagtgtatcctgatttggaaaagtgatgttccacttaatatttgttctgaattatgatccacttaaagtcaatggacatgtctccttctatgaatttctgggtaccatagtgcctttaacatagtaggtacacaataaatagtttcttgagtaaatgaattgtttttcaaattggctttttggtttttcttttctttcctcccctccatttagagccgggcgccaatctcagccaagcttgttgcaaatatgctatctgtagcaggtgcagatcatattatcaccatggacctacatgcttctcaaattcaggtatcagtggaagctaaatattggtgtttgaaaggtgggaggaaaggactgatgatgctgaagactgcagagaagccaaaaattatgcccaagtacatctgaaataaactagatatcaacaacattttaaatgtgttcaccttaagcatacttcatgatcttagtcatttcaggtggttagatagggaggcagtctagttttatgggaagagcactactttgaataaaggctctggtatttactagctttgtaagcttgggaaggttacttaatttctctgaacatatactttttcattattgtgagtataaaacattaaattcatattataatgcctggcccatgacaggtactcatagataggagctgttattatcattcttattctccttgaatattcatggagtgcagtggcacgatcttggctcactgcaacctctgcctcctcagttcaagcagttctcctgcctcggcctcccaagtagctgggattacaggcacctgacaccaggcccagctaacttttttgtacttttagttgagatggggtttcaccatgttggccaggctggtctcgaactcctgacctcaagtgatctgcctgctgcagcctcccaaagtgctgcgattacaagcatgagccaccgtgcctggcctcatggtcttaaatttagagccacagatattggagcctactttccaacataaacccaaagtaaggggggtggaataccacctttattttatattttttcaaagagatttttcaaatcattacatttcaagcttgtgggaattcaatgaagtacattggacagggactgtactccttttatggaaaggaatgacttaattgagaaatacaactaatttgtatcaactagaattagaacacagatctcctgatttctaattattcactgtgactatttatcataagtagcttccattaagtttatatgccatagcatctctaactggtttatccattagcttttactccttaacaaatcagtccaacacttagtggcataaagcagtatttacaaactcactgagtctgcatgttgactgggcagttcttaatggttttgtctgaacttagccattctttacaagggctcacttatgttcctatgttcagttgtgggttgactgagggctggctttgctgatcttggctgggctctctcacatagcccagattcaaggaggcttttataatctaccacactgggcctgccttcccatcagtttgaatgttgcagtaagacattctctgagcaagttactactttgtgtttgccatttataaatggaagagaaggaaagtgaagcaaaactgatccagcttctttctacagggcttttttgatatcccagtagacaatttgtatgcagagccggctgtcctaaagtggataagggagaatatctctgagtggaggaactgcactattgtctcacctgatgctggtggagctaagaggtatggttgaaattagtattgttcccaatgtactgggaaaatctttcagatggttgtgtcacaaagtgaagtttttctatccaagtggcagtttttaagtatttttgaatggatgtaagtagctagcacatgggttgaatatagttttaccctttcctcttttactgtcctcagttactactcggaagacaagacagaaaaggggtcctaaatcatcatattatggatttgactataacttatgagtaacttggtgctacagagctagcaatacagctataaaccttttgggaagggtagaaaatgtggttttctaatgaatagcagctgctattgaaccacatattggtggacaaattcgcttttacactcctcttacaatgctgttggttagatcattttgatccttgggattaaaatattaagcaggaaggaaagtaaagtgtgacatttttatttaaagccaagatcttaacattttaaacaaactgattgccagggattgccagttaacagtgctttgcagctcacatggtgcagactaagagctcttgatttccttagtggattactcgttagtaatgcattcaaaagtgtgacacatgttcttcttgttgtggaaatagaatgaagagctacaaaacacagatgattaggaagagctaattcagaactttctaaaagccattcaaatcttcaatgactgtttctcaacaacctcttttatttcagtaacttcaacagaactgataagctgagaacttgagttatgttatccagccagatatatgggttggtgagtcccatgtaattgctagttaccatctgtaatgctagagacagcctaagaaacatccccccaactagtagttgtcatatttaatttgtcggtcattattttaatatctttctgtgggacttagaaaatagtcacatttgaaataggcaggattttctttccaaaggtgggtataggaaaactgcctttagtagacaacttattgctacctgatttttttttcattatcattgtcttatagtgatggagtattttacaattgagtgtctatcacttctgtgttggcagggtttggggagtaggtagagatccctgtgtgatattcatttgtacagtagttctctcctcaaaaggtgtagagagttactttttctagccctttttatgctttgttggtcactgaatttgttggcctttgagtatggttggtttgggatacttgaactaattgatcatgcatttgccttgggtaagtaatcattccaagcgaattggttaccactgatgttatgtgcttatgcagtagtagtaatggagagtacagggtatggttggtttagatcaaggtacaaatgttacctagattatggttcaaaccttattatgtggtcacaggttctcacttatccagcaaaaactcatgtgaccatagtcacaagagaaacaggacaaaatgctatagtttgttcagttctacattaaaaaacaggacaaatccccaagcacgggctgcttcacacatgacggagatggcacagcggagcatggacagacgtgccactggggcagctcactgtcatttacactgaatagatttttgtttgaattatgtggtactttgtcaaaagacaaatttgtcttctatcctaccttctagtctggtttattttctcttgtaataagaaaaataagaattctctttgattggaagatactttggaccgaatggtgagatgcctagcttgtctgggtaattgatataactttctgtctagcaattgtgaaaaaaactcccaagcttggtgtccaggtacagttgacagtgacagttgatggatgttttgccaacagcactgagggaagtgatgaggacacaggcattggaacaggctggatgctgctcctctcctgccagtcaggttctcttctcaccacatccccattcacgggtcttccatgatgggaattgggacagtctgtgtactcctggcattagttaattctttcctcattccttctgctgccaatccattaaataaacttgcgtgtcttagcgttatactgcttcccagtactggtgagggtgtctgtcctctacccagaatgaatactcatctaagtttgatcagtacgttcataagcttctgttgagctatggaggcactggtttataaaacccagtttgtgatatttgcctttgagaagtcaatgatagttgctttcattcttccagccctgggaactattggtttcaaggagtattctcctccccaaaacaagcccattctttagtccatttctttttttcttttttttttgttttgagacagagtctcgctctgtcacccaggctggagtgcagtggcgcgatctcagctcactgcaagctccagctcctgggttcacgccattttcctgcctcagcctcccgagtagctgggactacaggcgcccgccaccatgcccagctaattttttgtatttttagtaaagatggggtttcactgtgttagccaggatggtctctatctcctgaccttgtgatccgcccacctcagcctcccaaagtgctgggattacaggcgtgagccaccgcccccggcctctttagtccatttcttttgtcttagaagccacacatacatatgaacacgctctgttttgcagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaagtaagtgtggattgatggggctggtagttagaaggaaaaagctagcaattgctgtctgaatgtcttcagcctgctgattccttttggaaccaaattgaggggataagtaactttgtgagatttttatcacccaaggcttaaattataatacatagaaattgttgagtactcttatttttttttcagattttcttattttttaaatttatattgtactaagctacatataacacaatttgccattttaactattttaagtgtataattccatgacattaactatattcacaatgttagacaaccatcgcctgatcatcaaagttttttgatcaccctgagtatgctacatgcgattgttttttgttttaatgagttaaaataaaaatcctgagcagacaggtgtgtgtgctcatatttttattttacctaagccggaacccttggtcttacttctcgactgttttaccggctgctacttttgttcattattacttctttttttcactctaatcctgtgataggttaatgtttatattacttgtcatctcttgcctgcagtgttctaaattgcctccccactctgttctccattgccagtcaccgttctctcacctccccactccatctctccatgcttgctaatcttcctgcaactgaggctcgatcccatcactctttaagattttaagtggcccctcattactaacaatccaagccactatgagcagcattgtttcttagaatggtatttttacttttatttttattttgagacatggtctcactctgttacccaggctggagtgtagtagtacaattacggctcactgcagtcttgaaatcttgggctcaagaaatcctcctgtctcagactcccgagtagctgggactacaggcaagtgccaccacacttgggtaattatttattattattattattatttttgtagagaaggagtcccactatgttgcccaggctgtccttgaactcctgggctcaagcaattctcccacctcagcctcccaaagtgctgggatttcagctgtgagccacagcacccagccctgagaatggtttttttaaactttcttgtgtctgtgccttgcacagtgcctggcacataataggtgctaaaaaaaaattggggtgaatgattcttggtttgggatcctggagtaaacattcataaaacccatttcatccttgtacaagtacgggaatactagtcgctataacagatcaactccctaacatgatagtttccttcttgtccatggcacactccaatgcaagtgttcttgttggactcattttttctaagcaatagttaggagctcagattctttcaatctttggtgctatatctttaacatggggtttccaagattaccttggaagacatttcaattttggccagccagaaaaggaaaagaacacagaggatcacccctggaagatttttgttaagtccaaccaaaaactgatgtacattgtgtctgcccacattttaatagccagaattaagccacatggccacactgaactatgtgagggaggctgggaaatgtagttcagctatgtgcccagaaagaagaggaagtggattttgttaagtgcaacagtctatgccagagtcctttgacactaattcagacctattcagataagttcttagtgcagttctttctcgatatggactgaattgtgtcctccccaaattcatatatgttgaggcctaaccccaatgtgatggtatttggagttaccttgaggggcacgtatttaggattagatgaggtcactagggcagagcccttacaatgggatgaatgcccttataagaagagaatgctggagaactggccagcatttccccatgcgcacgcatgcgtgcacacacactcacactcacacacaaagaggtcatctgagcacacagcaaagtggtggccacctacaagagaagaggcctcagcatgacacctactttgtctgcaccttgatcttggactttaagcctccagaactgtgaaaaatttgtttctgttatttaagccacccattctatggtattttcttttccttaaaaaaatttttcccctaacccactgtgccttataatattttttatttttttattttttttcatatgatattttgttgtggaagcctaagcaggctaatatactcctccctgactaaaattctgcaatgacaagtaagatgaatccaaatcaacattttttccctctagacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgaggatgagatttgtgcaaaacaagacttttctaagtgtttaggaggtggttacttacgttgaattaggtctctggattctgaagatatctttctttggtctgaaggatttagtcttgtcatcagaatttgtgatccaaaagttaacaatcacctgtttcttttcctttttttttttcttttcaaactgccaagccttgggaaaatcacctgtttaaaagtttaaattgctacacctcagaatctctggaagatggagcctaagattctacattttaacaggttctcccagtgattctgatgcaaattaaagttttcaagtccatactttacagtatgtgtttgtctgttaactatcggcccctgtagatataatgtgaaacctttaaactgattgtacacttctaccaactttagtgtttctcagtgtgctctggacctaaggttcttattaaaatgtagattcctttgctccatctaagacctataaaaccagaggtcctggaaccagtattttaaagtaattccccaagtaattgttagaaactaaagtttgagtgctcttgcactaaaagaacaaggccttgcttaattaaaaatgttcacattaatctatgagctttttgaaattaatatgtgtaattggaggattatcatcttttttttttttttttttgagataggatcttgctctgttgccccagccggagtgcgcaatcaaagctcactgcagcctcaactttgaaggctcaggcaatcatcctgtctcagcctcccaagtggctggcgtgcaccaccatgcccagctaatttttttgatattatgtgtagagacggggtctccctatgttgcccaggctggtctcaaactcctagcctcaagctatcctcctgtgtcagcctcccaaagtgctgagattacaggtgatgtcattcttaaggattttttttcaacttagtcttttttttttccttcataaggtttttttgtttgtttgttttttgtttttgagatggagttttgctcttgttgcctaggctggagtgcaatggcacgatctcagctcaccgcaacctcagcctcccaggttcaagtgagtctcctgcctcagcctcccaagtagctgggattacaggcatgtgccaccacgcctgactaattttttatttttagtagagatggggtttctccatgttgctcaggctggtcttgaactcctgacctcaggtgatccgtccacctcggcctcccaaactgctgggattacaggcatgagccaccacgcccagcctattcagaaggatttttaaatgcgaacctaccaccatttttttttagacagggtctcactctgttgcctaagctggagtgcagtggcctgatcttgactcactgcagcctcaaactcccaggctcaagcgatcctcctgccttagcctcacaagtagctgggactacaggcatacaccacaaccacgcctggctaatttttgttttattgtagagacagagtttcaccatattgcccaggctggactcaaactcctgggctcaagtgatcctcccaccttggcctcccaaagtgctgggattacaggtgtgagccacagtgcccagccattttgatgaaccaaagtcagcgttttttctcagttagcattttgactctttcctaagtggctgttttgttttgttttgttgttttgagacagagtctcgctctgtcacccaggctggagtgcagtggcacgatcttggctcaccgcaacctccacctcccaggttcaagcaattctcatgcctcagcctcccgagtagctgggattacaggcgtgtgccacaccatgcttggttaatttttgtatttttagtagagacggggtttcatcatgttggccagcctggtctccaactcctggcctcaagtgatctgcccaccttggcctcccaaagtgcagggattaacaggtgtgagccaccgtgcccagccgtaagtggctatcttaaaaatgttatgaagaatagctgagtgcagcctcatgacagggaaacagcacagtgttgcagttttaagaggaagggcacttgcctggctgctcatcagtgtctgcaaattggccagtcatctctgaccatatgatagtaacctgatttcctttcttgcctttctaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtgatt

SEQ ID NO: 36986 - DNA, 20623 bp, Homo sapiens
agaaggtagcagacagacagacggatctaacctctcttggatcctccagccatgaggctgctctgggggctgatctgggcatccagcttcttcaccttatctctgcagaagcccaggtcctggaggcgggatgctgggtgcttggattggggcagggctggcatcgggacccgattcaggagtgagggagagcaggggtggaggtgtcagagcgaagtctgactgctgatcctgtctgttctccccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtaaccagaccccatgccctcctgctgcttgtgggggcctcctgccctgttcccatctgtcttgtaagtgtcatcatcttcccactggcctcctcccctcctgtcttcccaccctggcattctccttccacgtttctcccttggtctctgtcctttttggtcagctgtctcttgctctgtgacccgctccctctccctctccctctcctgacaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcggggtgagtctcagccccagggcctcaacctttaaccccctccgagccctctcaggatgagtttggtgccccctaagtgagataacctgaaagaaagtgccacacagaaggggtgcttaggaaacatttgtcccctgctccctctgtggagtttgacccaccctccccttgcacatggacccctgctcacctctctcctcctccactcccagttcggtaccgggtctttgctctggatcagaagatgcgcccgagcactgacaccatcacagtcatggtggaggtgagtccccgacctctggccttcctgatcctggccactgatgtgacctcctgcctgtgagcacttctccccttgcagaactctcacggcctccgcgtgcggaagaaggaggtgtacatgccctcgtccatcttccaggatgactttgtgatcccagacatctcagagtgagcgctcccaatgtgggggctgcccccaagctacaccaccccaattcctgttaggctctccacctcccacacagaggcacgtccccagatgccctgaccctcagcctcctgagcctctggttaacccccacagtcctcttcccagggaagcaggctgctggctctccgtgccccactgtacagatgggctgagccccttccttgtccattctcaggccagggacctggaagatctcagcccgattctcagatggcctggaatccaacagcagcacccagtttgaggtgaagaaatatggtgagagctggaaactggagggacaggcagctgctttcctgaaggaaataagggtggaaggagaggtactgggagcagctcagggcagggagatatgggtgccacagccctgagcagaggggagtctttgagctggagtctgacctgcctatcccttcaccctgggtcagtccttcccaactttgaggtgaagatcacccctggaaagccctacatcctgacggtgccaggccatcttgatgaaatgcagttagacatccaggccaggtaatacctccctccccacctctgcccaccagcaccgggtcctgctccctactcagtatgaatgggctcctgcttccctgccctcgggccattattccccccagcccttggcccaccctcttctctctgccacgacaggtacatctatgggaagccagtgcagggggtggcatatgtgcgctttgggctcctagatgaggatggtaagaagactttctttcgggggctggagagtcagaccaaggtaggaaggagaataggggctggggaggggaaggggcaagggaggtgaggtgggagactcagtctcaccctatgtcctgtttctttctatgccccagctggtgaatggacagagccacatttccctctcaaaggcagagttccaggacgccctggagaagctgaatatgggcattactgacctccaggggctgcgcctctacgttgctgcagccatcattgagtctccaggtgggtgactttcccttattgtaaccccagacccttgcctctgacctctgagctaaccctctgtcctccggcaccaacaccaccccacttctcacatctcatctcagactcaaaaccaggaaacacccaggagacctggtttctctccaactctgtctctgtgactcggcccttttccctggctgagtttatttatttctttgctcgttctgctcattccttcactcctccagtggacatgtgttgttcaatgccccgtgctaggcctcagcatgcacagacatgttggggaccagcctcaacgccacccgtagggttcctgaagtccattggtgacacaggaatgagaagagacaggttaagagttcataaagagtgggggccagggggccaattgcaaaatggaggctgcaaaaggctcagagctctggtctccacactattttttgagtacagtcactcagatctaagaagcagatgttcagggagaaacagtgaaagggaggcagtgggtcataggcgtaatctatagcaatagagttttaaatgaatctcctttgtgctcaaacagcatgtctttaaattatcggagagtagctggtggaagtgggcttagctagaagactgcatgtctgtccaatgcttcaaaggagggtctttctccttgaacagagtgtttacagataagacagggggtctcactctgagcatgggaacatgatggcaattaggaggcttttcttctcagaggcctcttgtggctttccacaacttattgtctcatatttttatggacagtttatacaggcaccccacaagtccttttcccaacatgcccccctccctttttttttttttaaccgctattgctattatggcttatttgtggtgtttggtctgttttcagaagtgtcttttgcatctgtagactaaaagtaaacagcataaacagatacacattaaagtaaaatttgtaatagttgatcctttaatggtcttaatctgtttaagaggatttatgtttgaaagtccgtcagtagctccaatgagaatgtcagtctcaggcaggagggttaaatgagcctgagatgctttaaaaacctgtttttttaaaatttggttatatttaatgttaaatttttatttttttcttttagatgatgtctaactttttaaaaatgatgtttagtagtattatacgaatggggagttatgtagaaattggaagtatttcaattacattgtacttctaattgatgttttaagtttattgtacgatcttccatttaaataacagtctgtctaagatcatttgtttgatttgtcaattgttggtctatttgggtctgagaattccacaattttgaggaattttttgttaactatttatatattttgtagtttgaacagaggagtgtaaagcaattccagcagccgcagcagtagctgtgactgcaataaggcccataagactgttataagggtaaaaataaatctctttgttttggtaaacacttttttttaaaacatttttgtgacaatatgaatggaaggagaggctttctaaggtctattgagggaaaccagtatccaaactcctttcttagtttttatcagtaacacagatgtttttacaccgaacgtggaattaatacaggtgaaaaggtgacagttttgacaagtaatagtttgagaattaggtcgaatgtcaatatttttgaccattaacataaaaggagggttgacacaactctgaatgggcactgttttgttggaagaaaactgatacgcaaattgaagtttttaaccttttttttttaaagataatatatttttttctaaacttaaatatgagattgggccattattaactttcataatttggagtgtttagggcctattattggattaattattttgggatgtgggccagctgtactaaaattggtccaaattatgggaaaatgagcacgtttttcagtgtaagtagtgttacctttttgatagtatagtttctgttttagttttgtcttgtatttattattttgatgggtacaattaactgtaaaggtcccctcaggggaccaattaatgacaatttcataggaattattttgtagtaccatagtgtgatcagagatgtaattttttttaattaatatttttaaattatttgaccattgttaaggttgttggcacctcttttttgggggcttaaactgttaattgaattgaactctgtgaatgatccgggctccatccagaaaataaatgataggatactggtctttgattatgacctggaattttaactagtcaatgttgtcggtagccttttaggcaaccgatagttggccttatgtaaagaggggggaactgataacctatggacacatttattaacttttttttttttcctttgggtgagagggcccatgagtatttgtaggcttagggatccaaacgctattattaacataaacttcaactgggggttttaaccatgtgacaggcctaattaaaggcaggaatgggacacatgcccaataggtataattttgggctgttgtagccacaggtttgttaggcgaggaggtcactgtttttattttggctttgtattctaggattagtaaataacagaagacaaacatgagtataattagtaacttttttttttagtaaaagagtgacctgtagtgttacttggcatcttagtttactatatgttattaatgaggaaccccactgggggtatgttaatttattctagctaagcagttatgttattagaagctgagaagggggtgtttgttaaagtaacagggcagaagaaaggcggatttaagatacgagcttaatacagtgtagcaggtataggtagtaggcaaagtgagagaattaaaaatgaataaattatttggcttagacttttgtttttttagtataatgtctgaggcctgtgttgtttgtggaagtcgcattgttgaggctgtagttcctgtagggtcttttttaggctggttcaaatgtttttttattttttaattttttatcctttgatgaggatgtagtctttaggctggtactggaaattttaggagtggcgtctgtgttaagagactttttacaatttttaaagagcaggttagtgttttaagaaaaacttgtgttttattttaatgtttagtttatagaaaactggatgatatctttttaactttagtaaatacgtttacacacggaattttttacaattatcattttaaaacttgtttagatctttaaaacaaaattaaacaaccttttttgtataaattttttataactttttttatgacttttacagacaatttttaacatgtcttaactttttatgttttataatttttttactaaaggtacatttttataactttttaaatttttttacttttttgtatttttttgatttttgtcttagtcttttttttacttttatttttttaaatgtgtaataattagatgagtgttggtaacaatggatgtatgtacatattttagtttttaaaatttagggatgtgtttaacatctgtttgccagaactgactaggttccaattctttacggttaacacctattgaaggagggtatgtgcctgtgagctggtaatctgggcattgtgggataatttgtttagccagcctctgtgtaagttgaaattatttagataagtttctccaattttggtggaataatcgatgtgattgggtggcttggtcaagcagtgatgtcataacctgaaggtctgcttgattattgccgtaagccaatgggccaggcagagagctgtgggctcgaatgtgtgtaataaaagtaggatgtgtaccttggtctagtaattgttgaagttgaagaaaaagaccacacagagtgggctccagagcaaacttaaggctgtaatagtttttaaataaatacacagaataaccttagctctctgaatgttagtaaattcagatcaagtgattggattatgtggtctccaccagactgttgctttttcatgtttaccagacccaccagtaaaaacagctatggctccttccaaaggggcatcacaagtaatttttggaagaacctatgtagttaattttaagaattgaaaagtttttaggataatgattattaatacatccaacaaattttgttaaattaatctgtcatgtaactgagttaataaatgcctgtttaacctgatttttatttattggaactataatttttattgggctcagtgccacaaaatttaataattcatatatgagcctgtccaattagaattgccatctgatttaagtatactgtaagtgcttttatggtattatgtggcaaaaaggaccatttaactaaatcatcattttgaacaataacccccattattgtgtggttagtgtgaagtagggaacacaatgaattataaaggcaagtctgagtcaatcctactgacctgggcttgctgaattttgttttcaattactgataactctttcatggcctcgggtgttagttctctgttactgcgtaagttggtatttcccctcaatattgagaagagattagacatagcataagtaggaattgctaaattgggccaaatccaattaatatcttctaacaatttttgaaaattatttaaggttttgaaagaatctcttctaatttgaaccttttgaggcttaatggctctatcctgtacttgtattttcaaatactgaaaaggagtggttgtttgaattttgtcaggtgctataagtaattcagcatttgtaattgtcttttgcaaagattaataatattgaataagttggtctctactttttgctgcacaaatctggaaactgatctctaacaggctggatagttctgcctacaaaagtttgacaaactgtgggactatttaacataccctggggcaaaactttccaatgatatttggctgcaggttttttgttattaacggcaggaatggtaaaggcaaattttttgaaatctgcctctgctaaaggaattgtaaaaaagcagtcttttaaatctataataacaagcggtcagtctttagggagcacagtgggggatgggagcccaggttgtaaggctcccatcggttgaattacagcgttgacgccatctaccggactttttcttaattacaaatactggggaattccaaggagagaaagtgggtgaaatatatcctttttttagtagtttattttataaagcacccccaacttttccttagggagcggccactgttcaacccagacggggcgccgggtcatccattttaagggaaattgctccttcactgtaataactgtagggtgaacctgaattgccccatctccataatgaactgtgggtcgggcaataatgggcacggtgagccaagtctcgggctccctccccctgcacccactcggctgaggaggaggtggccattctggacatttctctacaggaaccgtgggctgaacaattttttgagtaggtttagggagactggggagattggcataaatcatcttcagactctcctttttgttagtactcggtagaggtggttcagagttctgattatcaaactcctctctctcctcctctgactcagcctcattatctgtctgaaaaggctccagtgctgcatgcaccaatgaccaaagcgaccaaacaggcaaaggaatttcctttccttctctatatgctcttttaaggtcctttccaactccttcttaatgttttaatttcaaagtttcctgttttgggaaccaagggcaaaattgttccatagcatgaaacaaatccataagattttccgtatcaacttttaccccaccatgcatgcttgaagagctgccgtaggaagctcaaatacgtggtgtacttactttcagtttttcccattgtgtccctagctttctctgggcgccccgcttacctgtagaggttaaaacttttatgtccttgggagtcctttgttcgttggtcctctgtttcacatgcttgagcgtttcctcaccagattcttttgggccccacgttgggcgccagaatgttggggaccagcctcaacaccacctgtagggtacctgaagtctggtggtgacaaaggaatgagaagagacaggttaagagttcataaagagtggaggccagggggccaattgcaaaatggaggctgcaaaaggctcagagctctggtctccacactatttattgagtacaataacttagatctaagaagcagatgttcagggcaaaacagtgaaagggtagcagtgcgtcacaggcataatctacagcagaagcgctttaaatgaatctcctttgtgctcaaacagcatatctttaacttatcggagagtagctagtgggagtgggcttaactaggagcctgcacgtctgtccacattccaatgcttcaaaggagggtctttctccttgaatacagtgtttacagataagagagagcaggtctcgctctgagcatggcaattaggaggcttttctcctcagaggcctcttgtggctttccacaacttattgtcccatatttttatggccagtttatacaggcaccccacaagtccttttcccaacacagacaggaatacggcagcctgtgccctgggagctcactgtcttgtgggagggaaccactcaagccactccccacttgtcctcctgtccctctcttcttgggctctgtcccccacctctctctgtcctttgtcttgcaggtggggagatggaggaggcagagctcacatcctggtattttgtgtcatctcccttctccttggatcttagcaagaccaagcgacaccttgtgcctggggcccccttcctgctgcaggtttcttccagaggggaaggatgagtagggaggatgtggtagttaggagggctcagggtctgaccactctcttttgcctgccctcctttacctgcctaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtaggactcctcggacccctgggagatggtgggggaaggggaggagggtgagctggggtcccaaggatccatggcctgacttggggggaaggtggggtacttggctctgagctactaccctattcgcacctgaccccctctccaggtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatggtgtgcatgagctggggagtcacggagggctggggtgcagggaagagccctctgggtggggctgggggggttcaaggctgaggctgtcccatgaagaggcaaccactcttgtccctcccattcttggcccagatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaaggtgaccggggtcaggagagatggcacttgtgccgagggggttgaggacagggtgattgccaacagggcatggatttagcttgggggcagtgaggataccgggactgaaggaagctctcccactctgaccgcccccacctgccgcccctgccagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtttgtccagaccctctccacagctctctcacccctccatggctcatccccctgcttccctgagccttgggcgcagcccctggatcccactgaggctccccacagtctcttccccacttggccctgtggtctccatctcctggctctgtatcctttcctatccccccatgtgctgccctctcacctgtgccgagtgctcagtcctgcccctcagccacacttggctcctagcattcctgcctttcttgcaggtctttgaagctatgaacagctatgacctcggctgtggtcctgggggtggggacagtgcccttcaggtgttccaggcagcgggcctggccttttctgatggagaccagtggaccttatccagaaagagtgagaacagagaaggaaggggagtgggtggcgggaagataaggaaggaggaagggcctgaggggaccagctggaagagtccgggcaggaagggctgggcaggggaaggggaggaggggaggaggccgagtgcctgacggctggactgcagcctttctctctaccaggactaagctgtcccaaggagaagacaacccggaaaaagagaaacgtgaacttccaaaaggcgattaatgagaaatgtgagttgcgggtgcctaggcagtagcttgggctctccacctgggatccgggttgggggtctgcctctctgcccctcggctccttgctgaacccacgtgtggtatttggggccagagatccgaattccgggattacgagtggaaggtgggcagctctctccagcagcctctcttatgttgctggtctcaaggggtcggggcgggggctgaggtgtatgtcctttttgtcctctcatgctcacccccacctggccctgcagtgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgaggtgaggggctgggtggggctagggcacaggtggcggcgcttggaaaggcagaacggtcccctcctcactcccgtccaccgtggtcccccagccctggagatcctgcaggaggaggacctgattgatgaggatgacattcccgtgcgcagcttcttcccagagaactggctctggagagtggaaacagtggaccgctttcaaatgtgagagtgtgtgccggcccggccttttctctgtgctgtgtctcggggccagccggggtagacgggccttctctgcctttccctacacagattgacactgtggctccccgactctctgaccacgtgggagatccatggcctgagcctgtccaaaaccaaaggtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccatgggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccaccgctgtgtctctgaaggtggtggctcgagggtccttcgaattccctgtgggagatgcggtgtccaaggttctgcagattgaggtgaatggagcacccctgaatataagtccccgggcccccagctttgtcctccaccctcagcactctctctgctggccaggccaggggcccaacacccaaaccaatgccttggtctgttcccatcttctacaattctgatccaactctgtccctggagttgaaactcaaagttctgggggagtctgcgctagcagggcaggctgtagtcctgtgtgacctcacaaccatgttttccctgagacagaaggaaggggccatccatagagaggagctggtctatgaactcaaccccttgggtgagtgaccctctacctccagccattggtttcctaagtgggtacaggtggtgggggatgtggacagcaggacaggctgccaacttcccccatttccccagaccaccgaggccggaccttggaaatacctggcaactctgatcccaatatgatccctgatggggactttaacagctacgtcagggttacaggtgggagtgccctttagtcccttcccagtggccaccttcggattcatgtgggacttgtggatccctgcttggtcccactccccgtgagcctctgacacagagtcctcagacctccaccctctccctcccatgtagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggttctgggtgcaagggcaagcaggaggggggccaggaaaggacagttactggaagatggacagcccaggaggctacagagggaaagaaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacggggcagcagcacctggtgagcttgggagagtggttccagggttctgagggggtcagggctggggcaggggtgggacagagctggtatgatgggagggtggataaccaggcacctgggggcgtgggcataatgagaagcaagtccttatccccaaccctcctttcctgccctccaggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggtgcgggcatgctggggctggcccgagaagcgcctgtcggaggactctctttgccccttccccctcctgtttgacatcttttctccccttactaggggggtttggtgggcaatgatgagactgtggcactcacagcctttgtgaccatcgcccttcatcatgggctggccgtcttccaggatgagggtgcagagccattgaagcagagagtggtaagttcagtggcgtttctgccctctgctggcccccagctctctccctttttcctcaggaacccaggggtccaggcccaagaccctcctcccgttttcttccaggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggaggtgaggggtgaggggctctggcagtgagcctgaggcccaggggaccttaggatccctgagtgtgcccagagggagaggctggatgaagactcagaggaggaatgaagttataagcaggggtgggttgggggagactcaggagagcccagcagggggtggctaagggccaggggaccaggctcttctccctgccttcctgtttactcgtggtctcccttcactttcagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagtaggggccgtccccgggctctggcgggggtgggtagtcctcagaccaagggcttgcttgagtcctggctcaacctccctaggacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaccctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagagggggtggggctgttttgaggaaggagataagttattggagccgcaaaaacaggtttgcttgtgcccttctaacatcgccttcccttttctgttgctgaagttttccttgggcagcaagatcaatgtgaaggtgggaggaaacagcaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtctcgcctgacgcctgtggcgaatgtggtgccactcgtgtgtgtggactgtgcagtgacggggaggaaaaggggctgaaggcctcaaatcctgtagcccagggagatgcccttaggtatggcaccagagaggtctgtggcctcacatgtcccacgtcctctccctgccccttgctgagccaggtccttcgtacctacaatgtcctggacatgaagaacacgacctgccaggacctacagatagaagtgacagtcaaaggccacgtcgagtacacgagtgagtgtgggggttgggaggccttggggccaggcaggggctggcgcagggagccgggtggccatcccagccctcctcacaatgcttccctgtgcagtggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtctccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggccgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 36987 - DNA, 20624 bp, Homo sapiens
agaaggtagcagacagacagacggatctaacctctcttggatcctccagccatgaggctgctctgggggctgatctgggcatccagcttcttcaccttatctctgcagaagcccaggtcctggaggcgggatgctgggtgcttggattggggcagggctggcatcgggacccgattcaggagtgagggagagcaggggtggaggtgtcagagcgaagtctgactgctgatcctgtctgttctccccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtaaccagaccccatgccctcctgctgcttgtgggggcctcctgccctgttcccatctgtcttgtaagtgtcatcatcttcccactggcctcctcccctcctgtcttcccaccctggcattctccttccacgtttctcccttggtctctgtcctttttggtcagctgtctcttgctctgtgacccgctccctctccctctccctctcctgacaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcggggtgagtctcagccccagggcctcaacctttaaccccctccgagccctctcaggatgagtttggtgccccctaagtgagataacctgaaagaaagtgccacacagaaggggtgcttaggaaacatttgtcccctgctccctctgtggagtttgacccaccctccccttgcacatggacccctgctcacctctctcctcctccactcccagttcggtaccgggtctttgctctggatcagaagatgcgcccgagcactgacaccatcacagtcatggtggaggtgagtccccgacctctggccttcctgatcctggccactgatgtgacctcctgcctgtgagcacttctccccttgcagaactctcacggcctccgcgtgcggaagaaggaggtgtacatgccctcgtccatcttccaggatgactttgtgatcccagacatctcagagtgagcgctcccaatgtgggggctgcccccaagctacaccaccccaattcctgttaggctctccacctcccacacagaggcacgtccccagatgccctgaccctcagcctcctgagcctctggttaacccccacagtcctcttcccagggaagcaggctgctggctctccgtgccccactgtacagatgggctgagccccttccttgtccattctcaggccagggacctggaagatctcagcccgattctcagatggcctggaatccaacagcagcacccagtttgaggtgaagaaatatggtgagagctggaaactggagggacaggcagctgctttcctgaaggaaataagggtggaaggagaggtactgggagcagctcagggcagggagatatgggtgccacagccctgagcagaggggagtctttgagctggagtctgacctgcctatcccttcaccctgggtcagtccttcccaactttgaggtgaagatcacccctggaaagccctacatcctgacggtgccaggccatcttgatgaaatgcagttagacatccaggccaggtaatacctccctccccacctctgcccaccagcaccgggtcctgctccctactcagtatgaatgggctcctgcttccctgccctcgggccattattccccccagcccttggcccaccctcttctctctgccacgacaggtacatctatgggaagccagtgcagggggtggcatatgtgcgctttgggctcctagatgaggatggtaagaagactttctttcgggggctggagagtcagaccaaggtaggaaggagaataggggctggggaggggaaggggcaagggaggtgaggtgggagactcagtctcaccctatgtcctgtttctttctatgccccagctggtgaatggacagagccacatttccctctcaaaggcagagttccaggacgccctggagaagctgaatatgggcattactgacctccaggggctgcgcctctacgttgctgcagccatcattgagtctccaggtgggtgactttcccttattgtaaccccagacccttgcctctgacctctgagctaaccctctgtcctccggcaccaacaccaccccacttctcacatctcatctcagactcaaaaccaggaaacacccaggagacctggtttctctccaactctgtctctgtgactcggcccttttccctggctgagtttatttatttctttgctcgttctgctcattccttcactcctccagtggacatgtgttgttcaatgccccgtgctaggcctcagcatgcacagacatgttggggaccagcctcaacgccacccgtagggttcctgaagtccattggtgacacaggaatgagaagagacaggttaagagttcataaagagtgggggccagggggccaattgcaaaatggaggctgcaaaaggctcagagctctggtctccacactattttttgagtacagtcactcagatctaagaagcagatgttcagggagaaacagtgaaagggaggcagtgggtcataggcgtaatctatagcaatagagttttaaatgaatctcctttgtgctcaaacagcatgtctttaaattatcggagagtagctggtggaagtgggcttagctagaagactgcatgtctgtccaatgcttcaaaggagggtctttctccttgaacagagtgtttacagataagacagggggtctcactctgagcatgggaacatgatggcaattaggaggcttttcttctcagaggcctcttgtggctttccacaacttattgtctcatatttttatggacagtttatacaggcaccccacaagtccttttcccaacatgcccccctccctttttttttttttaaccgctattgctattatggcttatttgtggtgtttggtctgttttcagaagtgtcttttgcatctgtagactaaaagtaaacagcataaacagatacacattaaagtaaaatttgtaatagttgatcctttaatggtcttaatctgtttaagaggatttatgtttgaaagtccgtcagtagctccaatgagaatgtcagtctcaggcaggagggttaaatgagcctgagatgctttaaaaacctgtttttttaaaatttggttatatttaatgttaaatttttatttttttcttttagatgatgtctaactttttaaaaatgatgtttagtagtattatacgaatggggagttatgtagaaattggaagtatttcaattacattgtacttctaattgatgttttaagtttattgtacgatcttccatttaaataacagtctgtctaagatcatttgtttgatttgtcaattgttggtctatttgggtctgagaattccacaattttgaggaattttttgttaactatttatatattttgtagtttgaacagaggagtgtaaagcaattccagcagccgcagcagtagctgtgactgcaataaggcccataagactgttataagggtaaaaataaatctctttgttttggtaaacacttttttttaaaacatttttgtgacaatatgaatggaaggagaggctttctaaggtctattgagggaaaccagtatccaaactcctttcttagtttttatcagtaacacagatgtttttacaccgaacgtggaattaatacaggtgaaaaggtgacagttttgacaagtaatagtttgagaattaggtcgaatgtcaatatttttgaccattaacataaaaggagggttgacacaactctgaatgggcactgttttgttggaagaaaactgatacgcaaattgaagtttttaaccttttttttttaaagataatatatttttttctaaacttaaatatgagattgggccattattaactttcataatttggagtgtttagggcctattattggattaattattttgggatgtgggccagctgtactaaaattggtccaaattatgggaaaatgagcacgtttttcagtgtaagtagtgttacctttttgatagtatagtttctgttttagttttgtcttgtatttattattttgatgggtacaattaactgtaaaggtcccctcaggggaccaattaatgacaatttcataggaattattttgtagtaccatagtgtgatcagagatgtaattttttttaattaatatttttaaattatttgaccattgttaaggttgttggcacctcttttttgggggcttaaactgttaattgaattgaactctgtgaatgatccgggctccatccagaaaataaatgataggatactggtctttgattatgacctggaattttaactagtcaatgttgtcggtagccttttaggcaaccgatagttggccttatgtaaagaggggggaactgataacctatggacacatttattaacttttttttttttcctttgggtgagagggcccatgagtatttgtaggcttagggatccaaacgctattattaacataaacttcaactgggggttttaaccatgtgacaggcctaattaaaggcaggaatgggacacatgcccaataggtataattttgggctgttgtagccacaggtttgttaggcgaggaggtcactgtttttattttggctttgtattctaggattagtaaataacagaagacaaacatgagtataattagtaacttttttttttagtaaaagagtgacctgtagtgttacttggcatcttagtttactatatgttattaatgaggaaccccactgggggtatgttaatttattctagctaagcagttatgttattagaagctgagaagggggtgtttgttaaagtaacagggcagaagaaaggcggatttaagatacgagcttaatacagtgtagcaggtataggtagtaggcaaagtgagagaattaaaaatgaataaattatttggcttagacttttgtttttttagtataatgtctgaggcctgtgttgtttgtggaagtcgcattgttgaggctgtagttcctgtagggtcttttttaggctggttcaaatgtttttttattttttaattttttatcctttgatgaggatgtagtctttaggctggtactggaaattttaggagtggcgtctgtgttaagagactttttacaatttttaaagagcaggttagtgttttaagaaaaacttgtgttttattttaatgtttagtttatagaaaactggatgatatctttttaactttagtaaatacgtttacacacggaattttttacaattatcattttaaaacttgtttagatctttaaaacaaaattaaacaaccttttttgtataaattttttataactttttttatgacttttacagacaatttttaacatgtcttaactttttatgttttataatttttttactaaaggtacatttttataactttttaaatttttttacttttttgtatttttttgatttttgtcttagtcttttttttacttttatttttttaaatgtgtaataattagatgagtgttggtaacaatggatgtatgtacatattttagtttttaaaatttagggatgtgtttaacatctgtttgccagaactgactaggttccaattctttacggttaacacctattgaaggagggtatgtgcctgtgagctggtaatctgggcattgtgggataatttgtttagccagcctctgtgtaagttgaaattatttagataagtttctccaattttggtggaataatcgatgtgattgggtggcttggtcaagcagtgatgtcataacctgaaggtctgcttgattattgccgtaagccaatgggccaggcagagagctgtgggctcgaatgtgtgtaataaaagtaggatgtgtaccttggtctagtaattgttgaagttgaagaaaaagaccacacagagtgggctccagagcaaacttaaggctgtaatagtttttaaataaatacacagaataaccttagctctctgaatgttagtaaattcagatcaagtgattggattatgtggtctccaccagactgttgctttttcatgtttaccagacccaccagtaaaaacagctatggctccttccaaaggggcatcacaagtaatttttggaagaacctatgtagttaattttaagaattgaaaagtttttaggataatgattattaatacatccaacaaattttgttaaattaatctgtcatgtaactgagttaataaatgcctgtttaacctgatttttatttattggaactataatttttattgggctcagtgccacaaaatttaataattcatatatgagcctgtccaattagaattgccatctgatttaagtatactgtaagtgcttttatggtattatgtggcaaaaaggaccatttaactaaatcatcattttgaacaataacccccattattgtgtggttagtgtgaagtagggaacacaatgaattataaaggcaagtctgagtcaatcctactgacctgggcttgctgaattttgttttcaattactgataactctttcatggcctcgggtgttagttctctgttactgcgtaagttggtatttcccctcaatattgagaagagattagacatagcataagtaggaattgctaaattgggccaaatccaattaatatcttctaacaatttttgaaaattatttaaggttttgaaagaatctcttctaatttgaaccttttgaggcttaatggctctatcctgtacttgtattttcaaatactgaaaaggagtggttgtttgaattttgtcaggtgctataagtaattcagcatttgtaattgtcttttgcaaagattaataatattgaataagttggtctctactttttgctgcacaaatctggaaactgatctctaacaggctggatagttctgcctacaaaagtttgacaaactgtgggactatttaacataccctggggcaaaactttccaatgatatttggctgcaggttttttgttattaacggcaggaatggtaaaggcaaattttttgaaatctgcctctgctaaaggaattgtaaaaaagcagtcttttaaatctataataacaagcggtcagtctttagggagcacagtgggggatgggagcccaggttgtaaggctcccatcggttgaattacagcgttgacgccatctaccggactttttcttaattacaaatactggggaattccaaggagagaaagtgggtgaaatatatcctttttttagtagtttattttataaagcacccccaacttttccttagggagcggccactgttcaacccagacggggcgccgggtcatccattttaagggaaattgctccttcactgtaataactgtagggtgaacctgaattgccccatctccataatgaactgtgggtcgggcaataatgggcacggtgagccaagtctcgggctccctccccctgcacccactcggctgaggaggaggtggccattctggacatttctctacaggaaccgtgggctgaacaattttttgagtaggtttagggagactggggagattggcataaatcatcttcagactctcctttttgttagtactcggtagaggtggttcagagttctgattatcaaactcctctctctcctcctctgactcagcctcattatctgtctgaaaaggctccagtgctgcatgcaccaatgaccaaagcgaccaaacaggcaaaggaatttcctttccttctctatatgctcttttaaggtcctttccaactccttcttaatgttttaatttcaaagtttcctgttttgggaaccaagggcaaaattgttccatagcatgaaacaaatccataagattttccgtatcaacttttaccccaccatgcatgcttgaagagctgccgtaggaagctcaaatacgtggtgtacttactttcagtttttcccattgtgtccctagctttctctgggcgccccgcttacctgtagaggttaaaacttttatgtccttgggagtcctttgttcgttggtcctctgtttcacatgcttgagcgtttcctcaccagattcttttgggccccacgttgggcgccagaatgttggggaccagcctcaacaccacctgtagggtacctgaagtctggtggtgacaaaggaatgagaagagacaggttaagagttcataaagagtggaggccagggggccaattgcaaaatggaggctgcaaaaggctcagagctctggtctccacactatttattgagtacaataacttagatctaagaagcagatgttcagggcaaaacagtgaaagggtagcagtgcgtcacaggcataatctacagcagaagcgctttaaatgaatctcctttgtgctcaaacagcatatctttaacttatcggagagtagctagtgggagtgggcttaactaggagcctgcacgtctgtccacattccaatgcttcaaaggagggtctttctccttgaatacagtgtttacagataagagagagcaggtctcgctctgagcatggcaattaggaggcttttctcctcagaggcctcttgtggctttccacaacttattgtcccatatttttatggccagtttatacaggcaccccacaagtccttttcccaacacagacaggaatacggcagcctgtgccctgggagctcactgtcttgtgggagggaaccactcaagccactccccacttgtcctcctgtccctctcttcttgggctctgtcccccacctctctctgtcctttgtcttgcaggtggggagatggaggaggcagagctcacatcctggtattttgtgtcatctcccttctccttggatcttagcaagaccaagcgacaccttgtgcctggggcccccttcctgctgcaggtttcttccagaggggaaggatgagtagggaggatgtggtagttaggagggctcagggtctgaccactctcttttgcctgccctcctttacctgcctaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtaggactcctcggacccctgggagatggtgggggaaggggaggagggtgagctggggtcccaaggatccatggcctgacttggggggaaggtggggtacttggctctgagctactaccctattcgcacctgaccccctctccaggtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatggtgtgcatgagctggggagtcacggagggctggggtgcagggaagagccctctgggtggggctgggggggttcaaggctgaggctgtcccatgaagaggcaaccactcttgtccctcccattcttggcccagatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaaggtgaccggggtcaggagagatggcacttgtgccgagggggttgaggacagggtgattgccaacagggcatggatttagcttgggggcagtgaggataccgggactgaaggaagctctcccactctgaccgcccccacctgccgcccctgccagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtttgtccagaccctctccacagctctctcacccctccatggctcatccccctgcttccctgagccttgggcgcagcccctggatcccactgaggctccccacagtctcttccccacttggccctgtggtctccatctcctggctctgtatcctttcctatccccccatgtgctgccctctcacctgtgccgagtgctcagtcctgcccctcagccacacttggctcctagcattcctgcctttcttgcaggtctttgaagctatgaacagctatgacctcggctgtggtcctgggggtggggacagtgcccttcaggtgttccaggcagcgggcctggccttttctgatggagaccagtggaccttatccagaaagagtgagaacagagaaggaaggggagtgggtggcgggaagataaggaaggaggaagggcctgaggggaccagctggaagagtccgggcaggaagggctgggcaggggaaggggaggaggggaggaggccgagtgcctgacggctggactgcagcctttctctctaccaggactaagctgtcccaaggagaagacaacccggaaaaagagaaacgtgaacttccaaaaggcgattaatgagaaatgtgagttgcgggtgcctaggcagtagcttgggctctccacctgggatccgggttgggggtctgcctctctgcccctcggctccttgctgaacccacgtgtggtatttggggccagagatccgaattccgggattacgagtggaaggtgggcagctctctccagcagcctctcttatgttgctggtctcaaggggtcggggcgggggctgaggtgtatgtcctttttgtcctctcatgctcacccccacctggccctgcagtgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgaggtgaggggctgggtggggctagggcacaggtggcggcgcttggaaaggcagaacggtcccctcctcactcccgtccaccgtggtcccccagccctggagatcctgcaggaggaggacctgattgatgaggatgacattcccgtgcgcagcttcttcccagagaactggctctggagagtggaaacagtggaccgctttcaaatgtgagagtgtgtgccggcccggccttttctctgtgctgtgtctcggggccagccggggtagacgggccttctctgcctttccctacacagattgacactgtggctccccgactctctgaccacgtgggagatccatggcctgagcctgtccaaaaccaaaggtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccataggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgaggtgaatggagcacccctgaatataagtccccgggcccccagctttgtcctccaccctcagcactctctctgctggccaggccaggggcccaacacccaaaccaatgccttggtctgttcccatcttctacaattctgatccaactctgtccctggagttgaaactcaaagttctgggggagtctgcgctagcagggcaggctgtagtcctgtgtgacctcacaaccatgttttccctgagacagaaggaaggggccatccatagagaggagctggtctatgaactcaaccccttgggtgagtgaccctctacctccagccattggtttcctaagtgggtacaggtggtgggggatgtggacagcaggacaggctgccaacttcccccatttccccagaccaccgaggccggaccttggaaatacctggcaactctgatcccaatatgatccctgatggggactttaacagctacgtcagggttacaggtgggagtgccctttagtcccttcccagtggccaccttcggattcatgtgggacttgtggatccctgcttggtcccactccccgtgagcctctgacacagagtcctcagacctccaccctctccctcccatgtagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggttctgggtgcaagggcaagcaggaggggggccaggaaaggacagttactggaagatggacagcccaggaggctacagagggaaagaaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacgggacagcagcacctggtgagcttgggagagtggttccagggttctgagggggtcagggctggggcaggggtgggacagagctggtatgatgggagggtggataaccaggcacctgggggcgtgggcataatgagaagcaagtccttatccccaaccctcctttcctgccctccaggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggtgcgggcatgctggggctggcccgagaagcgcctgtcggaggactctctttgccccttccccctcctgtttgacatcttttctccccttactaggggggtttggtgggcaatgatgagactgtggcactcacagcctttgtgaccatcgcccttcatcatgggctggccgtcttccaggatgagggtgcagagccattgaagcagagagtggtaagttcagtggcgtttctgccctctgctggcccccagctctctccctttttcctcaggaacccaggggtccaggcccaagaccctcctcccgttttcttccaggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggaggtgaggggtgaggcgctcctggcagtgagcctgaggcccaggggaccttaggatccctgagtgtgcccagagggagaggctggatgaagactcagaggaggaatgaagttataagcaggggtgggttgggggagactcaggagagcccagcagggggtggctaagggccaggggaccaggctcttctccctgccttcctgtttactcgtggtctcccttcactttcagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggcttcggcctggctcacccgtcagggcagcttccaagggggattccgcagtacccaagtaggggccgtccccgggctctggcgggggtgggtagtcctcagaccaagggcttgcttgagtcctggctcaacctccctaggacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaccctcccacccgtggaatccccgcagcacttcttcctggggtcttcgggggaagactgacttcctggctgtgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttattggagccgcaaaaacaggtttgcttgtgcccttctaacatcgccttcccttttctgttgctgaagttttccttgggcagcaagatcaatgtgaaggtgggaggaaacagcaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtctcgcctgacgcctgtggcgaatgtggtgccactcgtgtgtgtggactgtgcagtgacggggaggaaaaggggctgaaggcctcaaatcctgtagcccagggagatgcccttaggtatggcaccagagaggtctgtggcctcacatgtcccacgtcctctccctgccccttgctgagccaggtccttcgtacctacaatgtcctggacatgaagaacacgacctgccaggacctacagatagaagtgacagtcaaaggccacgtcgagtacacgagtgagtgtgggggttgggaggccttggggccaggcaggggctggcgcagggagccgggtggccatcccagccctcctcacaatgcttccctgtgcagtggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtctccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggccgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 36988 - DNA, 498224 bp, Homo sapiens
agggctgcagtcacggggcggcgcggagggccccagcccagtcaggggtgtggccgccgccaccgtaaggctaggccgcgagcttagtcctgggagccgcctccgtcgccgccgtcagagccgccctatcaggtgtgtttgcagccgaactggcagtgcccgcgggcggctgggccgaggccttggctcctacccgcgggggtcgggcgggctgaggctggagcaggccaggggcgggggcagagggggacggacttccagcatcgctcattcgggggcgtgacgggaggacctggctggggagcggcgggttgggagcctgtggctgccccttcggtgacagtggagtcaccgagcctagaaatggggaagctgtgacgtgggggtggtggagggtgctgcgggacagcagcgagcacggccctcagccgtccttcccaacacggtttcacttcccctcagctccagggctcagccccaagccgcccccttcatcccccatctgcaaacaatcctggtccccctgagcctccaatatgccttatgcagttcttttggggttcctttcgcattttaccgtgtactttcgcttttgatgcgtctagtttctgctactggactctcctagaatcgaagttccatgagggcaaagtcccatctgacttaggactcagagctactcaataagtaattgaatgagtacctatgccgtagaactgagtgaattaacaaatgagtaagtgaataaatgagtgcatacgagatacagctgaatcaatcagtgcatgagtgaaaataaagatgtatgaagtggaagcagtggagacgcaggcttacaactcctgttttttgatagctttccaaaaagttgtgtgaatgtcgcacttttgcaaatggaggcattctgattgggaccacttaaaaagagttctatgctgttcaaatggtctctggaaacgccccctggtatttccatttttgttggacttggctatatgtgtttgcttaaaacaaaatatgcctaggttttttcttgcttgtgttttgttcacttctactttggacgtttaaagaatcattgtcactataatattatttcatgtatttcttaaagataagggtgactctgaaggcagaaccatatgactctgacttgtttgtaaaaccaggcttttcttttgaattcagagttgttaagaatcttgtctgttttcctgagacaggtgctggctgatttgcaggtgactgaagaaggctacataaggcccagaaagacgcttatctgtttgtaaacaaataggcttagcacatagctttaatacagttggtcactgcagccgttcttacttgccaggtccaggttccagaagagctggatgaccttggacttgccacttgatctctttaggttttaatttcttaatctccaaaatgaagatgtttagctaggaaccctgcctgagttaaacctctgggattcttttgtatcagggttagaaggtgaaattacagatgatttcatggagttctgcttacttcacctcccatagcattttgtctctgctctcttctttgctgtttacagctcatttcctttcttctccacatctgcaacaagaaagcctgggagctcaagataagtgtaataaaccctaggctggtggggagaaaggagggtaagattttcttctacattgtcacaggctcctggtcctgggtctgacttttttccagtgcaacccagtctgacaatgccatatattcccagtatatctggggaactgcatcactatttcttcgcatgcatttgagattagttatcatagatcacattttggagctggaaggaccttggagattttttaaaggcacttcaaaagtcattatacatacatatttaaatatttttgcatgctacatttaacaaacacaaagttccaaatgtgttaagtaaaatgaaattaatgttacctacttcagtgaattcaagtttataaggagaagtggaatacacatgttgcttggtgaaaagggccaactttctcacactgttttcccaatgaggtcatgtgtcatacaggcatggaatgttacaaagctgatatttatggggcactgaccatacaccaggcactgttatatttaacctttttacttatattgccccatttaatcatcactatatatctaagagctagatactatggtaagtcctatttgatcttcttaactagaaacagtacatggaaaatgggagagttaggactcaaaactcaagcagatggaaacagggtttctcccagaaacaagacaatcctgccaggaaaaactgtgtgactttgaagaatgtggtctctgtgtgtgttcaagcatatatacaaaccctgggttatttgggtaaatgaatttagaatgagagcacagggtgaaatgatgaagactgaattataggggagttggttgttttatcattttgaaaattattgaattccattgagattccaggagactctgatactttgacctaggtgcccatgcatcttaattttaaatgtgttcagacttaccaatttagggaatataaaatgagtgacatcgacagctgccatcagtgaatggcacttaagggctttgaaccatgagtgctaagcagtgttgtttcttggactagctttgtgcccttggtaaggcactgcctcccaacctctttctttataagaccaacaacccctagtatagacaaagaacaatgcctacatctgtgtaatccagagacaagaatgcaggatgggtttccagaacccttataattaattgaagagagcaaaagacgaaaagagaggcccataaaataaatgggaaattattttgtttctttttcgtcagccaagtttagccccatggaaagcagagaccagttgtggccgcctgaaaaactaagagctgatgccagtttgatttagctcaggaggctgaaactttctgccccgaaggctggtgtgatggaatagaccttcccattgctcacaatattatgaaaaaaacattaaagcaacaatttttattacttgccctgcagctagagctttaaaatgtactttcttctcccctaccctccctaaaccacttagcttttaaaaacaaacaacccattcatgtgtttgttacagtcacattattagttctttctctttattcctgggcccttttctttaatgcagcaaagtatttggagggatgtacttgtggatctgtggaattttactttattttattcagaaaatattaatttcaataaccatttattgagtgtatactatgtgacaggtaaagatgaatgagaacaaatctaaataggagagtgacccatctgcaaacaattgcaccacagggtaatgtggaagtagtggccactcactcttccaggaaagaggtatgattggaactcaggaagactttgcagagaaggtgaattttgaactgtgttttaaagcctaaagaccaagcagagggagaagggtattccaagaatggagaacaacaagagcaaggaaaaggaggcaagtatgaacatggcattcttcaggagatgggagttcagtgtggctgtggtagggaggtgtggtaaggttagggccagacagtgatggtccttgaatgtcatgttatttaaactttatcacagtctagataatccttttcagcattatttttgttttgttttgttttgaggcaaggcctctctctgtcacccaggctggagtgccgtggcaagatctcactgcgacttccgcctcccggttcaagtgattctcctgcctcagcctcccaagtagctgggactacaggcacacaccactacagcctggctaatttttttatttttagtagagacgggactttgccatgtgggccaggttgatctcgaccttctggcttcaagctatctgcctgccttggcctcccaaagtgttgggattacaggcatgagccactgtgcctggctcttttcagcatttttaagctgaattttaaacagaggaatgatatgattggattttccttagaaaatagctacagtaataatgtttcagaagaattggggaaggaagagccagaaggccacaggaaaatgaagatgctattgccataggtctaatgaaataggataaggatctaaactaagataggtttgagagactatttgaagacagagcaggattaatgactagctggagctggatatgggaaatatgtttgaaaataatctgaggttttggaattgcttaactgggtgagtggagatgccactaatgagggtaagaaatataaggtgaggaagaagtttcgggagaaagacggtgagtgagcagaggtagctgtggaacatctgggtggagatcccaggatatagccttttctgtagctgtgctgtgatgtcacacagtcaagaccttggccaaacattacaatagggcctcagtctaaaaagacacatcaatttaataactcacttaaaaaatacatcatacttatctaatgaccattacattatatttcaggcaagttattagagaactctgattcttatgtaagtgccagtgaaggaaaaaagattggagactcaaacaatgaggagttattataagctgccaggagaaactgaaaaagagaaatacagaccagagtcattcaaaggaacaaagataaggaaatggcaggagtgttgcagaaagcagtggtttctgaagacacaggtataggcagatatgaaatacagagaagaaatttgagctggcgcttccaaataactgtacttctttaatggtaagatatcccaagctttgatttctcatcttattcagtttgtcaggaagagacaaacaggtgtgggtgctgggcagagggcttgatctcattttgcagagaaagtgtttggagactttgaactaagcaaagagtaacagggaaaataagataaaaatgaaaagggtaatgattcggagaaatttttcagagaatttaaggaattctatgacaaacaggtgttaaagaaaaaggcagatcaacgcagtgttctcttgatatagtggtattagacttccttggaaaaaagattcgcatagcgccttatatttaaaaagcaattttatatttgattgttacaagaacctaggaagcaggtgcagccaggcattattatctttcttttataaacttaaaatctggcatgaaggaggctgcagtttgtttcatggctcagacggctcagatcccatggctggcagggactcagagccttctgactttgggtccattgctttgtccattgtatcaacgccttgccttaccttggaaccttggccttctgcagtgtgcctccttcccttatcatatcatatcacataaatgtaaaagtaaagcagatggtatttgaagaccaaaagagccaagatctctggggagacaggcagtgatgtgaaaggatccttagcactgattatgctatatacaatagggatgttcatgaagagttgtgcatagagtgttatctacgtaaatcaaatgacactttcagtgcagtaggggagtccacaatatccaaagtgttatgattaaattttttatgaggcaaataatccctttataaaatgaacaatcagtcactccttgatatattatctgaataaatccagattttcaaatatggggttgacttaaagcaagatacatctctagtagcctacatctatatttatcatatatgaagatttttctgacttgggtattgaatatgaagatggggatctggagctggatcctctaattgttagagaccatttaaaatacaatggacatcatgacttgcagctaaatccattcagctacctttactgtttaccaagcacctaacaggtatgccattggatggggcaaaactcagctgggaaatggagagagaagcccagcactggcactgccttgagtctgacagttagaccacaagaaagtcataaatgtaaattcaccaatatagtgagccagggtaagaaaactagaaactcttatggtccttgaattctacatcagtattaaaatgaaaccaagtatatttcaaagcaaagactgttatattagacccagagttattctgtactgacaaaagataatctttgtaaggaagaagaggtagttgtgactctttatgcatcaaacatttaaaaatgcatatctttaaaacatgtaaaactaatgattagatctatgagaaataagcgaagctatttgtaggacactttagatctgttgttttacatgacaaatcaagtagacaaagtcaaatggtaatacacaagatttgaataatataactaatgaggttgaataatataatttatgagtgaatagggatatggaacatttaatagtatattttattattaatcaaaaaattatgttatgtatgaatatatatgtacatgatatatattgggatatatatggggtatatgtatgtatatatgtctccttttttgcattaataagttcttttttattttactgtaaattggcaaattatggttgtatatatttatgaaatacaaagtaatgttgatatatgtcataatacaaccttccatacaatgtggaatgattaaatcaagctaataaacatacccatcaccttaaatacttatcatttttgtggtgaaaatatttgaaatttgctctcttagcaattttgaaatatacaacacagtataattaactatagtcatcatgctgacaatataatctcaaaaaatttattcctcttgtttaattgaaactttgaaccctttggcattccccattttccccaacccctcagactttggtaagcaccattctactctacgcttcttagttctgttgtttagattccacgtagaagtgagatcatgtggtatttgtctttctgtgcctatgtctggcttattgcatttagcataatgtcctgcagcttcatccatgttgtcacaaatgacagaatttcctcatttttaaaggcagaatagtatttcattgtgcatatgtgccacctattctttagccatttatctgttgatggacacttcggttgattctataatttggctattgtgaatagtgctgcagtgaacatgggattgcatatgtctctttaatataattatttcaaatctttggctatgtacttagaagtgggattggtggatcatatgatagttctatctttagtttttttgaggaccctccatgaagttttctgtaatggctatactaatttacattcccatcaacaatgtataagagtttcctttacttcacattgtcaccagaatttttttttgtttgtttgagacggagtcttgctctatcgcccaagctggagtgcagtggcgccatctctgctcactgcaagctccgcctcccgggttcacgccattctcctgcctcagcctcctgagtagctgggactaccggcgcccgccaccatgcccggctaattttttttgtatttttactagagacggggtttcactttgttagccaggattgtctcgatctcctgacctcgtgatccgcccgcctcagcctcccaaagtactgggattacaggcgtgagccaccgcacccggccccagaattttgtttttgaggcaggatctggttcttttgctcaggctggagtacaggggcgtgatcttggctcactgcaacctctgcctcccaggctcaagccatcctccctcctcagcctcctaggtgactgggactacaggtgtgccactgggcctggctaatttttgtatatttgtagagaaggagtttcgccatgttgcccagactggtctcaaactcctgagctcaagcaatctactctccttggcctcccaaagtgctggattacaggagtgagccacagtgcctagtacatttgtcattttctgtctttttcataatagccattctaactggggtgagatagtctcattgcagttttgatttgcatttctttgataattaatgatgttgagcattttttaatatatctgttggccatttatatgtcttttgagaattgtctgttcaggctctttgtccattttttaatcaggttgcttgttttcttgctattgagttgtttgagttccttatacagttcatccttgagcaatgcggggcttagcggtgctgactccctctacagttgaaaattctagtataacttttgattcccccagaacttaactactaatagccaactgttgactggaagccttaccagtaacataaatagccaattaacacatattttgtatgttacatgtaatatatactatctgcttacaatagagtaaggtagagaaaagaaaattttattgagaaaatcctaagggagagaaaatatatttactatttattaagtggaagtgaatcaccataaaggtcttcactcttgtcatctttatgttgagtaggcggaggaggaggaggaagagaagggattggtcttgctgtcttaggggtggcagaggtggaagaagcgaggaggtgaaaggcgagggaggagaggcaggcccacttggtgtaactgtctggaaatacataataatttctgtatggctacttttctctttctaaaaatgttgtaaagtttatcttaaaatgtttctatacagtatcagtctttcttctgctatttgcattagcttcagtgcccatatcatagaagcgttcatgtcataaaagaagtcaaatgcagtcttaaataatcagaacgcttctgccagattgtctgatgttaatttgctttttggtacttttatatcctcctcatcatcataaggcactggttcagaagcactccgtcaagttgtcttctgtcaattcctctggtgtgtagtgtctattagctcttgaatttctccaagattcatatcttgacaccttcattcaccaccttttttcccactatatttacaatcgctttcattatttccttgaattggctttgtcataaaccctgtgaagtcatacacaacagctgggcacagttttctcctgcaggaacttattgttggcttgatggctttcacagctttttctataacaatgatggtgtcttcaatggggtaatccttctaggctttcatgatgttctctctatcggggttctctaacatagcactgacatcctttccatagagtactgtgtataatgagccttcaaggtccttatgatcccctaatctagaggatgattagagatgttgcgtttgggggcaagtaggacacttggatgtctttgatgttgaactcatggggttctaggtggccaggggcattgtctaatatgaaaataattttaaaaggcattcccttaccagcaagatactttctgacttcagagaaaaagcatcagtggaaccaatccagaaaaatagttcttgtttaagccaaaagactggtagctgatgtttatctttttccatcaaggcttggaggttagcagctttatagatgacagtcctgaccataaacctgactgcatttgcatgaaacagtagttagcctatgccttcctaccttaaatcttggtgctcacttctcttccttactaataaatgtcctttgtggctttttttttttttccagaatacagcatgttcagctgcattaaaaccctgtttaggcaggtatcctttctcctcaatgattttttaatggctttgcaatatagtttgatatcaggcagtgtgatgcctccagttttgtttgttttatttaagatcatcttggtgattttttttaattccctatgaattttagggttattttttctgtttccttttaaaatatactttctggccatttttctctctcttcgtcttctgaaattatgtgaagattagttcccttgactgtgattgtgtcacataattcttgtaggttttcttcatcttttccattcttttttctttttgctcctctgatgaataatttcaaatattctgtatttagctcattgattgtgctgcttaattgagtctgctgttgaagatttctattgcatttttcaattaagtcattgtattctttatctcttgggtttcttttttattgtttctacttcttctatattctcattttgtgtattgtttctcaaatttcatttaattttatatccatatattcttgtagttcactgaactgctttacaaggatttttctgaatcttttttctgccactttatagatcttcattttttagtctgttattggaactttgttagtttcttttgatgattacagatgctctttgacttacaatgggcttatgtcctattaaacccatagtaatttcaaaactttgtaagtaagaaatgtgtttaataccccagtaaaccaattgtaatgtcaaaaaattatgagttgaaccatcataagtgcagatgctccttgacttacaatggggttatatcctgataagtccgttgtaaagttgtatagttgtaagttgaaccatcataaattggggaccgtctatatttgtaatccttgtgttctagcattggtgtctgcacatttgaagagacagcttcctcctgagtgcagtggtataatgacagctcactgcagccttgacctcctgggctcataagattctcccacctcagcctcttgagtagttgggaccacaggtgtttgccaccatgcctggctactttttgtattttttgtagagaggggtttcaccatgttgtccaggctggtcttgaactcctgggctcaagtgatctacttaccttggcctcccaaaatgctggaataacaggcataagccactgcatccagccccaacagcttgctcttctggtctttacaggtattctttgtcagggattgacctttacttcttagtctaggctgtgattctagttgggtcaggtggtaatgaccccatgcaggcagagctcgctatagttggctgggtgctgcctttgctctgaggtctgatggggctgctggctcggctcccatgcttcggggagaccactggctgagctctgctataatttctgattggacaaggttgtagggtgtacttcctggctgggtggtactacttttttggttcaacagttgagcagggctgcaggctggactctgagtttaggtggagttgctgctcaggatggatggggtctggagtatatgctgcatagaactgcacagttgaggattgcctgtctctgggcagggccttagagtgggctctgagtctggattgagtcactctttggatttctgcgtcaggcaattccaacccctatgatccacagaaatgccctgtgatggtcatctccacatctcccgcctgggtaaggcattgaggtcgcctctgaggctggccgtctaaagactcaaagcaggctgaccttctcatcatgtttctgtgaacagtgaacttggctttgcaagtgagccataccattggctggtatctctgattgtgcaccaccactgggaggaacatagagccatcaccaaaatttgcacactggtccctgtgagctctgcctcctttctttgtttatacctaacccaggaggtctagccatgtcattactgccagtattccccatgaggtcagatgggagtgggctttctgggaagtgtctcagaatgctagggagctggatgtctagaaactctggttaccttttttttttttttactgtatgggcccagttaaaaagatcctcttggctgggcacagtggctcacgcctgtaatcccagcactttgggaggccgaggtgggtggatcacgaggtcaggagattgagaccatcctggcaaacatggtgaaaccccgtctctactaaaaatacaaaaattagctggacgtggtggtgtgcgtctgtaatcccagctactcaggaggctgaggcaggagaatcacttgaacccaggaggcagaggttgcagtgagctgagattgtgccactgcacttcagctggggcaacagagtgggactctgtctcaaaaaaaaatcctctctctgtgtgtcaccatgctgatctgggggagcaggaggggcagtgtagtcaacgtgagattgttcctcttctaatgtggtttttatttgattcagtggcctattcattcagctgtctccgtttctttctcaagtttgtaagttttcacaaaagtgttcttgtctttggattgttgcttgttggactttctgtagagggaagtgaagccaagtgaagcctgggacttcctattctgccatcttgctgatgtcatgcctacatgtttacagaaaattcacatcctcttataacatttatgagacattgtaaaaaacaaaacaaaacaacaacgacaacaaaacccaaaagccttaaatgaagactttagtgaattccagagtccttcttactcttactggccttgtgccttagccctctggtttagcccctgtttccagctagcttttaacaggttgagatgatgaaaagaaaacatacctctctcctttcataatgctgtgaagtagctcatataattcatcttccacgtttatatacgtatgtctcttttgtgcccagagcatcattttgagattcttttttcattatcaaaatacattggatctatgttattcataactaatctgaggctgtatttgttacatttgagtattttaaatcattaatgccatatgtattgtataccaaaatttaccatctaaaacacctggctattcttttgtagggtttttcttttcattagcttttttgagctaaagcttaaagaaaatcagggaccaaaggaaggttagaaagtggctggaggtatcataaacaccaactaagttctttgagaagcagaaggtgcatcatggaaatcagcattattctgacttcatttcattgcctactcagtccaaattttagggtttacaacttaaactaataactcactggcaccttgcatttcctgtggcttaatggttaagaacatgggctttgaagtcattgtcctgagttcaaatttgaggtctaccaccatcacctatgtgactttgggccaaacacatatactctttatacctccatttcttcatccataaaattgggataaaaattataactgtctgcagtgggcagaatactgtcttccctaccaccccctacggtgtccatatcttaatccctgaaactgtgcatgttagattacattgcaaaggggaattaaggttgcagatagaattaacattattaatcatctggccttaaaataggaaattatgctggattatcctggtgggcccaatgtaatcacaaaggtctttaaaagtggaagagtgaagcagaagaagtcagagagttaggaagatgtgattatggaagaatgttcaaagagagacagtgccactggctttgaagatggaggaagggggccatgagccaaggaatgtgggtggccacgagccaaggaatgtgggtggccactagaaactgaggaaagcaaggaaatagattctctcctaaagcttccagaaagggatgcagtcctgccgataccttgcttttacgtgatgcatacagtgtcagacttctgacctaaagaactgcaaaataataaatttgtattcagataccaaatttgtggtattttgttacagcagaaataggaaataaatgcaccgccatatggggttgttgtaagggttaggaaatgtaaacctttaagatagacctgccacatggtaaatgctcagttagtattagccactattattatccattggtactttagtttcccttctgtctttgctcttttgtggtagttgtcttgtaattacccaaatttgtggttatcttccctacaaagactatggccctaggtgtttttcactctcattttagtctatactcagcctccagtaatttgtcaaaattaccatttcagagttcctaccattttgtggttccagcagcttctgttccaggtgagtagatcttggctgtgactctctggatttgcctgtctctccagattttagggtggtagtttgccctgcaacttcagttctgtggggcatccaaggaaagtcgctggttttcactttgttttgtttcattattgtaaggacatgagtgctgacttccgagttctttacatgttggtactgaaattggaagtgtgggcagtgctctttaccctacggctttaataatctttctatacacatgagatcttcatctctacactttacttctttctgatttccattatctggttttcacttcattcatttcatttccaaacatgctttttctgtattttctatttaggttagtggcatctcaatccaagggatagtagttaatttgatgtgtctgaaatacagggtacaaaacaggctcatagtcggggagattgcccttaactctccacctttcctgaatccttttcttcagaattagtaagtcgccaagggctgttgtgtctatgaattttgcccacatccttgctgtcattacgctagtcctaactcttgactcggccatgcagaatattttaaaccactttatcctctacactgcctcagagttagatcataagttggatcatgttacttcctctctcagaagacctacattttgaaaaattgcttgtggaataaatcccaaactcctaatttggcatttaaggttcttaaagatctgtaattaaggtatatttctaggtggattcatagtgcatgtacctactgtatttgctagtgctaccacaacaaaatcctgcagactgggtaggttaaacaacagaaatgaattttctcatggttgtgggggctggaagtccaagatcaaagtgtctgcatgtttggtttcttctgaggcctctctttttggcttgcacgtggccatcttttctcgaggtacttacatagtcttctctctgtgcatgcacacccctgatatcgctctgtgtattccagtttcctcttcttatatggacaccagtcagattcttttagggcccaccctgatagtctcattttaccttaacacctctttcaaagccccattttcaaatagtcacagtccaaagccctgggggttagggctttaacgtatgaattttggggaacacaatttagcccataacaccgactgtatccctctatgtattctgtactcatgaatgtataatggatcacctaggaagatttagaaaatactgatttgggggtctcacccaacttcttgtaggttctgaatcagtaggtctgaaatggggctgagaatacatttggtgtgtgtgtgtgtgtgtgtgtgtgtgtttatacttctccctagtgctttcccagctttcctagactctttaacattattggtgaacatactataaatgttcatacctttgctcatatttgttttttaactgaaaattctcttcctaccatacctatgaaatttaatatctatgaaaattaattcagccttctaggctgatctgaaatatcatcttttctgttatctttttcttattctctccagagataatcctgcaatactttgttgtgattttattttactttatataagtactgaagaatttattttgttttatatgatagtcatttgccttcttctttcactagctttctgagaccaaagaggacatattctttatttctgtatatatgaaacagtggcagttgctctgaacatagtagataattaatcaatctttgcagtgtgaaaaatgaactagttaagaaatgctaatatttttattgtgactttttataaaatggagatcattgggtaaaaaatgaacatatcaaatgtaaaacaagtggcagacttttttttaaaaaagactttacttttttttgaaaagcagttttagattgagaaggtgtagaaatatcccatacactacctgcccctcacatgtgcattccctaccagagtggtacattcgttgcaattgatgaacccatatagacatatcatcatcgcccaaagcccatggtttgtattagcgttcactcttggtggtgtgctttctatgggtttggattgccctaaaaatcccctgtactctacttgttcatccctcccttcccctcactcctggcaactactgatcttttctctgtgttcgtagttttgccctttccaagatgtcatatagttggaatcatacagtatgtagtcttttcagattcgcttctttcactgagtaatatgcatttacttctcctccctgtctctttatggcttgatagcacatttctttttagctctgaataatattccattgtctgggtgtgctacagtttatttatccgttcacctactgaagatcatcttggttgcttccaaattttggcaattatgaataaagctgctctttacatccatgtgcaggtttttgtgtttacatgttttcaatccttttgggaaaatattaaagaatgccattgctggattgtatgttaagagtatgtttagttttttaagaaactgtcaaactattttccaaagtgggtgcaccattttacattctcaccagcaatgagtgagcattcctgttgctccacatcctcaccagcatttggtgttgtcagtattatggttttgggccattctgctaggtctgtagtggtatcttgttttcttttccatttccctgcttacatatgatgtgaagtatcttttcacatgtttattttccactttatatcttctttggtaaggtgtctgttaaggtctttgggtcattttttaattgggttgtttgttttcttgttgctgagtttttaagagttctttgtatattttggataatagtccttatatttaatatgtcttttgcaagagtggcagaatttttgttcattatttttttcttgaattaaatatccttaacattacacataaacagtatttttaatgtgtattttcaatttggaacttttaacatttaaaaatttctcttgatgaagatatgtgataataaaatggggggcaaagtgaagacattgtaacaatttttgataatcgcatcttcttctgcattgcatttttcagggcagagtattaatggtccagttcttaaagataaatggattcctcaatgtttatttgtagtatatccttgtttattctcctaatgaagaactgcatccttaaagctggcataattaggtagacttgtctattagctgagctactaagctttattttcctgggccaatgaataacagaaacaattctcaaaataattaaatctgttaagacccagttttggggtaaggagctggggtctggcatttcctttttgttggtttttcaaaaattattaaaacttcaatgcttggccaggtgtggtggctcatgcatacaatcccagcactttgagtggcaggcagatcgcttgagcccgggagttcaacactaacctgggcaacatggcaaaacctcaactgtacaaaaaatatgagaattagttgggtgtggtgtggcactcctgtggtcccagctacttgagaggctgaggcggcaggattacctgagccctgtaagggtgaggctgcagtgagccaagatcgcaccagcactccagcctgagctacagagcaaagccctgtctcaaacaaaacaaaacaaaatctcaacgttaaactttctagagaatgggtaatcacctttcaagtcatttttccaaacccatttctgaaccaggacaggcaataacagagattggcaggggaaggactgatgtctcctcacaagggaaaaaggactctgcattgaaaacacagatgagcctttggatgtggaaatttacaaggctcagagagccccgaaacatcttcagaagtggagcccagcagaataatgggaggctgtgtgctggcttggcactggagactgtctggcacaaactacactgtaaacaactcctcaaacattttcatctgcatacatgacattagattctccaaatgtccaattaaacacttgtcaatggaagaaatgtttgtttcctcagctgacctgttgtcagccttggccttcctgatggggaagcagtttcagctgatactgttgtatgctcttcctttctgggcctgatcttgtccctgttgagaactgtggagactgtgccaagctgtggaccatgggattaggttaggtaactaaagaaaatatccaggctgtgagcacttttcaaacctaagaaaatctttagtttcttttgcacagttgtaaaccgtttgtgcttaaaaaattataaaagtgattgcagttgagatagagaaaagagcagtgctgatatgtgtttatatacttctaagggctgacttcatttttttcaacatcttaaacttctattgaacaaatattgtgtgtgtaggtgtgtgtttgtgtgtgtgtgtgtcatcatctctgttgacagaaatgctcaatgataagtctctgtgactggaagagcagtgaaggacttggacacatgctgtagaaacataaaggaagtgaggaaggcaatattggagaagaatcaaaggagtttaaattattctttggaaaagttggagtttataaattaaaaaaaaactgtatgaccttgagcaaatttctatttttactagtgtcagtttcctaatccataaaatagggaatataatgtcaagaacatcgaaggttattattaaaattaaataaaatgatctatgtaaaatgcagcaacacttgccacattgtaaattctcaagaaatgctagctaatattgaaatatgaaataatacttctttggtccaaagatgtttaagcattcctatttggtaaagagaaggagcaaaagaacaagagaaaaattagataattggtacagtatgaacagagtatttggctttggaaaggagggtgggcagttctttcactgggacaggagctcagaatgactctataggtaaagggatagaagaactttaaggtgaggatgaagaaagacaaagcatgtcatggtcattctattgtctcttcagttacgtagaagaggagagctttttctgagcatgagggggaataggagtgaaatttgaggcttaaagagaatggaaaagtttcatagcagctgctgtggagaatttgatacgtgtcaactgaagataaatataagggttgtgcagcaatgcagaggatatggctgaggtcagacagccttagtttatagtggcatgattttgggaatgtagatgatggcattatgtaccctggagcaaacacagagaaaattcaaaattacctttgaggaataagaaaggaggtgaggagtaagggtaaaggcgtcctaaggtgctaatgaaaatgctgttgaaatcattaaccaccaagtaaagttgtgagccaagattaatctgaaatggtgatttgtgtggatagaagtacaaatagactggaggtggggaggcccttcactggacaggcaacattaatctagctgccattgtaccgcacacatgctgaatgatgatgatacaggaatgaaggaaacataattcacttgggcagctcaagagcatttttttaagctcttagtatatactggctagatcatccatatgacagcaatgcttcccttgaaaagctttaagtctagtgatatgctctggataatttaaactcagactgtggggtactttgaaggaggtaagcagagggtccgaggaaacaatagaagaggacattcaacatgacctgtgaaaagaaagggcaggtcagtaaaagtatcctggaaaatatcttgcttgagctgaatcgattgtagagagccagggtaaagaatggcagaaagggagaggcaaaagcaagggagaaaaagcaaggaaaaaacagagcaagggagtgatttggctagggcagacaaaagatttcagagaagggataattaagatgagttacatatgatactattactaagtgagagaaataaggaagacatgaatgaaagtgataaacaatgtgttggtaggaacagaagaaagaatgtcaagagaacagaatgatgagatttaatgactgattgaatacgtggggaatgaatgggtgattttacactcttgatcctgaattatagggacaattatggtttccttaacagaaagagggaaatcccgagttagggaagatttaggggaaggtgatgagtttggagatgttgaatcagaacatatggtttcaagtgaaagtaattcaaccaagatgggattaaaccaaatgagagaatttgtgatgttcataattagtaagttcataggtgcttctggatttaggcatacctggctctccagggttcaaatatgatatgggcttatctctattcctatgatctctgtctcttagattagcttgtcttgcttgttttcattccaaagacaggctctcagtatatggtaggcaaatgggtacctccaggttcacattccagcgatcccggtggaaataacttttatttgcaacatccatatattttaaatgtaggttttattattattcagatatggtgaggccaggagattaggagaaaattgccaatggaaaatataatttgttactcatatctcctatgatatgggggcacacaatgacatgcagaccacacagggaagcaccagggtcagttaggaagcagaaggagtgagggaaagagcctttattgtggggtttgtgggaaggaatggatgagtcaaagcaagtaggcttaggtttggctagtttgaatgattttcgtgggctctgggttgtagagttctttagcaagacgtctggtacctagccctgtggttataaaggcaggagaatattggctaggtgtatgaggatttgataagggaggtcatgctggtgggatgggctttggattggctagtttctgtatgaaaggcatgcttacaggggtgttatttgctatcactagcaattagctaatgctgtgagggacagtccctcctggtccattgagtccctggatgccagaacattaagaatacagaaaataagagaatatagttaatacattgtataccaacgccaggaaagattctgatttgccttacttgagtcattccagctctgtagtttaggtgcagagtacagggtgaggaatggtattgtgattgacagtcaacctagaccagagtgtagggatcagggaggactaccctaaagaaaataaagccagaacatgggaaagtatgctggtaaatcaaaaactgtatcgactggtctatcacaaggtggctagagccgtcttggttgagatgaccaggtggccattcaaatatggctcttggcctctagacttcgaagaggctaaggatttttatttttgttttagcagctctcgtacaccatgtattgctcccgggcttgatggccctcttctgtcctgcttttctaaagcctatatagttcctgagctcagtgttaaaaaccaaactggagttttaggcatcatttaggttttctgattctcttggtgaggtaccagtgttttcctcaatgcctacctcagaaaccttagctttgactcccttcctttcccttctatcaagtcatttatcttcttctgaaatagctcccagatttacttcttccttactcatattagctgttgcctttctagtctctcttttttaatacggctttctgaatattgccagagttatctcactggggaaacatcatccccacttctcccacaaaaaaatctaccccgccatttggacattacagagagtaaatggtgtgtacatattacatgggtgagtgtctgaagacctagattcaagtcacttcacgttcctcctctgcattttattaaagatatttggtagcttacataagaaaatgcatgttttaaaactttttataaatcataatgtagttcagatgatggtgattttttgatttctctaattttgaaattctaattttcaggcttatctttttctttttttttttttttttgagaaagtctcacactgtcacctgggctgaagtgcagtggcacgatctcggctcactgcaacctccgcctcccgggttcaagcaattctgctgcctcagcctcccatgtagctgggattacaggtgtgtgccaccacgcctggctaatttttttatatttctagtagagacagggtttcactatgttggccaggctgatctcaaactcctgacctcgtgatctgcccgcctcggcttcccaaagtgctaggattacaggtgtgagccaccgcacctggccttatctccttttctaaatgaacctctccgtcgccacacttaggccaagtttgtttctatctttatatctttctatattgttcccaacccgaaatccccttctttgctctactgtctgccaactaaatattagctatccttcaaagtgtgtctgaagtcctgtctcttatatgaagtcttgtctaattatctagatcacctgtattctctatttttcttacacttcaatttcactactgattatttacctttaattattatatatcttttattctccacaatatgtttgatgcttctgagggcagggatcctgacttttacttattttgtatcatggacagttctgggcataaatttaaaaaaaagttgctaatgattaattattaattggggaaaagtactaatttgcaataatcacactttggatatagtttgtgagcttcccttttcctcatggggagaaataagtttggattgattggactgacagatgttgaaacaatttggttcagttagacaaattcttattgagttctaggacatatgggtaactgctgaataaatattcatttgttcatttattcagtcaacaaatatttattggatatccattgtctgccccacactgtgcaagttaccataatatatgtctgcaatcagacatttagatattgaaaatctaaacatgaatcttacatggttctcatcttcaatttgctttattacatgaccaaggatgagatcattgggtgattataaagcattgcagaaaagtaaatgatatgcttgtggacatttgaagaagggagtaatttattctgactcgggtagctcagaagaggattcaaagagaccatattcaggaaaaaatgaaacatgtagaaaggaaatattaacactcatgtttgctttgtgaaaattttgcattttacacagtgtgttgttaaaaattaacgtgttggagagtttccatttccaggaagatggagtaaatgtagtttttcctatttgtctcctaagtgcaactaaaaacccttgacattatatatataaaacaaatataagaagactctgaaaggtggagagaataaggcaaaccagctggagacctcaggacctgaggaatgacacattactgagttccctgggtttttctttttgccttgtatatctcagacttagagctgaacaaatgggtaacttggagatgccaatggtgcagacaaaaaaaaaaaatctccagcaaaagcctgttttctctaacaaaggacccaaaaagggataatccagcaaaacaaaacttttaaaaagtaaccactctattgcaaacaaacagaaaaaattgtggccccacccttatgtattcagcaaagactgagtggatatcttagatgtctactctaataaggctgtgatgaggtatctgaatatccctgccagggtagggtcagagaagaccaagtagaggtactttccttcccatcaaccagtaatgagcctcctgctgcccccaccacatccccacttgtgatgtcagcggggatcttggacttgtggcctaattgacaataatgcacctctcccttgccctgctggcatgatgtcagaggagatctagtggacttttaccgtttcccagaagtattgaggccatcttaccacagtgtcagtggataccacatggaggatctacaactctcactttcactcagaatgtatgaggagaccctgcccctccttgagtgtcaatggaacctggacttgtacctctatctggcattgatgaggcagtgacacctcccactctccattgcccctgcagtagtgtcagagaaatccaactaaaatggatgtggagtctcataacataatataaatatctgggtttcaattgaaaattacttgtcacagaaagacaggaggaaaaaaaacctagagaaacaaaaaacagagaagaaaaatagaaaataagaaataaaattgtggacaagttctaatatatcaacaattacattaaatgttaatggcgtaaatgtaacaatttaaaacagattgccagaatggattgaaaaacatgatcaactctatgctatgtacaagaaacttacttcatatgtaaacatataggcaatttggaaaggagagaaaaacatatgtaattgattcttgttaatcatggtagttatgttctgtaaaactgctgtgaatgctgaatttgtaaatactaaactgctgttcctaggggaaatacagagctagattcctgcaagcctctggtcacatttttctcaactggtcaatgaataattttattttatgtgttctgtttaaagacaccttactgagtatatattatcgattcattaactttgaactcattgccaagagctctagaactcatatctgaacaaagcttatcgcacacacatgttttctctgtaaggtacatcagagctttcatttgcttaggaacaatagggctttagtactatgcttgaggccattttaaacagtaaaatcaccaacaaaaagtacaaacatatcaaaaccgtggcactaaataaactgtgagaacagttgtttacagcatgagagctaaaacaagaaggcaaagtatttacttgtttgacctaggctaggaacatgtgtatggagtgactcaatttttttttttttttttttttttttttggctgtactgcacttgtgcacaaatgactgcaaaagcaatgcaagtatgattttggggttacaaataaattttagtgagtaggcaaattagcaaatatggaatccacaaataatgaggatagatggtgtcatgcaaagatcaatcaaaggaaagcagatatattaatatcagataaagtagacttcagatgaaagaaaattaacagagacagacattatctaatgataaaagccttatgctaatgtttataacagctttatttgtaatagccaaaatggaaagaatccagttgtccttaaattgatgaatggttaaacaaactgtgatatatccatactatggaatactactcagcaataaagaggaaaagattatttatataggcaatgacctggaagaatctttagggaattctgctgagaaaaaaatcaatcataaaggttatatacacgtttctatttatataacaatctttaaatgacagaattatagaaatgaacaacaaattagtggttgccaggatttaaggagtttgggtgggggtgggagtagagggatgcgtgggtgtagctgtaaaagagcaacaggacggacggatccttgtggtgatagacatgctctatgtctggactgtctcaatggcagtatcctgcttctgataaagtactgtagttttgtaggatgctgcactggggaaactggggaaagtttacataggatctctctgtattctttcttataactcaatgtgaatctacagtgatcccaacataaaaactgtaatttaaaaaacttagcgtactttactgtatgtagctcctttccttgtacttgataaccttaagtctttttgtcaaccagtgatacactggtctacaaatatttattttgaattcctgcttcgttctcagcattatggtggctggaactattaggaatacaattacagaagcataagatttagagtacatataaaaaagcgtgtgtgtgtgtaaagcatatgcaagtatgtctgagagagtaaacataattctcatctttcaaaattttagtgttccactgtaaattgtaaaagctatagtgtaaagtagcatttgtaatcctattcagctcttaacttgccaagaatatcctctcaggatgtgttgcttcactacagtaccaaccattgtgttgtcaaatccatgtgaattatgcaaaacaaaagaaaaacaaatggcctacctaaggtttggcagctgcaacaaggaaactatcaatttgaggtttattgtaatacattaaatttgaaagaatattcttccaagtaattctagggcttggaatgaatgaaggatcatttgaaaaatctgcaactcatttctaaaagattaggaaaaaagagaaaagaacatagttgccaacttctccttggtttgtatttatggaatatatgaaggtttagcattttagattctttcctaattctcagttaatttacctgtagaatctctttgaagaactacttttacatttctttcattttgatgagaaaattgaaaacttggggcaactaaaaagaagtgtttagcttgagtgatagttcattaatatgatttttaggggcctggcagaaacaaatagatcctagcaggtcttgtgatttagaggattattagagatttgggtgaaatagataagtatttctcctttgatagaatcagataattgtctctctgtgcaatgtccaacaccagctttctatgtaataaaaataaactatgaaaacaaacaggaggcaaaaataaagcttcatgggcttcttaaactgtttgtgaaagttgttgttctagagatcataaggtagggagttaataaatactttgttccttgacagggctaccccattgtaccactccaaaaccatgggaatggtgtcctgtgaggttgtatagtacacagtcagccttgttctgtgcagcatccctgggacctgccatgtactagacactgttctaggtactggggatatagcagtgaacaaaacagatgagaaatatccctgccttgatggaatttccattctagactggaaattgagacaatgagccaaatggataaattaattttatagcatgcttggaggtggcatattctatgccaaaaaataaagcaaaggagttggaaaacaattgctaggattggggagttgtttcagttttaaatagggtggtcagatcacttgagtgcaggagttcgagaccagcctggccaagatggcgaaaccccatctctactaaaaatacaaaaattagctgggcttggtggtgcgtgcctgtaatcctagatactctggaggctgaggcatgaaaattcctttaacttgggaggcagaggctgcagtgagctgagcttgcatcactttactccagcctgggagacagagcaagactctgtctcaatttaaaaaaaatggggtggtcaaggagtgcttctttgagaagtgaatgttgtttctttaaaatttttttttaaaatgttagattcagggggtacatgtgtgggtttgttacatgcatatagtgtttaatggtgaggtttgggcttcaagcatagccatcacccaaatagcaaacattttcaaccaagatgaaggtgtactgttcactctgggtaagagtgtgccaggcagaaggaacagttactaccaaggtactgaggtgggaatattgcccttcagcaaagaggctagagtgactggagcagagaaggggaatggtagatgttaccagtggagtcttgactaggagtcatccaggttcttggcagtttgaacaaagaattggacaaaacacacacaaagcaatgaaagaatgcagcaacggaagtacagatttattgacgtgaaagtacactccacagaatgagagtggacttgggcaagcagctcaggagcagtggttacagaattttctggggtttaaataccatctagaggtttcccattggttacttggttacatcctacataaatgaggtagtgggccatgaccagtctgattagtcgcctttcatgatcagtcagagactgaagtggttacaaagttacacccctatgcaaatgaagactaggcctgtgaccagcctgattggtggtgggaggggacaaatcagaggtactttccatttttcatctgataccggaaggggtgtgttgtaaagggagtagcctctgatacttttgttacatgggcttggaaagttggggttttccttatgatttagttctaggaagtcagtgtgaattggccttagggtccctgcctcctggcgctattctcctgcctcagtagagatgagatctgaacataagatgggacttgtgggacatccataagacttcagcttttattctgagcaagatagggtgcaatctgagggctctaagctgggaggtgacattagctgactagatagctgtgggtagtgtgaacactatattgtctggctagttgggaagtggctcaaatatcatattgaataaatcgcaataaaatgctaaagttggagctgtaactgaggaaaatggtggttagaaaagagaaatgaaaaacaaataaacccgtgacaagacttttctattacttgtaagaaagtggaagtggaggaggggggatactgtcttgtaataaaaacttagtcttatttctaaaaagtaattgttcaactagaagcaacaaaactaatcatagggaatctgttttagtaggtaatgcagtatgtcaaccatttttagagtatctcaaaattttcaacattggcaaaatacccaaagctggcattacagcttggattcttcccagtggaaaaccaagttggacacaaagttctgaagaggaaaggagtctgagaaatagaaagaactgagatgcgtgtatttcctgaaccttttttccccctgtccttaatgatgttgtggttaaaacacttttgtgggtttattgagactgataaatacgctcatttacatctcattaatgtcaaattgatgtggctgaatagcatagtttggtagtctctaatgtgtgagacttcatgacttaagtaaacttttctattactctgaattagtgtcaccaagggcataggttttttaaagaaatgcttgtagagactttaaaataatgaaaaatattcaacacacctggctaagagtgattgtattacattcctgtttctttagataaaggtctgtcagcacatccattacaggcacatcttttcaggttgaaacttggcatagcagttctaaagaggaaagagattcaaacaaaatgtgaacaaaatgtttcttttgcttgaagaagacattcccttcataccctgatgcagctacatcccataaaactttgagaatcttattttcgttttgtttttggtaaaataagaagcgcctttgaaaaacagtttatctttggacacgaaggtaaagaaaaaccttttgatgtttggcaacagatttgcttaagaacaaaaatgatttaaaggactttttgaaaagagttagtgttgtctatttttattttctcagacagaccataatcacaatgactattgaaacaccgatacccttaagggctaaatttatcccgcctgtccctggaacaaaacaagaatatccacaaacatgacaccctctttggcagaatagacactaagtgcatatttgttgagaattgagaagatgcataagtcagagaaaagaaattatatttaaaaaggctttacaaatttttagtttttgaggtaatatatacaagtggaacacaactcaaaaagagtatgtagtgaaatgtaagtttccttcttcctccttgctctaagccaccactgggttaccctccacagagacaagcactgttatcagtgtcttatgtgtcatttaagagagcatattcttttttctttttagttaattggtagctttacattttattctgcaccttgctttgttctcctgacatttcattttggaggctgttcaatatatgtatgtagagagctacttctactgcattctttttaattagcttcatgttctaattggtacgttacatgtaccaatacacatagatgtaccatgatttacttagtctatacataaacatttaaactattcctaacttttcctattacaaacagtgtaacacaacatcctcgtgcacagatcattttgtgtgagtgtatctgcaggataatttctagaagaggaatatttatgttaaaagtatatgcatgtatgtagactcttctccatagaaattgtacacgcccagcagcaatatggaagtgtgcctatttctccattccctttccatcacaatgtatatcaaaaacttagtaatgtgatggaggggaacagcactctgttttagtttgtgtttttatcatgagtaatgttgagcatctttttataagtttaagaatcatttgtattttctatgaactgtttatatattttcttgcttttagaaaatattattgatccttttcttattgatatgtgaaaactcttttttaaaataagtgttttctcaacacacactagtgcatttttggtgtatgtaagttccaattggctttttatcataccaaaaatgtttattttttcctatttttatagattaataataattgtacatacttatggagtatgtgtgatattttgatacatgcatacaatgtgtaacaatcaaattgggatatttaggatatctattacctcaaacatttatcatttctttgctttgggaacatttcaattcttttagcaattttgaaataataaattattattactatgtcaccttactatgctgtccaacactaggacttattccttctacgtttctgtatataaccaatctctcttcatccctcccactgcctcacacccttcccagtttctggtaaccatcattctactctctatctccatgagataaacttttttagctaccacatgtaagtaagagcgtgcaatattttttctttatgtgaatttattcctgggttttctattctattccattggtctatgtgcctgacttatttcacttaacataacgacctccatttccatccatgttgctgcaaatgacagtatatcattcttttttatggctgagtagtattccattgtgtatatatatgccacattttctttatccagtcttctgttgatagacacttgggatgattgcatatcttggttattgtgaatagtgctacaataaacatgaaaatgtaggtatcccttcgatatactgatttctttgttttgtatttgcttttttaaaagtaatttttatttcaatagtttttggggtgcagttggtgtttggctacatggataggctgtttagtggtgatttctgagattttggtgtacccatcacccaagtagtgttcactgtacccaatatgaagtcttttatccctcatcccctttccaaccttccctactgagtccccaaagtccagtatatcattcttatgcctttgcatcctcatagcttagctcccacttataaatgaggacatacaatactggttttccattcctgagttattttacttagaataatggcctccagctccatctaacttgctgcaaagacctgattttgttcatttttatggctgagtagtattccatggtctgtatctaccacattttctttatttacttgttgtttgatgggcactttggttggttccatatctttgcaattgcaaattgtgctgctgtaaaaatgcatatgcatgtgtctttttcctacgtgacttcttttcctcttggtagatattcagtagcgggattgctggatcaaatggtagttctactttttgttctttaaggaatctccatactgttttccacagtggttgtaccagtttacattcccaccaacagttctaaaaatgttcccttttcaccacatacacaccaacatttattgttctttgaatttttaattatggtcattcttgcaggagtaaggtggtatctcattgtggttttgatttgcatttccctgatcattagtgatgttgagcatctttgcatgtgtttggtggctgtttgtatgtcttcttttgaaaattgtctatatgtcctttgtgcactttttgatgggatttggattttttttgatggtttgtttgagttccttttagattctgtatattagtcctttgtcagatgcatagtttgtgaatattttctcccattctgtgggttgtctgtttgctctgctgattatttcttttgctgtgcagaagctttttagtttaattgggtcccatttatttatttttgtttttgttacatttgcttttgcagtcttattcatgaattctttgcctaagccaatgtctagaataagttttccaatgttatcttctagaatatttatggtttcaggtcttaggtttaagtttttgatccatttgaggtgatttttatataatgtgagaaatgaggatccagtttcattcttctacatgtgacttgccagttttctcagcaccatttgttgaatagggtgccctttcctcaatttatgtttttgtatgctttgttgcggatcagcacttacttaatatatttggctttctttctgggttctctattctgttccgtcggtctacatgcctatttttatacccctaccctgctgttttagtaactatagccttgtaggataatttgaagttgggtaatgggatgcttccagatttgttctttttgcttatcttgcgttagctgtgaggccccttttttggttccatgtgaattttaggattattttttctaattctgtgaagaatgatgatggtattttgatgggaattgcattgaatccgtatattgctttgggcagtatggtcgttttcacaatattggttccacctatccatgagcatgggatgtgtttttatttgtttgtgtcatctatgatttctttcatcagtgttttgcagttttccttgtagagatcttttacctctttggttgatatactgatttcctttcctttggataaacacccaatagtgggattgctggagtgtatagtagttatatttttagctttttgagaaacctccatgatgtgtttcatcatggctgcactaatttagattcccaccaacagtatataagcgttcccttttctttgcatccttgccagcatttgttattttatgtccttttgaaaatagccattccaactagggtgagctatcttttatttgcatttccttcatgattagtgatgcaaagcattttttcatatacatgttttccacttgtgtatcttattttaagaaatgtctcttcagaccctttgcccactttttaatgggattatttgggcttttttttttttttttagctgttgagttgtttgatttcctgttatgttctggatattagttccttgttggataaatagtccgcaaatattttctctcatactgcaggttgtctcttcactctgttgattgttttctttgttctgcagaagatgtttagtttactgtgaccccgtttgtctatttttgtttttgttgcctgtttttgaagtcttagccataaaaatctaatgtcctgaattgcttctcctatgtattcttctagtagttttatacttttgggtcttatgttttagtatttaatccgttttgagtttatttttgtatatgtagtaggggtctactctcattcttctgcatggatattcagttttcccatttgttgaagaactgaatgctttttctatgtctactgagatgattcatatggtctttgtccctcattctgttgatgtgatgtatcatatttattgttggtgttgaacaatccttgcatccctgggataaattccacttgattgtggtgtattgtctttttaatgtgttgttggatttggttagctagtattttgttgagaatttttgcatctgtgttcatcagggatattggcttttagttttctttttattttttagtgtgtccttgtcttgttttgatttcagggtaattttggcctcatagaatgaattaggaataattccctcttctccaatttttttgaatagtttgagaagaatttttgttagttcttcttcatgagtttagtagaattcagcagtaaagccatctgctcctggtcttttcttaacttgagacattttattaatgattattactaatttttattctgctcaggctttctgtttcttcctggctcattctttgtaggttttatgtgaccaggagttatccattttctctaagtttttccatttgttaaaatatagctgtttataatagtctccagtgattctttgtatttctgtggtaccagttgcaatgtctcctttttttttttgtttctgattttatttacttgaatcttttctttctttttcttggttactatagctagcagtttgtcaattttacttatattttcaaaaaccaacttttcatttcatcgatcctttgtactttttcaagtcttgatttcctttagttttgttctaatgttattacttctttccttctgttaatattaggtttgatttgttcttgcttttctagttccctgaaatacatcattaagttgtttatttgaaatctttctacttttttgaggtaagcatttattgctataaacttccctcttggcactgcttttgctgtatcgaataggttctggtatgttgtattcacatcttcatttgtttccagaaatattttaatttccttctttatttcctcattgatgcaatagtcattcaggggcatgtggtttaaccttcatatatttgtacagtttccaaagttcctcttgttactgatatatagttttagttcattgttgaaattcccaactgatatggtttggctgtgtccccacccaaatctcatcttgaattcacacgtgttgtgggagggactcagtgggaggtaattgaatcatgggggcttgtctttctcatgctattctcatgatagtgaataagtctcatgggatcttatggttttaaaaacaggagtttccctacacaagctctttgcctgctgccatccatgtaagacatgacttgctcctccttcctttccaccattattatgaggcctcccagccctgtgtaactgtaagtccattaaacctctttattttgtaaattttccagtcttgggtatatccttatcagcagcgtgaaaacagactaattacagtaaattggtaccaggagtggggtgctgctgaaaagataccccaaaatgtggaagtggctttgggactgggtaacatgcagaggttggaacagtttagagggctcagaagaagataggaaagtgtgggaaagtgtggaactccctagagacttgttgaatagccttgaccaaaatgctgataatgatatggacaatgaaatccagactgaggtggtcttggatggagatgaggaacttgttgggaactgaagcaaaggttatgttttagaaaagagactggtggcattttgcccctgcccgagagatctgtggaactttgaacttgaaagagatgatttagggtatctagtagaagaaatttctaagcagcaaaacattcaagaagtgacttcagtgctgttaaaggcattcagttttaaaagggaaacagagcataaaagtttggaaattttgcagcctgacaatgcaatagaaaagataatctcattttctgaggagaaattcaagctggctgtagaaatttacataaataatgaggatcctaatgttaatccccaaaacaatggagaaaatgactccagggcaggtcagaagtcttcatggtagcccctcccatcacaggaccagaggcctaggaggaaaaggtgttttttttggccaggcccaggtccctctgctctgtgcagcctagggacttggtaccctgcatttcagcagctccagccatggctaaaaggggccaaggtacagcttgggctgttgcttcgcagggtgaaagccccaagccttggcatcttccacatagtgttgagtctgtaggtacacagaagtcaagaactgaggtttgggaacctcttcctagatttcagaggatgtatagaaatgcctggctgcacaggcagaagtttgctacaggggtgaggctgtcatagagaacttctgccatggcagtgtggaaaaaaatgtggggttggaacccaacacagaaaccctacttcagcattgtctagtttagctgtgagaagaggaccaccatcctccagactgatagatccactgatagcttgcaccatgcacctggaaaagctgcagacactcaatgccagcccatgaaagcagccaggaggggggctataccctgcaaagccacagaggcagagctgcccaaggccatgggagcccacttcttacatcagcatgacctggatgtgagacatggagtcaaagggcaccattttggaatgccctgctggatttcggacttgcatggggcctgcagcttctttgttttggccaatgtctcccatttggaatgactgtatttacccaatgcttgtacccccattgtatctaggaagtaactaacttgcttttgattttacaggctcataggtgaaaaggacttgccttcactaagatgaaactttggactatggaattttgggtaaatgctgaaatgagttaagattttgggggactgttgggaaggcatgatttgttttgaaatatgaggacatgagatttgggaggggccagggcagaatgatatggtttggctgtgttccccacccaaatctcatgttgaattctcatgtgttgtgggggggacccagtgggaggtaattgaatcacgagagtggatttttcttgtgctattcttgtgatagtaagtctcacttactcactcgtgatagtgagtaagatctgatggttttaaaaagagaagtttccctatacaagctctctctcttggcctgctgccatccacgtaaaacgtgacttgcttctccttgccttctgccatgatggtgaggcctcccagccatgtggaactgtaaggccattaagcatctttcttttgtaagttgcctagtcttgggtatgtctttatcagcagcatgaaaatgggctaatacaccaactattgttgtactggagtctgtctctccctttatatctgataatatttgttttatatatctaggtgctctgctgttgggtgcttgtatgtttggaattgttatattctctttctgaattgatcccttcatcattatataatgactttctttgtctctttttacaggttttaacttaaagtctgttttatctgatataactatcactattcctgcttgcttttggtttcatttgcatggaatatatttttccatccctttactttcattctatatgtgtccttacagatgagatgagtttcttggagacagcataaaattgggtcatgctttttatccattcagcttgattatatcttttaagtgaagactttaatctgtttacattcaaggttattattgataaatgaggaaatattcctgtcactttgtaatatgatttttggttgttttatatatcatttgtctctttcttccttttttattttttatcattgtggtttagtggttttctttagcggtaatgtttcacttctttgtctttctcatttgtgtatcttacttttatactttcatgtgtttttatgatggtagagattatccatttgctttcagatgtaggattccgttaagtatttcctgcagggctgatctagtggtgatgaattccctgtttttgattgtctgggaaatactttatttctttcatttctgaaggacagatttgctaggtatggtattcttagatggcagggttttttcttttggcactttgaatatatcattccattctcttctggactgtaattttttgctgagaaatttactgttagtcctaatcagacttgtatatgataatccccttgtatatgacttggcactttttctgtttttagaattctctctttgtctttggcttttggcagtttgcttataatgtaatttagagaagacctttttggattatgtctatttgtgagtttttgtgcttcttgtacctggatgcctaaatctcttgcaagatttgggaagtttttaagtattattctgttaaacaggttttctatgttgttatctatctcttgcccttctggaactgccagaattagaatttttttctttttatggtgtcccatatattatctaggcttccttcattcttttaaatccattttttctatttttttcttttctcttttgtctgactgagttattaaaaaaaaaaaacctgtcttcatgttcagcagttcttttctgtgcttggtatactctattgtagaagctcttgattgtattttttatttcatttattgaattcatcagttccaggcctttggttttgttctctttggatatctgtctctggtatttatcattcagctcatgaattatttttgatttctctgtattatttatctgtgttttcttgtatctcactgtgtttctgtaatattattctctggaattcttttttaggcattttataaatttcctttactttgggatctcttactggataattattgtgtttcttttgaagtgtcatgtttctttgcttttttgtgttttttgtatccttacattgatttcagtgcatctgacataacaattgcttctgattttatgcattggctttcatggagaaagactttttcctgtagataatctatagtgttggttgggtaaagtgctttggttttgattctggttgggcacggtagtatagtctgcatgatttctttggctgtaattagcatcagtgttttctctgagttcctcagtggcttagactgcagttgttaatggatgttgtggtgaggctttgctggagatgggcatgccatgcaggctggtccttgggtaccagtggtgttggtgaggcatgcctgtcctcaagtccctgatggtggatgcaggtgttagctgtggcaggtacggttaggactgatccttagacccccacacagtatgctcgggtgcaagcaatcatggtggtgggtgggatcggcttgtctttaggccccagatgatgtacttgggtgccatcagtggtggcagtggatagggtagccctgtcttcaggcccctggatggaacatgtgggtgccagtggcagcaagagggatgggttgatttccaggttcttggattatgtgcacagataccagcagcagggaaagtgagcctgtcctcaggccccctgatagtgtggggaggtacgagcaacagcaggtggagcagattgatttaagagttagctcagtgttggccagacttggtggctcacgcctgtctcccagcactttgggaggctgaggtgggtgtatcacgaggtctggagttcgagaccagcctggtcaacatggtaaaactccatctctactaaaaaaaaaaatacaaaaattagccaggcatggtggcgcttgcctgtagtcctagctacttgggaggctgaggcaggagaatcacttgaacctgggaggcggaggttgcagtgagctgagctcgtgccactgcattccagcctggggtgatagagtgaaactccatctcaaaaacaaacaaacaacaaaaaaacaaaaaacaaaaaacagagttagctcagtgttttatgatttataaatattttcttaattttctaggcatttgtgttttgattttttgttatgaaatactttttatttctatttttattagtcaaatttatcaattttaatgggttctgagttttttgacagaattagaaaatctttattgctctgagatcttttttataaaccatctcattttttaatggtactttaagggttcttatgtttaaatctttaatctgtctcagatttattttggtgtaaggtgtgttatatatatctagcttaatttttcttcgattagttatcaaggtttttttgtttttatatcactttttgaagttcattttttccgatgggattcaaatatacttatgacattaaaattttctaactatatttgtgtctatttctgggttctctgttctgtttcattgatctatttttctgtttacaaaccagcaactcaccattttaaataatagctttacaacaggtttttatatcttgcattgctaatcccgatcatttgtgttctttttcagaatgtttcttgttattcttatttttcctgtgaacttcagaatcaaatcaatttcttttgtttcaaatagtgttaattgtgtgtgtgtgaatatgtgtgaacatattaaatttatagaataagtcaggtagaactgacatctttaacatttagagttttcttatccatcaatatccctcacttttccatttgtttaattcttgtgggtccatcagtaacattaaaagttttattcacatatttcttgttatacatttttctagttactctataattttggttgctacttttaatgcaatctattcttactttggatctcctatttgcgttgtttgtatgtatgaaaagtagtggtgtcacaatattatttttgtattcattcacttaactgaattctgtcattatttatagttttccagttgattctcttgtgctgtccaggtaaataatcatatagtttccaaataatgatattttagttttatctcttaaaattttacctgcattttactgtctagttatgttattcaggacctccaaaaaattaatggtggtcatagtagacactcttgtcttcaacttattgttaataagaatactaataatagagttttcattaagcatgacatgctggcttttgagatgcaacagagatattttgtcatattaagagaggaaacccttttttcttggtatagtacatgataaggatttttgtcaaaaataacgttgaattttatcaaaagccttttcataatttattgagatggtattttagttttctctttttattattaacatggtaaattatattaatagatttattgttatacattattcttttatttggtgcataaacaccacttagtaatggtatattatactttaatgtgatcctggattctatttgcaaatactcacttagggtcttttttcatgatattcacaagtgagtttaggctatatttttattttttttctgtgctttttattgtggatttatatgttataaatatacatttgaagattttctttttttttcctatgctctacaacactttgaatggcattaaagttaggtgtttcttaaaaatttgtcagtattccgctagtgaaaccaactatgtgttgaactattttgttgggagtaaattgacaatttgtcctccttttaaaacagatagtgatatgttagattttcaaatttatctgggatgtgatttcttagaaaagcatcttaattctcaaatttactcacactgaattgatcaaactggtgttataggagtcttttaattttttttgtttctgggatcttcctcattgtttcttgttctttgtatttgtattttctatccttataattaaaaatgttttggcgagttaaaggttttgtttcgtgttatttctcctcctccacccatgaaacatctgttgggtttacttattctttcacattccatttttcttttcttttcttttcttttctttctcttctcttctcttctcttcttttctttttttctttttctttttctttttttgagacagagtcttgctttgtcacccaggctggagtgcaatggtgcaatcttagctcatcgcaacctccgcctcatagattaaagtgattctcctgcctcagtctcctgagtagctgggattacagacgcacaccaccactcctggctaatttttgtatttttagtagagatggggtttcaccatattgaccaggctggtctcgaacttcgcctcatgatctgcctgcctcggcctcccaaagtgctgggattacaggtgtgagccactgcacctggccacatgccatttttctaattcattatttcactttttatgtttattaatttctttttttctattttcctgtttttcattttattctaacttcttgagtgcttatattatctctttcattctttcttgtttattaatatttcagctatatcacctagataattgtatattgttctttcttcgattgttatttcccagatatcctataatttcagttttgattttatatttgatgcaaaacttaacagaattttaaaatatcctgatagtagattattttcattttctgggtttgttatttttaagttttattacattatgagcacagatgtatacattgtttttcctttttgaaaactgtcaaagtttttttttgtttgcaaatgggcagttttgtgaatgttccatggaaacttggaaagaaggtgtagtctctatttttagagtaatgtatatcacttaattttatttaggttttccatattctgaaaaaaatttttttttgcttattctgtcatgtcctgagagaaaagaaagtttcctattgctgagattttattttctaatttaagacttctgttttctgtaggtttttctttattgatattgcttctgtattactgggtaattagatagtcataacatttaatctacattttgtattgtgccctttagcattacaaggtgtttatcttttttcattgaacatatactatgctgcattaaaacccatctgatattaataccatgaacgttattttctttttacttgctcttgcctgttgtaatctttgcctttccttttattttcaacccttcttggttacttattgatttgtcgtattcttgtgtgcagcagatatttggattttgctttgaggcccacctcatttttcttttaatgagtatgtttaggccatgtgtagttgtagaaataagtgtttacttttaattctgtcattatatcttatcacactttgttcacagtatggactatttctgctttgtggggcgtgtgtgtattttctgatttggaagatttgtaattttatgctaccagttactttataattatatctttatgtgactctctatttcctactattagcatagatgaacttggcaatttccattttcttccttctactcctactgcaaaattgacggtactatatttcttcatgtatgcctctttatatttcaatgtactgtaattctgttgcttgacttaccagttttaaatgatctcttttgattgctagtatatcaattagaatattttcattgataagtaactgaaaagccatctagtggttgcttaatcaattaagacaattgctaccttaataataatgttaataagtccagaagtaggatagttctagtatctcaacaatgtttttagaatccagtttttccatatttttcttgaccattctcagcatgtaggctcttaacctcattgttgtttcttcttggttacatttataggcatgaatttatcctatagcagcataagagacagagaaaaatgctgtttatcttctcaaatttcttcataagaactgagaaacaaatgtctgctcatgactcattggacagaattgaatcacatgttcatgctaaaaccagccaacgttaagagaaatagatttcccaagactagcttatgctaatcacaaatcattctgtggagctggggagaacctcctagttctacaatacagaagcagaaaaggataaatttgtgtaggtctccagtggtgtctgctacctctgtctctataaaatgaagaaatcagcagaaatatactgccaccaattttcttgcccccttgctgtgtcaagttttgttaattacacattgttacatgtcaaggcttctaacctattcattctatcctgtaaccataatgtatttgttttggtcttcgttatagagaattcagtacaactattagtcattttgccagagatttatcatgcatttcttgattgactgaagttaatgcactagcaatttcttccagaaatggaaaaagggaagaagggaaccaaattctgtggattattgcatgttaaaaaaagtttgtcagcagtcattgtacttcagcaacagttcgattggatataaaattttttcttatttccttgaggacttttctctagatgggaaaaattatgtattgaaacctgttccttccattgttttgattacactttttggggacactagttgtacatatgcttgatttccattttctctctcttcctggccttttggctaacatcaagtgtaattgatttccattttctgtatatatccttttttctataatcattaaaaaattttacttttgctataatcctttttaacttggttatttacattttattctgatcactttttaaatttgtgtccttcataattcttactttgttttcagcagcatttactctgtttggattgtctccaatatgaccttcatttctctgatggttttatttttctctcctgtttatgagctctgccagtccaatcatcatctccttgtattgccttgccttattttacttgggctcttgtatacttagtttgcatttttaatttatagaggtatgtgcttatttttttgtttatatcattatatttggtcacaatttttatctgttctgtggcaatattttttggatgccactttcctctgttccctattttctccttttgtggctcttatgcaagttattccttttaaaaaataatcatctctaactgaggcacattttttctggatcagctacctgtaaaaggtttgtgtgagaggggcaccccattgtgttctaggctaataacaattgtccttatgatttaatgagtattttttttaatttagcttttactctcttccccattgccttgccttcagacagatttctgaaaatatagcttatacatgtgatttgttattcagtctcagttacttgctttctttagtgccaagttgtgtccaggaaatctattgccaagttatgcaactactatcattattcctaacaagggattgttagtttttctgttaggatgtgatgcttactttggaagattgttttctgctgtagccatatgtagtttcttttgacatcttcttgcaactccgtttgagctgtgatacaaagtttacatgcccagtgcaggggaaatgatgtgtgtctgccacttttgagtgctatgattgttcacttctttagattctcatagtctgtcctgataattgcaggaattagaaaaggctggcctagagtcctttcctcacctatgactttagggccacattatggcttccttttcccatttcatgaaaatatgactacatctatggtcttttatgaaaaacaaagtaaaatgccctgctagcaactggcaacccaaatccaagaggtaaccagattttctttaggaatataagtttttccaaggcaatatccatgtgtgagacatctttggaagaataaatgtacagaaattggttgtattagtttcctagggctgctttaacaatttaccataaaaccagtggcttaaaagaacagatatttattctttcacagttctgaaaagctgaagttctaaatgaaggtaacagcagggatgctgttccttcagaggttctaggggaagaattcttccttgcctcttccaggttctagtggctccagatgtttcttggcttgttgctgcataactctaatctctgcctcagtctttatatggctttcttccttatgttctgtcttctcttctgtctcttataaggatacttatcattgaatttagggcccatccaggatgatctcatctcaagatctttaacttaattatatctgtaaagtccctttttttgaataaggttatactcatcaaaagtactaggggttaggacatggatgtatattttgggggaccattactcaacccactccactagtgtttctgtgtcatctctcttcatacatttaacagttatatatatagcaatgtctttgtgagtaacactgttctgggggtttcagagtattgactatcttttccttaaaatgtttataatttacttgaggactcaagatctacatttggacaataatataagttaaaacaaaaaataaagcggagtcattttggtaactggtgtgagaattccattgctgggaaatatgttcttgatatgatactttgataagcttgggtagaagttagcctccaaagcccagctagtcctcaggtttctttgatgctggtatgagaagtggcttttcggtagaggcaagcctaatggggatttccatgtaaaatgctgttctgtgcactctgacccttccttattactccaaaatatgtccaaaaccatataaataacagtgaaaataggttgagtgtatttcttttggaaatcactgaacaccctgggcattatcaaaacatacaattacatataattaaataagacaataatactattaataagtcatacagttctggaaaacagtaaggtctctctggttggagttgtctctggaaaatgaatcttgagttgaatgttaaaattgggtggaatatgattgagaaagggtattctagaaaggagaatgatattggtaagtgcaggagtgtacctaagacaagcttgagacaccaagtgagtggtctgatcctgctgaattacagtaggctttcagtagaagtgcaagattgtaccttgcttgtaggtgtgtaatagaactattgtgaataaagttgtggttcataataattattgaaccctagggcattaagcaaacataggcagtggtcaggtagttacagcaggccttgggtgagacccagtgctatgctggcttcaggtctgacccagcacagtcccagtgttggtgactgcagggttgcttgtgccacccctctcccagctccaggcagctcagcatagacagactctgtttgtttgagagaaagtaaggaaacagagcaagagtcttcctggtaatccagagaattcttccggatcttatccaagaccatgaaggcgataactctacaagtccacaggagccacagttttactaagctttaggtgtcccctaatgcagatacagctgcaatgaccaaaaacttagaccacaacacccaagtcctttcaaatatttgaaaagccttcctaagaaggacaggtacaaataagtccaggctgcaaagacaacaataaatattcaattcttcaacagccagagaccaatgaacattcacaaggatcaagaccgtccagaaaacataatctcaccaaatgaactcaataaggtgccagggaccaattctggagatacagagataggtgacctttcagaaaattcaaaatagctgtgttgaggaaactcaaagaaattcattgataaggaattcagaatcctatcagataaacttaacaaagagattgaaataattaaaaagaatcaagcagaaattctggagtccaaaaaggcaattgacactctgaagaatgcattagagtatcttaacagcaagaatagatcaagcagaagaaagaattagtgagcttgaagacaggcattttgaaaatacgcaaagtagacaaaagaagaaagaataaaaaagattgaagcatgcctacaggatctagaaaatggcctcagaagtgcaaatccaagagttattagccttagaaaggaggaagggtagggaggggggagagagggagagagagagagtagggtagaaagttcattgaaagagataataacagagaactttccaaacctagagaaagatatcaatattcaagtacaagaaggttatagaacaccaagatttaacccaaagaagactacctcaaggcatttaatagtcaatctcccaaaggtcaagtataaagaaaggatcctaaaagcaagaaaaaagaaacaaataacatacaatggatctccaatacatctggcagcagacttcagtgaaaactttacaggccaggagagagtggcatgacatattaaaagtgccaaaagaaaaaatcttttaccatggaatagtatatccagcaaaaatattctttgatcatgaaggagacataaagacttttccagaccaaaaaaaaggctgagggatttcatcaacatcagacctgtcctacaagaaatgttaaagggaattcttcaatcagaaagaaaaggatgttaatgaggaataagaaatcatctgaaggcaaaggactcagtggttatagtaagtacacagaaaaaaatggaatattataacactgtaattgtggtttgtaaattacccatatcttaagtagaaagatgaaaacatgaggtgatgaaaaataataaactgcaactcttcaagatgtaggcaatacaataagatataaatagaacaataaaaagttaagaagcagggagacgaagtaaaagtgtagagttctctttttgcttgcttgttagtttgttaatgcagtgttaagtcaccagtttaaaataatgggttataagatggtatttgcaagcctcatggtaacctcaaatcaagaaacataaacaaatacactaaaattaaaaagcaaaaaattaaaacatagcaccagataaaatgaccttcacaaaaaggaagacagaaaggaaagaagggaggaaggaagagaagaccacaaaacaaccagaaaacaaataataaaatggcaggcataagaccttacttatcagtaataacgtttaatgtaaatggacagaactctccaatcaaaggacatggagtaactgaatggtttaaaaaaaaaaaagacccaattatctgttacctgctggaaacacaataaagaaatatcagacttaatctgcacagtagatcaaatggacctaatagaaatttacagaacattttatccaatggctggataagacacattcttctcctcagcatatggctcattcataaggatagactatatgttaggccacaagacaagtcttaaaacctttgaaagaacagaaattatgtcaaatatcttctctgactacagtggaataaaactagaagtcaataacaagaggaactttggaaacaacaaacacacagaagttaaacaatgtgctcctgaatgaccagtgggtcattgaaaaaattaggaaattaaaaaaaaattgaagcaaataataatggaaacacaacataccaaaacctataggatacagtgaaagcagtactaagaggaaatttatgtgtataagcagctacataaaaaagaggaaaaacttcaaataaacaaactaatggtgtatcttaaagaactagaaaagcagttttttccaattctgtgaagaaagtcattggtagcttgatgaggatggcattgaatctgtaaattactactttacagtgcatatggaaccaaaaaagagcccgcattgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaatatatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgagagaaaattttcgcaacctactcttctgacaaagggctaacatccagaatctacaatgaactcaaacaaatttacaagaaaaaaacaaacaaccccatcaaaaagtgggcaaaggacatgaacagacacttctcaaaggaagacatttatgcagccaaaaaacacatgaaaaaatgctcatcatcactggccatcagagaaatgcaaattaaaaccacaatgagataccatttcacaccagttagaatggcgatcattaaaaagtcagggaacaacaggtgctggagaggatgtggagaaataggaacacttttacactgttgatgggactgtaaactagttcaaccattgtggaagtcagtgtggcgattcctcagggatctagaactagaaatatcatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacatcatggaatactatgcagccataaaaaatgatgagtttatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagtggggagggatagcattgggagatatacctaatggtagatgacgagttagtgggtgcagtgcaccagcatggcacatgtgtacgtatgtaactaacctgcacattgtgcacatgtaccctaaaacttgaagtataataataataaattaaaaaaaaagaactagaaaagcaagagcaaactgaacccaaaattagtagaagaaaataaataataaagatcagagcagaaataaataaaattaaaattaaaaaatagtacaaaagatcaatgaagtgaaaagttggttttgtgaaaagataaacaaaatttacaaactttagtcaggctaagaaaaaaagagagactacccaaataaataaaataagagatgaaaaggagacattacaaccaataccacagaaattcaaaggatcattagaggctgtgatgagcaaatatgtgccaataaacttgaaaacctaggagaaatggatctcattctagatacaaacaaccacaagattgaactatggaggaatccaaaacttaatcagatcaataacaagtaacgagatggaagccataatggaaagtctcccagcaaaccaaagcctgggacttgatggttccatggctgaattctaacaaatgtttaaggaaaaactaataccagtgctactcaaactagtccaaaaaatagaggaggaaagaatacttccaaactggccttctatgagaccaatattaccctgatacaaaaaccaaacaatgacacattgaaagacaaaaacaaaaaattacaggccaatctccctaatgaacactgatgccaaaattcttaacaaaacattagcaaactaaattcaatgatacactaaaaagattcatcatgaccaaggggaatttatcccagggatgcaagtatcctcaacatatgcaaaccaattcatgtgatacatcatataaacagattgaaaaacaaaaaatcatatggttatttcaactgatgctgaaaatgtatttgataaaattcagcatcccttcatgataaaaactctgaaaaactggatatagaatgaacatagttcaatgtaataaaagccatatatgacagatctatagctagtatcttactgatgaggaaaatctgaaagccttttctctaagatctagaacatgacaaggatgcccaccttcactactgttattcaacagtcctagcaagagcaattagacaagagaaagaaataaagggcatccagattggaatggaagaagtcaaattatctttgtttggaaatgatgtgatcttatatttggaaaaacctgaagactccaccaaaaaagtatgagaactgttcaacaaattcagtaaggtggcaggatacaaaatcaacatataaaaatgagtagtatttctatatgccaacaacaaacaatctaaaaagaaatttaaaaagtaatcccacttacagtagctacaaataaaattaaatacctaggaattaaccaaacaagtgaaagatctctacaatgaaaatgataaaatgctgatgaaggaaattgaagaggacacaaaaaatggaaagatattccatgtccatggattggaagaatcaatactgttaaaatttccatactgtccaaagcaatctgcagaattaatgcaatccctatcatgataccaatgactttcttcacagaaatagaaaaaacaatcctaaaattaatatggaaccactaaaggcccagaatagccaaagctatcctgaacaaaaggaaaaaaatgaggaatcacattatctgacttcaaattatactactgagccatagtaaccaaaacagtatggcactggcataaaaacagttagaccaatggaacaaaatagagaacctagaaataaatctatacatctatggtgaatttatttttagcagaggaaccaagaacatatattggggaaagaacagtctcttcaataagtggtgctgggaaaactggatgtccatatgcaaaagaatgaaactagacccccatctttcatgatatacaaaaatcaaatcaaaatggattaaagacttaaatctaagacctaaaaccatgaaactactataagaaaatattgggtgaaactctctaggacattggactgggcaaatatttcttcagtaataccccacaagcacaggcaaccaccgcaaaaattgacagatggaatcacagtaagtcaaaatgcttgtgcatagcaaaggatacaacaaagtgaagagacaatccacagaatgggagaaaatatttggaaactatccatctgacaagggattaatagccataatatgtaagcagctcaaacagctctataggaaaaaatataataatattatgaaaaatgggcaaaagatgaatagatatttctcaaaagaaggcaaacaagtgttgcaaaggtgctcaacatcactgatcatcacaatatgcaaataaaaactacagtgagatatcatctcaccccagttacaatggcttttatccaaatgacaggcaataacaaatgctggcaaggatgtggagaaaagggaacccttgtacactattggtgggaatgtaaattagtacaaccactatggacaacagtttggagttttctcaaaaacctaaaaatagagctaccataagatccagcaatcccactgccagctatatacccaaaaggaaggaactcagtatattgaagagatatctatgctcccatgtttgttgcagcagtttttcacaataagcaatatttgggagcaaactaagtgtccatcaacagatgaatggataaagaaaatgtggtacatgtacacaatggagtactattcaaccacaaaaagaatgagatcctctcatttgcaacatggatggaagtggaggtcatttatgttgagtgaaacaagccaggtacagaaagacaaacatcacatatttccacttatttgtgggagttaaaaagtaagacaattgaattcatggacatagagagtgggatgaaggttaccagaggctgagaaaggtagtagggggctggtgggaagtgagaatggttaattgctacaaaaatatgtttagaaagcatgaataagacctagcatttgatcgtacaacagggtgactatagtcaataataatttaattatacatttaaaaataactaaaagagtataattggattacttgttacacaaaggataaatgcttgaggtgatagatactccacttaccctgaagtgattatacacattgtatgcctttatcaaaatattttatgtaacgcatatatatatatacctactatgtacccacaaaaattaaaactaaaatcccaaaataatataaaccacagtgtcatatttgtgcttcactgcattcaaacaaattttgaaacatatggtactgagggcccaagctgaggacaaagagacatcaagcacacctattctaaagtgaactataaataactggggtcagacacctcccccagagatcagtgagaggtggccaaactgtccttatcactctaaactgtcacccaaggcctttcctatcatttcccaattgataaaagaagatgtggggtagagaggagaaagaagatgacattgttacatttgtgagtttcttgccaaatgttgtgtttccctccctttcccgtgggggcttcctgcctacttcaaagccctgtgaaaagtggactactagacaagagcctgggagtgtcaacaggagactggcttctcactcctggctagatgttgcatgaggtgaggcagcagaggcttagcttggtgaggttgttagcatgaagtgaagtatggtgaaggaagaaaaggacctaccatgggtccttgatgtgtgggggcatgtatgtacttggaaattgatgccttctgcttgcgtggctgcactactctgccaaggctgatagacaatggaccgcaggtaagatgtctaagaagaagacagagaaaatcccccagctcacttagaaggtctggaggaggattttcatggttcctatggcttgtcagaataagtctagcaggtagaatgcaaggcatgagtttgggaactgatcaagtggcatctagttatgagataccccatttggtgagagggttgagtgcgtggaccagtgactgagacacaaaatggagatgcagttgtctcttgttttgagggcattctcagtcatgtatagtgctggcttgaagcagaacatctctccaagtaaactgcatgcaccttctgggtagatagcaccacattggtaaagaccaccagcatcagaaagaaccagacctagctagaagggaactcgaaacagctgcccacttcttccagacagccagtctcatatgtcaacctctgccacatctgaaatttctctcccactgctctaatgcgtgggtggacttacagcctggaagctggaggagggaggaggtacagaggacacagagaacatctctttccttcctgaaggatggagggagaagaactttccccctgtctgctccaggcctgacctgaagcttggctggccccagggagagcaaagaagagctttatactagctatgaaactggaatttaaaatatatttgagtcttaaatactggaattagactcttctaataactgaaagtgattggaattttgtggaatattcccagatgttactaagggatagtgaaatatgattcaatgtaggacagctgtcagcagggattgggaaaatgaaaccattttaagtttattttacatcaaatacagactgtacaataacctggttatatacaatatagtggaaagaaaatagattaagtcagactgacttgggtttgaatccttgctcagcaacttactttccacatgatttttggcaaattactttcaatagttttcttaactgtgaaatggggataggcagtaacatcattcttccaaggatttgggagaagattaaatgaaataaattctaggaagcgtctagtgtgatgcctgagacatatagacctctgaaatggggattgattattacagctggagacaaatctggtaaatcaaggactaatggctgatgtagctatcaaatgtaatttgaagtagttagatgggtgggatctgatgagtatttgatgttttctaaatcccaaactatctttttcaatgaagtcaatgcattttcaaagcatttttctgcttaatttggaagattaaatgtatctaactggaagcgcatactagaaaagcatgagaaagggcttcttgtcctgatcagaaagatgaggaggctccgaagagatctgaggtaggacttctgccagcctcaaaatgtgccacacacatttaactgggaagatgctctgaataacatactcttggccatgtgaatgcgttccttggcagccctggccctgcaaagtttggcaggaggggattttcgggttgccagctaaagccctgacactcagagcaggcctcagtgtctctgttcccaaccctgtccccatccctaactgaaggaacttttgtttgtgcaatagctgttgtatctcactcatcccttctactaattggctctgaccctaactttccatattctccagcttggagatgcctgtgggaggtttgctttgagaaggccccagctttggcattgtcagtttttcatctggctcctaatctatttcactttgtctcaagcttcccttctttggtgacccactaaaaactgaagttgtgctggcaagatggtgctttgttgtcatggaaagaggctgtttgcagaactgcggggttaacaagaaggcttctttggcctgtggacggttggtttgtctttggcagtagccagttggagtacagcagggaggcatgttcattccagaagccgtctagtcttcagttgaaggaagtgccatcttaattttgaagtgagagcaacttacatctagagcaaactctttgaaggagggggatcttccaatatcccgtgtgggcctcccgaaggcccgaggcatagacaacaaggaagcaaggaagatgaggaagaaaaggggtgggtagagaaagggagaataagagagagaaaggtgaacgaaagctacagctgctgaatcctcttctgtatccatcacatgtttttactgaaagtttaagataatatcccattgccttatgtttatttgtttattttgatagctaacacttaaatagtgcttactacctaccaggtgctgcattaacactatatatattaagtcttttaagcttcaccacaaactcatgaggtaggcgatggtactatgtttatttcaagatggtaaactgagacatggagccattaagtaacttttctaagatcacacagctagtaagtggtagagccaggtttcaaatgcaggatttatattttctcttccctttccttcctgtccctccctcccctttctccttctgtaaacaagtgtcttctttgaggtgtatttagtgtcacatattttgcatttttgtgctttttttgggggggttgtgattttgctgtttaaaatggcccccaagtgtagtgctgaagtgttgtctagtgcttctacatgcaggaagattgtgatgtgccttatagaaaaaatgtgtgtgttagataaccttcattcaggctttagttgcagttctgttggttgtgagtacaatgttaatgaatcaatagatagatattaaatatgatatttaaaagaagcatacataaaacaaggttatgtcttcataagttgatgaaagtgttatgaccagaggctcacaagaacctaactctgtatttcccaagaagccatgattcaataatctctaattcagtgtttgtgacaactttatagaacataactccatgaataatgagactttgccatattttttttggcaaagattataataaatatgtcttgccacctaagtttagcttgatgcacagtcttctaagctatgtggccatttgctaagaaataccactatatatgttttgtttcttcagttcataaaatctcatgcacaatatcttatgtggtgcctgagaaatagtcagtgctccataaatgcttattgaatgaatgattaaatgaatgaaaaaagtaacactcaaaatttacaagataatctagtctagtactttacattttaagaaatacatgaatggacctggaactaatgtgtgtgtgtgtttttctttttaagtaagccatataacctatgaggcaagcaagttgttctaattgccttctggttgattacatactatttgttgagtactagctactgggattttcaaaatggaattttgcatagtttatttccctcaatcctacctaataagattaaggtccatctgttttgtataagagtccactgtttacttatcaagagtgctttgataaacgaagaggttatcagccacttgtatgggtatcctatactctgtttggctatagtgaggttaaaaggtcaagaatctgtaaggggattcttatccatgaggatattatgtatgcctagggaccatggaagtgaagttttgtttcatttattcatctattcaacaaatattttgaagacgtgctggtgatataatttggaatacaaaaatatgatgtccctgagattgttctttggcatcttggaaaatagtcctatgtagaaagcaacatccttcatactttcagttcttaagtattcatcaagcacctattatgtcccaggcactggggatatagcagtaagacaaagcccctaccctttgaaacttatattccttcaggaagaccaagcactgaacaacccatttgaggtaatactctcccctttggcccggattctgattcagctgctctttatttattatctccatattatgtgaaattatcttgcctttttgctcatttgcttattgtctgtctcccctcatgacaaatgtagctctaaaagagcagaaacttcgtctttcctattgctgaatgtccatcactgagaatagtgtttgatccaacagtagatgcttaataaatgttcgttcttatttaattatagttatggtaatgctaggaagtgtatttctggagattttgaattagtatggacaatcaggaatactcctttaaggaaatatggattgagttgaactttgaaggagtaagcagcaactaaatggagcaaagagtatatattctaggcagagggatcaggtcaaagaatggaacattagaatgtgtgatataaaattgatatatctggagttcaagagtaggagagtatattaggtgagtctagagaggtaggagagggcaggatagtcagggattaggaggctatatagggatttggagttttatcctaagagcattgggaagttattaaagaactacaaacaggaaatcaatctgttgttctgtggatgggagagagactactgagtggatagtgcaaccattcatggtcttgaagattaggtgttcagtctgggaaatctttgattcaaagtacctgtgaaacatccatttggaggtattaagtagacaattggctatacatatttttgggttcagagaaggaggtctgaaatgaatacactcatttgagtgacaacactgtgaatggtgtttgaagtcaagaggactgatgaaattgtctagggggagagtgtagagtaacaaaaacagagggcttcattcaggctaatctttgaggaacttcctcttttaaagatgataaagaagggtgaacaggaaagaatcttaaaagcagaaaagtttaaactaaactatctatgcttatttatatggcctttctgagtggttttattgtcaattgcccaagcatatctctctaataagactctatttaatttaccatattttaatcacttattttcttgtctttttcttctattgtccttgagagtagagattttgttctttaaaatcatgcttgaaaccctagtgcctagcatgcttccagcttaataggcatgaaatatatctgttattgagtgggaatacagagctttcttaggaaagatgagcaagagcggaaagcagatttttcctcacagcctcttctatgtgggacaccataaacattttattttaagccttttgtctataactgtgaaatggtgatttaggtatcaggaagcagatgggaaactttttgaggggtagaggcatttaaattctgcatctgtggtttctttgcatggatttgctcctacccctagacctgtggctgctaaaagttatttccagaagctgttgcagccaagagtctggtgtctacttcatcactttggaggttggcctgcctaggtctcccaatagtccctttccttctattccctctctcttgactatctgtttcccatttcctctaactttatcccaattcctctttgtccaaagaatcccagggcatgtttcataattataggcattattttactcaggatttattaacattttgtacagttatcacctttccccatttttccattatgaaatacatttttttatctcatataatttttacctttgataatgaagtgtgtatattctctttgataatggatctaatgataatgtgaccagtgtgtgaagatcagtgggccttcctctcctcccagttactccacattctggctaggtgcctctgctactaatagcttagcctgctgttcccatgtttgaggattgattctttttcctaggctgaggcaaacagttgtaatgttaaaggcttgctgacagcctgtctttgttgcctggaccgtgttttaatacgtgatctttgctgcctgaattttcttttttctagactacttgatttttcttgacctgtggaattttatgattacttgatttgtgaatttatctcaagcccctggttttgaaccaatgactctattattttaagccaggtgtattgtttttttagcctgtgtctattatactgtgtgttgcttcttatattccctatatctaagtaacttggctgactgggcattttgttaactttggggaggaaaagcatcaacatgacctgcatagggctggagaagagtgcagttagcccttgagggttgggggtgaatgtgttaagggtattaagggtggggagatactgctaagttggagaaaaactttcagcgaatttcactgatttcaaatcaagctgaatttgaagttcttgtctacatgagtgaacaatttttaaaacatttgaaggcatgcatttaaagtgacagcttaatgttaaaatgggaagttatgattcataagcagtagtaaaattttgaataacatgactttattcattgacagtaactgctttacattttccggtttcattatatcagtactgtgaataaaatccagaaaagttatagaggaggaaatgactttgagtttttattcaatagtcattacttacgtctttccacatttttttgcaaattttaagtttcagtaatgatcttgctattcaaattttctatttcttacaaccataatcttctagaatagccacaaaggtaggagtaagctgaagtaaaaagcctgtaggtcagtgtaaatgcctttcataaagcccacagcttgattcagtaaaacccagattgacgtctcttttcttatgataggcccagaatttatttgatttagttatatctatgacattttatttattttctcctggcaacatatagtttccacttttgatctaggggaaaaaaaggaggcttatagctgtaaaaatagccctgtacaaagtaatagaccctaaagtataactgtgcagagacaatgaagaaacagatcactgttgcttagtaggaatttctgcaatgacagaagtttttctatgcactgcccaatacagtggtcactagccacaaggagctgatgagcactggaaatgtggctattgaacctaagatactgaaatttaattttaatttcaatttaactaacttagtcacatgtggataggagctactacactggcctagtgcaagtatctacttcaagcttgtccaacctgtggcccaggacagctttgaatgcccacacaaattcgttaactttcttaaaacattatgagattttttttttcctaactcatcagctatccttagtgttagcatattttatgtgtggcccaagacaattcttcttccagtgtggcccagggaagccgaaagttgaggcacccctgatctagatcattgtattaactttctactggtattacaaaaaaattaccatggacttactggcttaaacaacacaatttcattttaatgaatgaatgaatgaatgaatgaatgatttttttttttggcttaggacaacacagatttattattttgtagttctgggagtcagaagtccaaaatgggttttacttggcaaaaaataaagtgccagtagagctgcattccttctggaggctctaggggagaatctgtgtccttgccccttccagcttctgaatgctgtctatgtttttggcttgtggctctttcctccatatttaaaggcagcaatgaccagtcaagtattgtcatattgtgtcactctgacactcaagttagaaatctagcactgttctcactgggctaaaatcaaggtgccctcagggctgctttattttctggaggatttaggagagagtccattttcttttcctttctagcatttaatggctgcccatattccttagttcatggcccccttcctccatcttccaagccatcaatgttgcatctctctgtccccttcttctatagttccatcttcctttgcctctcttcttctgcctctcccttacacttataaggattcttgtgattacactgagcacaccttgataatccaagatagtctccttattttaaagtcagctgactagcaatcttaaatcccttttgctatagaacctaatatatccgtaggttccaagaattaagactggatatttttgtgtgggccattattctgcctaccacagcttctaaatttggagccatttaatgaaaagacaaggtaagccatatgtgtgtgtgtgtgtgtgtatatatatatatatatatatacattgtttgttgggcctatacctatatttcatccaacacagtatagggtctcaaaataatttaagaacaatagaaacttaattttaaaagaggactgatatgatatctgctccaatcttctatcccttgtagttttattctcttctataatagaatctctagtttattaattttctgtcattagtttcctgtgaaggatactccctacttaacaacaaaatcagctgcattgttgtatagctatggttgttctagatcatcctatcacctagcctttacaatcaccacagagtagcacgttggtttctgacttttggaacaatgttaacctgctttttcgcagagttacgtatctcaataaatggaattactacctacatagttgtctcggcaaaatcttgggaattcttctttatcacccaccattcaccactgttgaatattcttaatatataactcctaaaatatctttcagatctgtctacttcttttaagtattttacttttcagttttagaatttaatttttttatagtttcaatttatttgctgagattctcatttgtttatgaatcaagaccatgttttctttttctgtcattgttctttatgtatgttcattttttagtttttaaatttatctatatttaactcatttccatagcttttgaggtacaagtggttttgtttacatgaataaattgtacagtagtaaagcctacgattctagtgtacctgtccctggacattgtacccaatatgtggtttttttaatccctcacccctctcccaccctctccgcttctgagtctccaaaatccattataccaagctgtatgcctttgcatacctacagcttagctcccacttataagtgagatcatacagtatttggttttctattcctgagttactttacttggaataatggcctccagctctgtccatgttgcttcaaagtacattagttcattcctttttatggctgagttgtattccatggtgtataaataccacattttctttatccgcttatctgttgatgaacacttaggttggttttatacctttacaattttgaaccgtgctgcgataaacatatgcatgcaagtgtctttttgatataatgacttcttttcctttgggtagatacctagtagtgggattgctgggtatctactttactgcatactcatttattctgagtacacataaatgtggttgtgtattaacttgtgaatgcaaaaccatctctgcatccttgggataaaacccacttgatcatggtgaattatctttttgatgtgctgttggattcgatttgctagtactttgttgaggatttttgcattaatgttcatcaggaatattggtctgtagttttctttttttgttctgttctttcccggtttgggtatcatggtgacactggcttcatagaatgagttagggaggattccttctttctcaatcttttggaatagtttcagtagaattggtaccaatttttcttagaatgtctgatggatttcccctatgaatctctctggccctgggctttttcttttgttgttggcaatttttaaaaattactgattcgatgttactgcttgttatttgtttattcagggtttctatttcttacttattcaagctaggagggttgtatatttctaagaacttatccatttcctctagattttctagtttatgtgcatagaagtgttcatagtagtctcgaaattttttttgtatttccgtgctattggttgtaatgtctccatttttatttctaattgagcttatttgaatcttctctcttctgttttgtttatatttttaaagaaccaactttttggtttattggttttttggtttcaatttcatttagttatgttctgatctttgttatttcttttcttctgctagctttgggtttggtttgttcttgtttctctagttccttcagatgtgacattaggttattaatttgtaatctttcaggctatttgatgcaagcatttagacctataattttcctcttagcactgctcttgctgtattctgaggttttgaaaccttgtgtcactattattattcattttgaatcatttttatatttccattttgatttcattgctaccgcaaaaatcattcaggagctgattgcttaatttccatgtatttgtgtagttttgagggttccatttgaagttgatttctagttttattccattgtggtctgagaagatacttgatttgatttcagttttaaaaaacttaatgagatttgttttgtggcatgtcatatggtctatcttggagaatgttccatgtgttaatgagaagaatgtatattctgcaattcttgggtagaatattctgtaaatattattaggtcaattttttttatagtgtagattaagtccggtgtttctttgttgactttctgcctctatgatctgtctagtgctgtcagtggagcattgaagttccccactattattgtgttgctatctatctgttttcttaggtctagtggtaactgttttatgaatgtgggagcgccagagttaggtgcacatatatttaggattataatgtcttcttgtgaccttttttgccccccctttttttcttactattattgctttagtctgttttatctgacatcagaatagctactcctgcttgcatttagcttccatttgcatggattaactttttccacccctttaccttgagtttattagaacccttacatttaaggtgatctcttgaagacagcagatatttggctgtgatttttttaaaatccattctgccaatctgtatcttttaagtggagcgtttagacaatttacattcaatgttaatactgagatgtgtgtactgttcagtcatcatgttgatgttgcccagatgctttgctttctccactgtgcggttgttttataggtctgtattagtctgttctcacactgctaataaagacatacctgtgactgggtagtttataaaggaaagaggtttaattgactcacagttcagcatggctggggaggcctcaggaagcttacagtcatgggagaaggaaaagaaaacatgtccttcctcacatggtggcaacaaggagaagtgctgaggataatagggaaaaacaccttataaaaccatcagatctggtaagaactgactcactatcataagaacagcagcatgggggtaactgcccccatgattcaattacttcccactgggtccctcccatgacacatagggattatgggaactataactcgggatttgtgtggagacacagccaaaccatatcattctgcctctagcccctcccaaatctcatgtccacatatttcaaaacacaatcatgccatcctaacagtcccccaaagtcttaactcattccaacattaacccaaaagtccaagtccaaagtctcatctgacaaggcaagtcccttctgcctattagcctgtaaaattgaaagcaagttaattacttactagatacaatggggatacagacattgggtaaatacaactattccagatgggagaaattgaccaaaacaaaggggatacaacccctttcaagtctgaaatctaatagggcagtcattaaaccttaaagttacaaaatgatctcctttgactccatgtctcacatccaggtcatgctgatgcagaaggtggacatccatggtcttgggcatctccacccctgtgactttgcagggtacagcccctctcccagctgctttcacagctggtgatgagtgtctgtggttttctaggcgcatggtgtaagctgttggtgaatctagcattctggtatctggaggacagtggccctcttctcacagctccactaggcagtgctccagtggggcctctgtgtgggggctatgacaccacatttcccttccacatcaccctagcagaggttctccatgagggctccattcaagcagcaaacgtctgcctggatatccaggtgtttccatacatcctctgaaatctaggcagagcttcccaaaccccagttcttgacttctgtgcacccgcaggcccaacaccacatgtaagccaccagggctttgtgcttgcactctctgaagcaacagcctgagctgtacttagcctccttttagccatagctggagctgaagcagctgggatgcagggcatcatgtcttgaggctgcatagagcatgggggccctgtacatggcccacagaatcatttttccctcctaggcctctgggcttgtaatagtaggggctgccatgaaggtctctgacatgccctggagacatttttcccgttgtcttgatggttgacatttggccccttgttacttttgcaagtttctgcagctggcttgaatttctcccacaaatttttttttctattgcatcattaggctgtaaattttccaaacttttatgctctgcttcctcttgatcgctttgccccttaggagttttttctgccaagtacgctagatcatctctctcaagttcaaagttacacagatctctggggcaggggcaaaatgccaccagtctctttgtgtaccaagagccaccattactccagttcccaacaagttcttcatctccatctgagaccacctcagcctgcacttcattgtttatatcagcattttggtcaaagccattcaacaagtcctaaaatattccaaacttctccacatcttcctgtcttctaagccctccaaatctctaggaagttttaaacttttccacattttcctgtcttcttctgagctctcaaaactgttccaacctctgcctgttacctagttccaaagtcgcttccacattttcaggtatctttacagcagcgccccattcccgttaccaatttactgtattagtccattcttgtgctgctaataaagacatacccaagactgggtaatttataaaggaaagagatttaattgagtcacagttcagtgtggctggggaggcctcaggaaactgacagtaagcaaacacatccttcttcacatggtgccagcaagaagtgcagagtgaagtggggaaaacctccctagaaaaccatcagatcttgtgagaactcactcactatcatgagaatagaagcatgggggtaactgcccccatgattcaaatacctcccactgggttccttccacagtgcatggggattatgggaactacaactcaagatgagatttggatggggacacagccaaaccataccaaggtccttgagttttatgctttcaagaggtctattatggagcatattgacctattgtttcaagatttagaactccttttatcatttgttgtagggctggtgtggtagtgacaaactccttcagaatttggttgtttgaaaaagactatttctccttaatttatgaaacttagttttgctggatacaaaattcttggttgatagttattctttttaagaggctaaagcggacaccaactccttctggcttgtaaggtttctgctgagaagtctcctattagtctgataggttttcctttataagttttctgatactgttgtctcactgctcttagaattctttccttcatgtctacttctgaagcctgttggccatatgccttggtcatgcccttttttcagtgactctcttaggagttctttgagattcttgtatttggatacctaaatctctagcaaggccaaggaacttttccgcaattattccatcaaataagttttccaaactttttgctttctcttctccctcaggaacaccagtgattcttaggtttggccattttacataatcccatatttcctagagactttgttcatttcttttaattcttttttatttctatttttgtctgattgggttaattcaaaagccttgtcttcaagctctaaaattcttctacttggtctattctactttttaaactttcctctgcattttgtaattccccaaatgtgtctttaatttccagaagttttgattggttttcctttaaaatatctatttctttagagaatttttcattcacatcctgattttttaaataaaaaaattatgttggtttttatctttctcttatatctcctcaagtagcttaataatcaaccttttgattttttttatctggtatttcaaagattacttcttggtttggattcattgctggagagctactgtgaccttttgggggttgttatagaaccctgtttcgtatttccagaatcattttctggtttcttctcttttggatagataattttttctaattattcttgaatttatttttgattctactgtgttttcttttttttccctcttgatgatgcgactttagtatttacagtttattctagcctaatgaagctcttggtgctttcaggggtgaagactctgtatgaaattcgttgattatagatagtctttgtattatggctttctcagatgttgattgtagtagcaatgtgttcagtgtgtgagcaggttcatagtctcttgtggggttgaaatggcagaggtctcttgaagcttatcttattccccagtgatgtgcacattttaatttatttttttccccagtattttacttactgggttgaagaattcaggcttcaggccagtaggggaggtgtctgtgggtaaaaaaccagtgtggccaaagcaggtgggtaaatgcaatacccagtggtgggcagaggtcctagccttgatagaggaggctgggggagctctcagtgaaacacagtgagttctctgcaggggaaatttaggcagccacattagcttcccagccaggccagcaggaaagcaatctacctcccagtcatactcctgacccagtgttctagctattcacatcagacaggtgcctctttccatctccaagaatgttgattctctaagtagatagggattgtgactctactccttgtgcaagcctgaacctggagggcactcctcctgtgaggaaggagttactctgaaccatttcagaaaggctgtctataggtgtacccacacgaagctcccatgaaagaatccccagctgtatctgcaatggtggatgagggggagaagaagtccccttctccaagacccttcatgagtaccagggctgcccaagtattggatagagctgcagactttccctgtggagtgcagcacttcacttttgcctctgctgaaagaaacttcccacaagcagaaagttctgggactcaagacctgccatctggattcttttgtcccatggggtgctcccttgatgtggtgcagtccccctttctgcaggaataggagtccctgagggccagattactgtgaatgatgctgctcctcttagtttagccacccagtggggctgtcacactccaagctggtgctagggaatgtctgcaagggttccagtgatgtgaactgtcctcaagtctctgagcagcaggtaccagcactagctctgatgcaggtggcaggggagtgacatagactctgtgagatcctttgggtatacatagccttagtgtgttggctttctcaaatgttggctgtagtagtaatgaactggtcatgtggacagaccaggaccttctcattagctagggtgatgcaggcaatggtgaaagctgaggtcatgcacaagttttctctggcctgggcgctgtgtcattttaactgcagatggtgtaatggactgtgttggttggcttctagtaggtggtggcacttgcaaaagagtgccagctgtggtggtagcagtggattttttgttgttgttgtttccatgagcaaatatacagatttattttttatttatttttaaattttaaatttttattttaatagattttaagggaacaggtggtgttttgttacatggatatgttctttagtggtgatatctgagattttggtgcatccatcacccaagcagtatacactactacactgaatgtgtattcttatttctcatcccacttccaccctttccttggagttcccaaagtccactatatcactcttaggcctttgcatcctcatagctttgctcccacttatgagtgagaacgtacgatgtttgcttttttattcctgagttacttaacttagaataatgatctccagctaggtgcagtggctcatgcttgtaatcctagcactttgggaggctgagatgggcagatcacctgaggtcaggagtttgagaccagcctggccaacatggtgaaaccccgtctctactaaaaatacaacattagctgggtgtgttggcgtgggcctgtaatcccagctacttgggaggctgagggaaaagaattgcttgaacctgggaggcagaagttgcagtgagctgagatcacaccattgtagtccagcctgggcaaaaaagagcaaaactccgtcacacacacacacatacacacacacacacgcaagaataataatcttcaattccatccatgttgctgtgaatgtcattattccgttcctttttatggctgagcagtattccatgatataaatatatatatatatatatatatatatatatatatatatatatatatatatatacgtatatatacacacacacacacaccacattttctttatccactcattgattaatgggcgttggggctgttacatatttttgcaattgtgagttgtgctgccataaacatgtgtgtgcatgtatctttttcatataatgacttctttttctttgggtagatagccagtaatgggattgctagatcaaatggtagatctacttttagttctttaaggaatctccacactgttttccatagtggttttactagtttacattcccaccagcagtgtaaaattgctcctttttcaccacatccatgccaacatctattattggcacatagccactggtctatgtgcctatttttataccagtaccgtgctgttttggtgactatggccttatagtatagtctgaagctgggtaatttgatgcctcaagaacaatatgatttattcttttcgcttagccttgctttggctatgtaggctcttttttggtcccatataaattttaggatttttttttctagttttgtgaagaatgatgatagtatttttctttgctttatgttacccaggggaggtactcagacaatggattgggacatagagctccccaaaagttccatcatttgtgttaagctactaggacacatggaggggcaaagccaagtcgtgggcgctgggtcaggcaagtatgtgttctggctctccacgtgtgggcacaagcagtggctccagaggggattgtagggcagttctctagctgctggggtaatgttccagggaggagcacaactgcctctgttgtacagaagagtcttcatggggagtggggagtagcaggtgacagtaagccctacttagctcctatgcacttggcaaggctgttttcacacttgcagtgttccactagcagcagctagctagtttccaggcagtctgcatcaggactcaaaacttccccaggccataagctttctccatggagacagaaaccactgtgcccaggccatgcccctcccagcctgccctagaagcaggggcacactgcttctgtgcttgtggcttcagcccacttcccactcacccctcagttctggccaagggagttcatccgtacttgagattatattgtgaatcttaactgggggcttctcccaacctgttgtgtccggaattggtgggttcttggtctcactgacttcaagaatgaagccgcggaccctcacagtgagtgttacagctcttaaggtggtgtgtctggagttttttccttctgatgttcggagtttcttccttctggtgggttcgtggtctcactggctcaggagtgaagctgcagaccttcgcggtgagtgttacagctcttaaggcagcgcgtctggagttgttcgttccccccagtgggcttgtggtctcgctggcttcaggagtgaagctgcagaccttcgtggtgagtgttacagctcataaaagcagtgtggacccaaagagtgagcagtggcaagatttattgcaaagagcgaaagaacaaagcttccacagcgtggaaggggacccaagtgggttgccactgctggctcgggcagcctgcttttattctcttatctggccccacccacatcctgctgattggtagagccgagtggtctgttttgacagggcgctgattggtgcgtttacaatccctgagctagacacaaaggttctccatgtccccactagattaactagatacagagtgtcaatacaaaggttctccaaggccccaccagagtagctagatacagagtgtcaattggtgcattcacaaaccctgagctagacacgggtgctgattggtgtgtttacaaaccttgagctagatacagagtgccgattgctgtatttacaatccctgagctagacataaaggttctccatgtccccaccagactcagaagcccagctggcttcacccagtagatcccgcaccggggctgcaggtggagctgcctgccagtcctgtgctgtgcgctcgcactcctcagcccttgggtggtcgataggactgggtgccgtggagcaaggggtggcactcattggggaggctcaggccacacaggagcccatggagggggtgggaggctcaggcatggcgggctgcaggtcccgagccctgccccgcaggaaggcagctaaggcttggtgagaaatcgagcgcagcgctggtgggctggcacttttgggggaccaagtacaccctccgcagccactggcctgggtgctaagttcctcattgcccagggctggcagggctggccggctgctccaagtgcgggcccgccaagcccacgcccacccggaactccagctgttccgcaagcaccgcacgcagtcccggttgccactcgcgcctctccctccacacctccctgcaagctgagggagtgggctctggccttggccagcccagaaaggggctcccacagtgcagcggtgggctgaagggctcctcaagtgccgccaaagtgggagcccaggcagaggaggcactgagagcgagtgagggctgtgaagactgccaacatgctgtcacctctcactgtgaccactgcctgtgtcagctggcagacttctgtgaggtccctcccctgtgaggtaggatcaggaatggcttccctctatctctcctggagactgggaatgcacacaaagcatgtctcaatgttactctttctcatatactccctactgctccctataacagctccagtgctgtatagggttaaggccttcccctgtgcttgggttgccaggttccccagtaggagtgtatatcctggaggtagtttatccctctctcacattcaggggacttacggttttctgcctggctcatggtgtaggctgaagcctgccacttcattcaaagggtctgtggtttcttttagttttcctgttaagttcctgtattgcttcttggagaaaagttcacagtgtgaatctctgtgcactattttgtctttccaaatggaagaagcatgccaccaataactccaatctgccatcttggaaaaaaatgtacatatatcaagacgatattttcatttcattctttgaacatattttctcttaattccttgaacatatttaaaatagctgtctgaaagtcttctgtaaatccaacacttgcggcatcttgggattggtttctattgattacttttttaaaaaaaactgtggatcacgtgttccttttttctttgtggatctagtcatttttttattgtatgagggacattgtagacaatatattgcagacactcaaatctgttatttttctctgaagagtttcatgtgtgtgtgttttgtttgtttagaaggcagtagaattattggctgatcacattgaacttagataggcatggttttatgctttgctggaatggttctgtggaaagctctaggtgctgcctaagcccctataaattactaggacttaacttacaaattacttcctctgaagatcttgtcaagacttagttctaggcttttcttggactagtttagtctgtattcatagggcagtgtttctctatcttttttttcattactataaaagagatttttaagacatttttttcccagttttgctcccccctcctccatgaagttttaataccacagatataactctatatctgtttatgtactgtggttctttgaagaggtacaaagcattgtaatatctaagattctttttgctccccgcctccctgccaagaactaattttcatccgttggggatgatattccccttgttgcgaatgcattttctatggtgtggtcctaaggtaaagcctttctgatatctctgctggatgctccaaagattaataaggtgttcatgggttttttttttttcttccctggctgtgccagaatgccagtatcttccaacaatgctcaaaatctcatacatcttttatgtttttaatcctatagcagccactctataagctttgggtagtgctgtcctgcccacgtacagcccatctctcagcaatgtacttgcagggggctcctacacggactttgaggaccccatgttgcatggtttcttcctctctggtgccctgccctgcatgttttaacttttagcactttgaattctgccttcttatctcagtaagactgctgtcctctgcttggactctagctcactttactgtggttgggagttgtcctggcacaaagagatgggaaattgggattactttgtgagtttttattctctcagagattgcagtcttacactgcccccttcccaatgcctgaaaatagttgcctgttttgcccagttttatggttctgtggtcatttatggagggacagtacacctataccaataactacagtttctctgacttcttttggaagcagaagtcctccttctactactttcaattctcatctgcacctagtacaggtgataagcattctatcagaattaggacaataattttctaacaggtcttctgatctccttactttcagcctccatactacctccagagtgaactttttgaaacacaaaaacacaaatctcctgtcattctcctgtttggaacccttattaggcactcctttatccttaggataaagttcagtcctttaaagtagctcacaggtccccctctatgatctttcttccagctctctctccagccttggctttcactctcgaccttgaacctttgtgcatgtcatactacttttttcagtttgtcatatgtgcagtggttttacttgcctccttgcctttgcacatttatttttctttttccggaattcctactctgtctccccactttacttggctaactcttgctaatcctttaggttgcagcacagatttaacttcttctggtagtcctataccaggatagaggccctgttttatgtttcatacactaccctggtgtcattattaacagttctttttttcttttccttacttccacaagaaataagctctataaaggcagggattttatttgtcttgtccagtgctatatccatagtgcttagtacaatgcatggttcacaagtaggtattccattaatatttatttattgaatgaataaatagagatagtgtttattccctttttcatatgattgctctttaaatatataggataactcttgtgggttccttatgtctttactttttgaggctacatattcagagatcataaaggaaaggtttaaatatctatagcaggagttggcaaactatggccctgggaccagatctggcctgctctctgcttttgtaaataaggttttattgaaatataaccataccagttttttttttcacatattatctatctatggctgcttttgaactaccatggcagaattgcgtagttaggatagagacatatgacctaaaatatttactttctagtcctttacagagaaagtttgctgaccactggtctacatgaagtttcctatgcatcctcaatttatttaaatgaagaagcataggaaagtatgctagagtatatgttgtaagtgatatactaggctagtctgaggtcagcaactaaccttaaaatcttagtggcttaacacaacacagatttatttctctctcatgcaaatttctttgatgcttggacaattttccagtgtactcctctccgtatagtgacttagagatccaggcagcttccattttgtgttccatcaaatcatctattttcttgatttccctggcgcaggaagaggaagctagagggcctgcaattcttgggactgaaagtgacacatagagcttcttctcatagctcattggccagaagtagtcatatggccctgcttagtgaaagttggttggaaagtaaggaaagacatataaatatttaatgagcgatgagcatctctgccatagaaagattgccttaaaatgattaaatgcttgttttttggggaaagttttcaacttaacattttcagcttcagttatcttgaacatgcaatccttccaagtaacacattataattatgtttttattttacagataccataccccgaatagtaaaatattatcaaaagtaaataggacaaggatttttttcttaaaaaattgggtctactggtttttaaaaattggattttatttaaaaaaattcactgacataattttctaagaatatatcaattaagcaaattaaataaaatacagtaatggttgaaatggcctgaaggatctccctgacacaaggggatccttttataaacacttacatggagactgaaaatttatcctgctaatggagtattgttatttagagtggtggtttttcactactccctccacccctttggtttgttttatgtgatagaaccctcttaggagagagcccaatttataaaacatacaaaaaggagctattgtgtctgaagaaggcttgcgttggattctgtctactcaatctctcttttattacccccatctctccctccctaaatgagtacctttttagtatccttgaggactgaaaaacactgctttaagcatctataggacataatttcgagctgtagaaccacagattttagaactcaaagggaatttagagaccatgtactctaattttactatgatttagtagatgttggttagcaactgtggagctgcaggacaacaaccaacttgtgtgcctgattttctaaaaaactaggggcatctcaaacaaaactaactctaaagtgattatttattcccaagagacctcttatattaggggaagactaccaatttacatcaaactagattccgaagggcattttcaggatctgtacttttcattttaatataatataatttttaatatataagtacccaagaacctaccctaaacaaaatctgggatcttgacagtaatctgtctttatacctcaccaacctatctctctgcctacccctatttgaactaatcatcattctggaccctatgtttctatttgcttgcttttctttttatatagttttattgcatctgtatgcattctctctctctctctccctgcccccttgctgtttttaactaaaaaataggggattgtgttgtttataatcttttgaagtacatttttaaaattcagtattatactgctcagaatcatccatattgttgcatattatagtcattcataccttttgactgctctgtaatattcaatgtgtgaatataacagcttgctatggcttgaatatttgttctttccaaaactcatattgaaatttaatccccaatgtggtggtatttagaggtggggcctttaggaggtgatttgcagtagtatttctgtgcataacattcaagctgagagccaagtcaagaatgcagtcccatttagagtagacacacacacacacacacacacacacacacacacacccctaggaatacatctaacaaaggaggtgaaagatctctataaggagaaccacaaaacactgctgaaagaaatcatagataacataagcatatgaaaaagcattccatgctcatgaattggaagaatcaatatctttaaaatgtccacactggccccaagaaacttatggattcaacattattcctatcaaactaccagtgtcatttctcacagaattagataaaaacaattctaaaattcatatggaaccagaaaggagcctgaataaacaaagcaatcttaagtaaaaagaatgaagctagaggcatcacattatccaacttgtttatactataaggtagtggtacaaaaacagacacatacaccaatgaaacagaatagagatcccagaaataaagctgcacaactacaaccatctgatctttgagaaagtcaacagaaataaacaacggggaaagaacttcctattcgataagtggtgctgagataactggttagccatatgcagagaatgaaactggatccctgcctttcaccacatacaaaaattaaccaaaaatggattaaagacttaaatataaggcctcaaactgtaaaagtcttagaagaaaacctaggatgtaccattctggacattggctttggcaaataatttttggctaagtcctcaaaaacaattgcaacaaaaacaaaaattgacaagtggtacctagttaaactaaagagcttctgcatagccaaagaaactatcaacagattaaatagacaacctacagaaagggagaaagtattcataaactatgtatccaacaaaagtctaatatccagactctataaggaacttaagcaattcaacaaaccaaaaactaataacctcattaaaacgtgggcaaaggacgtgaacagacacttatcaaaagaagacagacaagtagccaataaacatatgaaagaaatgctcaacatcattaatcatcagagaaatgcaaatcaaaagcacgatgaaataccatctcacactagtcagaattgccattattaaaagacaaaaaataacagatgctggtgaggctgaggagaaaagggaatgcttatatgctggtggtggaaatgtaaattggttcagccactgtggaaagcagtttggaaatttcccaagaaacttaaaacagaactgccattcaacccagcaatcccattatttggtatatacccaaaagaaaataaatcattttaccaaaaaagacacatgcactcatatgtttaccatagcactattcacaatagcaaagacatggaatcaacctaggtgcccatcattggtggattgtataaagaaaatgtggtacataaacatcatggaatactacacagccataaaaaataaataatgaaattgtgttatttggagcaacatggatgcagctggaggccattatcctaagtgaattgacacaggaacagaaaaccaaataccacatgttctcacttataagtaggaactaaccatttggtacacatggacataaagatgggaaaaatagacactggggactagtaaagtgggtagagaggcagggggtcaaggggtgaaaaattacctgttgggtactctgctcactacctggataatgggatcattcgtaccccaaacccatgtaacaaacccacacatatgccctctgaatctaaaataaaagaagaaattatagaaaaagaagtgattgggtcatgagggttctgtgctcattatggattaattcattcatgaattaatggattaatggtataacagattgattgcttatcatgcatattagtctattcttgcattgctataaagaaataactgaaactgggtaatttataaagaaaagaggtttaatttgctcatggttctgaaggctctacaggaggcatgatgctaatatctgcttggcttctgaggaggcctcaggaaacatacaatcatagtggaaggcaaacagcgagcaggcatcttacatggcaggaacaggagcaagagggcgaggggtaggtgctacacactcttaaatgacccatgagaactcactcactatcttaaggacagtgccaagagggatagtgctaaaccattcacgagaaatccacctccataatccaatcacctcccaccaggccccacctccaacaatagcgattacaactgaacatgagattgggtgtggacatagatccaaaccacatcatcatgggagtgggactggtggctttttgagaagagaaagggagacctgagcaaacacttttgacctccttaccaagtgatgccctttgctgccttgggactatgcagagagtccacaccagatgtgacctcttgactttggacttctcagcctccagaactataagaaatacatttattttctttataaattacccagtttcaggttttctgttataagcatcagcaaatggactagtacatagtttattcatcctcttttctgttgatgggaaattgggttatttctaggttattgctgttgagtacagtgatggctatgaacattcttgtgcatatctctttttgtacatgtgcaagaggttcttttgggtatacacttagtgactaaattactgggtcatagagtatgtgagttttccactttagggagtaataccaaatcattttctagccctttagccaatatataatggaagcaacagcattttttttcttttcttatgaaagagcaagcagctatttagtcctgtccctacagttcccatttcgttttcactgggacctgcattaaaacacatctgagggtgtctcactttgaaaacaggtgtgttcaatcatctactttcaccttaggtcatcctcagtctagttagcagtccttgctcctgacataaggtataaaaacactctcaggaccacttcaggttttatctcatctcactgctatgttctgtggcagtaccaccttgattttcctagctgctttagtccttatggttcttttacatctcacctagctttctggctttaaaatccctagcttgcacctacatgttgaggaaagataactcttaggcctccctgacttccagattccggattttttttctcacctttgacagctgagagctccttaaacgatgggtgacacattcaaatgcttatataggccagggtgggagcactaatgagtgactcaggattccaggattaatataacactatcaggagcagtgggactgtggtggcctgatgatgggggtagcttctccttatggggttgctcccaggacttctgatttttccagagaaaaatagttatctagatttttaactgaaatctcttgacctttgagtgtcaacaatagatttaatatttagaaacactatgcaggccaaatgaaatatttctgacctggattcaacccataggtcgcccgttggtgaactttgcctcaaactttggcttatctgccttttgctttggccattgcctcacctgcctgttcctgccaaggtgtgcccctctctctggaggagacctcattgtgacatctctcaggtttaccttgacttccaagtgacctgatactgacagcaggcagggcaatgtctgattacttaccctttcctttctctcactgcttgccttaaatgcttctatcaaattctggttcttggaggcctgacttgttttgataatttttagaagagaaatgttatatggaatgatatttttttaacttgaaaaaagtatgacaagaggccaggattttattatttaatggctctcaaacttatttgcagttttagggcttctctgcttgatcttgctctggtgttgatcaggtggccctgacttcactggatgctggatttgtccctactcttgtcctaatggattggtgaactaaaacagcagttttttgatttaggaaaataaggtctttgactttcccccgtcttagaaacggtcacaatattttgatttgagattctaggcttttgagcatttgagaatatccttctcaaaacagaaaacctttgctttctttgcaattatttggcacattctaagggtggatatggtcagtatccagttgggaaataaagaaagtgcttcataaatcacacaactttttctgttgctgagtcagtatcagacacagatattttctgagtcaagcctgctgttctgtcaggtgggagattatgggtaaggtctgagattgagtggagttcgttagagcaagatgctaatgagcacagggtcatgggtttgatccccatacaagtcgattagcttaaaccataaagggactcctggctcatccatcctggcaaatatgtggtcacaggcctaaggaagactaggttagagagtgagaaaaatccttcatcatcaagaggaaaaaaaacaaacaaacctcaaagcccatgtcctattggatgtagtaagtgatatcatctgtggttgtagtcagtgcctatattacttatatgtagggagaagatttgcatcccattaaatctcccaaaatatgtaatatagcatgcatgaggttaaataaccaatgggaactatagtgacatccaaaaactctcgcaagagaagtcttatagctaactgagatggggtggaacctccatggccatggtggaactctgtgactgtgctgaagacctcttgtgcaattaattccttgttgggcatgaagccatgcacatataccctaagacaatgctgtcttctcctggaggatggataaaagggcagagaggattgtgtgagggcctaggattgtagccacttgtcctatggctgtcttattcactctgtatatttgcacaccctggtttcacattatctgagtgttttcctatggaaagaggttttcctatcttcattataagaaggacagtattttctagccatacccatttttcaaggatgatctatttaaaaattatttttcccaatgaaaaatttcaaatgaagtaatcagaatagaataatgaatgtccatatacacatcatctggatttaacaattgtcaacattttgccatatttgcttcattattttgtgtttttttgctagtgttatctcacctttacatatttttcttaaaaatgacaattttctgcataactgtaatactattatcactcccattaaaattaactatataatttcttaatgtcctgtagtactgcaaattcaaattgctcaattgtccccaaattgtcttttgcagccagtttgttcagtcaggatctaatcaaggatagtgaatttcttatgtgtgtgtgtttgtgtgtgtgtgtatgggcatgtgacatggagctgtggaagagacaagccagttggtctgtacaatgtctcatcttttggatttgtctgagttttcaggatgagttttgaagatttgtatttagtgttgaaaatgggcttgggtctggagattggcagtggccaggacaccctgtacagggaggaccttcgaaaatgagggaggtaaacacaaaggcagtaggaatgttccatatttttgtgtcttgcttcccagcagggctgacagacacaaactcatgtgaacacacagggacatagacctttataaaagaactgggtaatgtttttctctttgccaggccatagatagcacagaacttgaggatatgataatcctattggctgtatattttgaatagtgtatcctgaataaacaagataaaaccaagaggcagaaaaatgaatagaaattaaagctatgagaaagtcatagaaaattcttagtggtctgacattttgagtttgttcttctttggttaagttcactcatctctcttgggagtagagagaacccatatttgggataaacaactgcagaggaccaagagtcttgggagaagctgatgacaggcattcagaggtaagacttgggaagaaaatagccacagaaggaaagtacagggaggcaaacagtgggaggggccagctcatctcttttctccttccccccaaagactgctggttgtcagtgggcctataaaatcttttatgatcttaaaggtattttggaagactaagtcaatctttagcattcttaacctggagcaggggttctgaaacttgaactggcacattggcatcacctgggaactctaaaacacactgatgtctgggtaccaccctcagaaattctgatagaatttgtctcaggtgtggccagggcaacgggctttttaaaagactttccaagtaattctaatgagtatctaagtttgaggaccactgatctagatcaattaaccatacatacatatatatatatatatatatatatatgcatttttttttaaaaagatacatttaacacctccccccacccaataaaccttatggaaacccaatgcataaaaaagattaaagtggaggtgctttacataaggtgctcttgaaacctggctgagtaggcaccatttgctacacccactccccgtttctttcaaaccctctcatcttcctacagcagtgtcttcaaagaattagggtctgaagagtaggactatttgaaaaataactggtccagagtttaaagggttttaaccatctacatctagaactctggctctttcaattaacttattaactgtatgactttggacaactataaactctctgaacctcagttctcttatatcttaattagagatgatacctatctcacaggttgtaatgaagactaaagttggatatatgctagtgtactgtcagtagagattagttccttcagtagttcaggctttcctccaggctactgcaagctttcaggtctgtcctgggatgggactgatggtttggtttaatctgggaacttcagttaccttcatattatactcatatggtagggtgtacacagattccctttactcatgaggggtctaaaattcctgattgacttgcagcatcataggaataaatggaggtgggatgggggtggagtttgttcactgctgaatgctaagggagaagccaggagcttccatgaaatgactcaggaaatgctctataattcagataaactgttaatcaatggggagggaaccaggcaaagtccattttaaaatgaaaaaggtattaagatccataataggcatagtggaagggctgggggtgttgaggtgggaaggagttctctatggaccagaggagcaggttcatgactgagggaggagttattgattttttttgtaaacaatagatttttaagcaggaatgaagaaacatgaacatattcttccctatttttttgttccaatatggttaaacaaaactcccagataatatagaaaccttgcttattccccttatgaatattttaccagtattgctaagaagtgaaattgattgatattaatttaacttcctcctcttcccacccagacattagtaaatagtgaaatggttgtaagtgttcagggagatgacaaaagagaagtctgaggcttgaggaattacgaagtcagatgatctgtaattgaataatattgagtagaatacacaaatcaaaagtggtgtaaaatctattacaggaaaaactcatttgagtctggccctgtcacagtcattgaactagtgattcaagtctgaacatggccagcagtggtatttcctgtttatctttcacaaagctggcaacaatttccacattatgttctctgcacatctccaacctctacggaatgaaaaatgcattttagtttcctcagcattcacaatgtagaaccttccagagaagctttcttttctttctggcatctggataaatggaggaatagcacgaagcggtaggtgcttaggccaattaagatgtttggtgggctcagtggggatgacccttagtctttaaaacatttttttgtaattatcttattcacatattattatccaaaataccatgactgtggttttggttgctactgcactttaatatagtagatgtatttttactttctatttttctttttttttctttaaagatttccattcttaatagatgagaaaaaaaattcctaagaagtaaaatgttaaagatgcttatttgggatcataggatctcttttagcaatttgcaatctgaagcggagaccacacaatttctggccacattgggatactgtctatactgctgcctctttctcacattatcttcctgctatctgacatacctatgctcacatccaggtactgaacaggggccctacatggctctgaggtaatcagagttcacttgtccacaacttgccattgaaaggctatgccctttagaatttcgtattctgaagaaaatttctattttttttaaatgtttcaatgttagtgagttgcctgaggaaagaatgtgataaaggtagttctaatcaaggtatatgtgagagactaattaatggtaggactcaatgttttatcctgatatgagtatactcatttcaaaaggagtctcctgtaaactccagctaaacaaacacaaaggcattttcaggatttcaggtatacatttgatggctggggcagagtggtgtatagagtttttcatgtagaccctcctcaaatctcaacacatgacttctatttcaaatctattttaaagaccagaactatttaaattttaccctaacatgactaaatttactttcctttatacctccacattgccaggacatttaaaagcctcttccaatcctaccaaagataagacactgatgacatctcatctcctgcctaacttgtgactattctcagtattggtgaagaggtgaaatttgtagatgagggattttaatccttcactttgtatttgatacatgactttatgtattatggtgctgatttttcagcacatctttattttcccttttccagttttaacaatgaacttttccaatctatcgttacttagtgaagacggttaatagtgaatacatggttcaggtatttcttttaacagccctgcaaatagaaatacagtgtaagtcccatatatgattatatattttcctataatcacattaagaaaagaaacaggtaaagtaaaattttaataatacatttaatccaatatgtcagaaacattatcattttaacatgtaatcgtgtaaataatgaggtatctcatttttttcctgaaaaaaaatctttgaaatctgggatttctttgaaatctaggaggtattttacaattacagcctatctcaatttgcaggccatattgaagtgctcaatagctgagtgtggctaccatattcacagccttagaaaattttgagtaagatgaatataagctgtgaacccgtacttagtttcagttagactatcttctttatgaaaatgtttaaatctaaactaatttttctccccacatatgcttctctgctagtgttctccaattcagtagttggccctgacatgcctgtcatatgtggttttaaaggcagaacatggtagacctctaagaggcattaattacagtgcgcacagctgtatgtagcagtatgggctcaataacactacttagttgtccatgccagaaaaagagttatttgagacacatcatcttcctcatttctacactccatcttccaaaattgtctttcactaagtcctttcagttccacctccagagtacatctgggaccggatcacattactccatctctacaatcttctctttaagtaggctgctacctcctagatggctgcaatagcctctaacaggcttcccacatcctctttggatattctccagtccattctccatgttgcaacctgttttgtgaaaggcaaatctgagcatgccacactcccacttaaaatcctctgacaggctgggcgcggtgggtcacgcctgtaatcccagcactttgggaggcccaggcggacggatcacaaggtcaggagatcgagaccatcctggctaaaacggtgaaactccatctctactaaaaatacaaaaaattagctgggcgtggtggcaggcgcatggagtcccagctactcgggaggctgaggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaaaatcctatggtgacctacaaggtctttgtgatctggctctatttatctactactccttccttctttattttgctatgctactcgctcttcctgtgtgaggattttcacatactctcttacttttatctgcagtgcttgtttgcatgctctctctctttctctctctttctgtttctctctctctgcctggctaacctctttttgctgttctgcttaaatgtgactttttcaggaacaccttctctaacttccttgacttttgggccccatcctgtatgtttttatatcaaacaggaccactatgtttttttcaggacacttatcacaattttatctatatgattatttgtgtaattttagtatattatctgtctccactgatgtaagcttcatacaaatagagaaccaaatctcccttgtttattccttttatgtctgtagtactagcctagggcctggcatatattaagccttcaataacttccagctgaatctgcgaatgcatgtgctcagcccattgtctgtagcagcttggtagttttaagaggcttctcaagcttgcagaaacccttgtgggtatgactaagtgttccagcttctgtttcattgtgaagattttagaagtgtagcctttaagaggcatactacaatccttccaaaaacaaagaaagtctgaaaataaatttgggagaggatgtggaacaaagtaatttctacactaataggaaaaatgcaaattggtgtaacttctttggactgtgtccccaaacaaaagctgggtcatgtcaactggctgttattctgtcttcttggttattgggtgtttctttgtgggggtattccttctagtgggtcataacatatgccataaaaatccacattgtggccacttccatagacccatctgcagacaggcctttactcagatcttcttgtcccagatctttcaatctttcttctttcaggtgcctgcccaattagccagggtattcttcactgtttattaatccttatatcttctaacagcaagtcacttcttgtccacacaaagaggatgatttagtatactgccttcgtccattgggaagattttcccctcttcgctgtctttcgaggccatccctaagggagggttgttatgcaacagcagtccatttttgggtcacaccgagatactgagctgattcatttatgagctagttttccctctttcagctggccattagggactcaacacagggctacaggtatcgtttgaagagaaatggatgatatgggtttgacagtcatgcaatttgcttgtgccccctggccctgcctttgtccaatcctggaagtatcatttccatcttatgatggagtactaccagacctgcctaatcatatgaattattgcatttgttagaactcagcttaatgtggttatttcttattgtagggtaacttgaggttctatggtcagatgctcagtctctactagggctcagtagtattccaagagctgctgtttgaatgttatatagttcctggctgaagatggcatgctttgttttagaatcctggggaactgcttatgttatgattctactatttctttctataaaatccacatggtgtcttttcaaaccacagaaaccccaagaaccaaaagttttgccgtatcatattgcataagtcatagggtcacttttatgacaacctgaacctgctggagagccctttggtgttttgagctccactcacagctggtaaatgtgtattgttgcctaacctatgtaaatgggtactgcttctgatcttcttactgatagggatggaaaagaatgcatttgccagataaatggctgcatactacatgtcatatattgtgttaatctgctgtaatgaagctatcatatctggcccagcaattgcaactgtggctactacttggttattatagaatgttgtagattttatttctttaataattaatggacattagagattttctaaatctttaatttctaaattagagattttctgaatctctctgagcccatattggtagttcatactttcctaggaatatgtctatttcacctaaggaatttagtaaatttctcttattacctttttaatatctgctacatctgtagttgtgtccctttttgattcataatattatttgtgccctctttctgtatttctcattcacttttgccagaggtatgccaattttattagtttttgcaaagaaccaatatttggctctgttgtttccttctagtctatctttgctttctgttttattaatttcttcctcttgtctttatcttctcaatttttatattattcctatttgctcttttcttaacttttctaagttgaaggttgtattagtcagggttctcttagagggacagaactaataagatacacacacacacacacacacacacaaaaaaaaactaataggatatatatatgtatatatacacatacaaaactaataggatatatatatatatatatacacacactcacacagaactaataggagatatatatatatatgagtttattaagtattaacttacatgattacaaggtcccacaataggctgtctgcaaggggaggagaaaggagaccctgtccaagtcccaaaactgaagaacttgtagtccattgtttgagggcaggaagcatccagctcgagaaaaagatgtaggctgggagactaggcatgtctcacctttttcacgtttttctgcctgctttatatttgctggaagctcattagatagtgcccaccagattaagggtggatctgccttccccagcccactgactcaaatgttaatcacttttggcaacacccacacagacacactcaggattaatactttgtatccctcagtccaatcaagttgacactcattattaaccatcacagaggtttagcacattaatttttcaccctttcttgtttcttattataagtatttaaggctataaatcttcttttactttggatttaaaaattatgtatatttaagttgtaaatggctctaaatctgtctctatctgcatctcacaattcttgatttgtagttcttttgttatctttcagttgtatgtattttctattttttagtattttctaatttttattcttctatagcccatgagtaatttagaagtatgtttttgaattttctaatgtgtaattttgtttgatagttcgttttgctgctgattgttaatttaacttttttgtcagatattgcaatgtatgagatatagattctctgaaatttgtcaatatctattttatggcctgaaatgtggttaatttttataaaccgtgtgtgcttgaaaagaatgtgtattctcaagttgttggatgcattgtttcatagacacacattaaattaaccttgtgctgttcaaatttttatatcattattgatttgttgctgtttgacatatcagttagtgaggaggtatgttaaaatcttccatttatgtggatttgtccatttctctgtagtccagatattttttgccttatactttgaaatgtgttattaagtgcatatatatgtaaattgtttttttttccaggtagttattcatttttattttttatttttttattttttatttatttatttttattatactttaagttttagggtacatgtgcacaatgtgcaggttagttacatatgtatacatgtgccatgctggtgcactgcacccacaaacttgtcatctagcattaggtatatctcccaatgctatccctccccactccccccaacccacaacagtccccagagtgtgatgttccccttcctgtgtccatgtgttcttattgttcaattcccacctatgagtgagaatatgcagtgtttggttttttgttcttgtgatagtttactgagaatgatgatttccaatttcatccgtgtccctacaaaggacatgaactcaccattttttatggctgcatagtattccatggtgtatatgtgccacattttcttaatccagtctatcattgttggacatttgggttggttccaagtctttgctattgtgaataatgccgcaataaacataggtgtgcatgtgtctttatagcagcatgatttatagtcctttgggtatatacccagtaatgggatggctgggtcaaatggtatttctagttctagatccctgaggaatcgccacactgacttccacaatggttgaactagtctacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcctttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatgtattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagcctagtagtatagtttgaagtcaggtagtgtgatgcctccagctttgttcttttggctcaggattgacttgatgatgcgggctcttttttggttccatatgaactttaaagtagttttttccaattctgtgaagaaagtcattggtagcttcatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctttttaaagcaattgtgaatgggagttcactcatgatttggctctctgtttgtctgttgttggtgtataagaatgcttgtgatttttgtaccttgattttttatcctgagactttgctgaagttgcttatcagcttaaggaggttttgggctgagaagatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttatgcatctattgagataatcatgtggtttttgtctttggttctgtttatatgctggattacatttatagatttatgtatattgaaccagtcttgcatcccagggatgaagcccacttgatcatggtggataagctttttgaggtgctgctggattcggtttgctagtattttattgaggatttttgcatcaatgttcatcaaggatattggtctaaaattctcttttttggttgtgtctctgcccatctttggtatcaggatgatgtcaggatgatgctggcctcataaaatgagttaggaaggattccctctttttctattgattggaatagtttcagaaggaatggtaccagttcctccttgtacctctggtagaattcggctgtgaatccatctggtcctggactctttttcgttggtaagctattgattattgccacaatttcagctcctgttattggtctattcagagattcagcttcttcctggtttagtcttgggaaggtgtatgtgtcaaggaatttatacatttcttctagattttctagtttatttgcatagaggtgtttgtagtattctctgatggtagtttgcatttctgtgggatgggtggtgatatcccctttaacattttttattgcgtctgtttgattcttctctctttttttctttattagtcttgctagcggtctatcaattttgttgatcctttcaaaaaactagctcccggattcgttaattttttgaagggttttttgtgtctctatttccttcagttctgctctgattttagttatttcttgccttctgctagcttttgaatgtgtttgttgttgcttttctaattcttttaattgtgatgttagggtgtcaattttggatctttcctgctttctcttgtgggcgtttagtgctataaatttccctctacacactgctttggatgcgtcccagagattctggtatgttgtgtctttgttctcgttggtttcaaacaacatctttatttctgccttcatttcgttatgtacccagtagtcattcaggagcaggttgttcagttttcatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattaagtaatgtccttctttgtctcttttgatctttgttggtttaaagtctgttttattagagactaggattgcaacccctgcctttttttgttttccatttgcttggtagatctttctccatccttttattttgagcctatgtgtgtctctgtccatgagatgggtttcctgaatacagcacactgatgggtcttgactctttatccaatttgccagtctgtgtcttttaattggagcatttagtgcatttacatttaaagttaatattgttatgtgtgagtttgatcctgtcattatgatgttagctggttattttgctccttagttgatgcagtttcttcctagtctcgatggtctttacattttggcatgattttgcagtggctggtaccggttgttcctttccatatttagcacttccttcaggagctcttttagggcaggcctggtggtgacaaaatctctcagcatttgcttgtctgtaaagtattttatttctccttaacttatgaagcttagtttggctggatatgaaattctgggttgaaaattcttttctttaagaatgttgaatattggccctcactctcttctggcttgtagagtttctgccgagagatctgctgttagtctgatgggcttccctttgagggtaacccgacctttctctctggctgcccttaacattttttccttcatttcaactttggtgaatttgacaattatgtgtcttggtgttgctcttctcgaggagtatctttgtggtgttctctgtatttcctgattctgaatgttggcctgccttgctagattggggaagttctcctggataatatcctgcagagtgttttccaacttggttccattctcccggtcactttcaggcacaccaatcagacgtagatttggtcttttcacgtagtcccatatttcttggaggctttgctcgtttctttttattcttttttctctaaacttcccttctcgcttcatttcattcatttcatcttccatcgttgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagcttggagtaatttgatcatctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttcttagttttctttctaacggacaggaccctcagctgcaggtctgttggaataccctgccatgtgaggtgtcagtgtgcccctgctggggggtgcctcccagttaggctgctcaggggtcaggggtcagggacccacttgcggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctcctttgtttacccaagcaagcctgggcaatggcgggcgcccctcccccagcctcactgccaccttgcagtttgatctcagactgctgtgctagcaatcagcaagactctgtgggtgtaggaccctctgagccaggtgcgggatataatctcctggttcgccgttttttaagccagtcggaaaagcgcagtattagggtgggagtgacccgattttccagatgccgtctgtcaccactttctttgactaggaaagggaactccctgaccccttgtgcttcccgagtgaggcaatgcctcgccctgcttctgctctcgcacagtgcgcgcacccactgacctgtgcccactgtctggcactccctaatgagatgaacccggtacctgagatggaaatgcagaaatcacctgtcttctgcgtcggtcatgctgggagctgtagaccggaggtgttcctattcggccatcttggctcctcctcctagttattccatatgtaaattgttatatcttcttgatgaattgagatttttatgtagtcatctttttttatcaataatccttttgccttgaagtctattttgtctcatactaataaaactgtaccagtttttaaattagtgttttcttgatttttctataaatttgacattaaatttttgttttattttaaatttttgtatgttaagctttagatggtgtctcttgcaataacttagagttgtattttctttttaatccagtctgacaatatttgtcttttaaccaggtaatctaggcagtttacattgatcatgattaatattatatttggattcatttctatcatcttataatggtttggactgaagtgttgatctggattgttgcacatcccttggttgaaagatgttacagccactgaatcacccaatcactgatccacatcctattattttgaactatccctatggcccccaatagcatagtgacttagggttaaatggcagtgtaaaaggatacaggaggctgggtgcagtggctcacgcctgtaatcccagcactttgggaagccaacgtgggtagatcacaaggtcaggagttcgagactagcctgaccaacatggtgaaatcccgtctctactaaaaatacaaaaattagctgggcatggtggctcatgcctgtaatcccagctactcaggaggctgagacaggagaatcacttgaacccaggaggtggaggttgccgtgagctgagatcacaccattgcactccagcctgggcgacagagcaagactccatctcaaaaaaaaaaatgtatacgggaactggagatggtaagtgggctgaagagcagtttcaggaaagaagttcatcatcatcctatatttaaaggactatgatatgtgtataaaagagggattaaaacatgagcagcaaatgacagaactagagcaaatgagtggaataataccttattccttgagcagctgttatgtgccaggaaaattgctaaatacttttcacatatagcttaattcatacaacaaaccactgagggaagggctcatcatccttatttcataggtgagaaaaatgaggctcagagagattaaagaagatacttgaagtcaaacaactagtaactggcagaattgggaatcatactcaattttgtatgactctaaaacccttgttctttttactgaattacatcacagagaggtgaactggtaaataccaaatgaaggaagaatactttttataattaaaattcataaaaaagtaatgaactatcatttgaaatggtaagcatcccatcactgggcatttctaaacagaggtaatgtggtcatgtgtcaggactgttatagtgagagttttactttgagtgggaagttgtactttagaacagacgcttggattagatggtcattaattatggtctatttcagtttccatgaggttattgaaactgtgccagagcttaacaaatgcatgattttcaaaactctccctaccttctgaaactagccgcaatgtgaacttgtcctttcttcacttagcctccttaactcactgcagtgttatgtgatgtgtacaggtggggactttaataaaaccctatttgatgatgacttgatgaaagtctatttggcctgtttagataggagaaaaacaagtcatgtgtataagtgcagtgtaaggttctttaatttgaaatactggagccaagcaatgcaaaagctgagagactccatttaatagcatgttaatatattaaaacccttaataataaattcatagcacttaaaatacaaatatttctacaatgtaatattattttacagatggtatttagtaaatagccagtatttactgggaagtggggaattcattgtcctttgtgccttgctttgttgacacattctaccatgtgaaggccaagagcccgtaagaatagaaaaacctttctgtcagcagcagcctcatcaagctggtccctctgtagactctgctctgtccacttattttctttatccttactgctaatccatcaagtaaccatttcgccttcttttaaagcccagccacaagcattatttcttcccggagctttcattgacctgtgcctctccctgcactgtacctctcgaggtatccagtagtggcagttgaagtatatgaagaaggattttatacattatttacttttgttctgagtagttcttttaaaccttgtgaaagcaatttcacaagtgtttcctatagtattgctctgatgtggataggaaagacctcattatagcctttggacatgaagaaactgagacatcaggaggctgagaattgccaaatagtggtagagttttagcatctttcagctccacagctctactagccaaatgtgcgttccaaaatatttcccacaggtttctgactcttggattttaagtagtatgttatggctggtacctgggatttggtgtatttaaaatttgtttgggccagtcgcagtggctcacgcctgtaatcccagcactttgggaggctgaggcgggtggatcacctgaggttgggagttcgagaccagcctggccaacatgttgaaacgctgtctctactaaaaatacaaaaattagccaggcatggtggtgcacacctgtaattccagctactctggaggccaaggcaggagaatcgcttgaacccaggaggtggaggttgcagtgagcagagatcctctcactgcactccagcctgggtgacagagcgaatctttgtctcaaaaaaaaaaaaaaaaaacactgtttgactcattatttgaatgggccaagcaagggctgaccaatgcatagagagaagtatggttattgaatccctactagaatgtgaacaaattttgagaaaggcctaccattgaggtgagtgtgctgtaacctgagcacgtgagaccaaaaaaacacctgagaaaaatttttgctttcaaaattcatccatgtgactctatagattggatattctggtttcatccatttagccccaaactgacagagggttgtcttgggcagtcagagatgtgtagtgtaaagattattgggcactacttaggagccaaaggttctaattatggagcgtcttaagattagattcatcttttttactttcctggcctcagctctctcttatggcaagtgaggggtttgcaatgaggtcagtggttctcagaccatagcctttggagtacatggaccagaatcgccaggttatttgttaaaagttgagatgctggactccatctaggcctactgaattggaatctctggagtggcacttgtttatctgccttttgacaagctgaccaaatatgcacactaaagtttgagtacctctggatgatgtagattctaaggttccttccagctctatgatactttgaatgagaaagacaaagacagacagcaattacggatttcatttcaggtttctttactattctttaatgtcagagcctttagtgattttaaatttgccagaaatcacctaattagcatgtgatgacaatatactattttcattttttatgtctgcctcccccagcttattatcagcattgtttctatttcttttgtgcattactacagtaatcatcaatctcttcttattcacttccatcctttgtatcatcatcagagatttttggtgttgtttttgtccataaaacaacaaacacaaaaaatgtccctcacatgattaataagttgcttttttttctggcaataaaaacccttaatttctcagcatggcttactagacctttccaagtattatttatctttgtagttttatctcccaaatttttacccacatccagccaggaatcctttaattctcaaactagtttaggtagctgattacctagagtcatcttgtttctttctttcttattaaatatgaaatagctttatagttaacttcattgtacgatctggtacaattttattcatagaaaatattactatatgataacattttagaccgtaagcatttattaataataaaaaaaaaccaagcactggatttagtttggctctctctgagttttttacctaatatattttctatcttttttaactgtttgctacctctttctgttagaaaagtgaagaaaaataccaaagaaatatttttgtaagaataacttaaaattaagagtattccacatatcaatttaaaaacaaaatttcaacagattgctacagattgcttttatatggtttaaataataaattactttgattccatttatggagcactggtgttttttgtgaacgctgttaggtaacaggacctgtgtccctgtggttctctttctggaatgcctttctgaagcttctcctcttaaagaattcctgctcatttttcaagacccagtagatttgtcaccaattgcaaagccttttctgaccctcatagaaataactatcaactctctcctctatattttccagatttcttggtatgttcatctctacttaaaaaactaatatctaacatcattataataataatgattattctgtttatctcctctcttcctctcttgcctctatgggtcctggcacaaagtttatgttccataattgatgttaaatgaatgtcttgttttgactaagatatttgttccttaagaaccttatccgtcttacctttattctgtaggaccaagaacacaagatcttatgtgtacccatttagcgatgacagactgaccaagtgatctggcttttctccacgctctgggaaatagtttaactctgtcaaagagcagtcaagaaaagttcatatattgagagtgatgtgatgatggctgtttgaaaagcttggaactacctttttagatcaaataggcttggttctgtctcaaatctggattagggccaatactttgataacccagtcagcaaagatcagaagtcaagaattcacaatctttcatcgtgctctgaaatcatttgtcaataaacaacaaagaccttctagggctggatattagagagggaagtagccgagagcttggaaggggagcttttctatcagctgaggactctggatgggaaaaaggcttagttcaggtctggtaaagaatttgagaataagcgaaattcaaggacacagtagtcaagaaagtgtttagtactgggtgttggctcggatgtgaggaaaaaggcactttacactgttagtgaggacagaagtagaaattggtacagcctttctggagtgcagttctgcaaggtgtattaaaaatgttaaaggtgtttatactttttttcccaccaattctacttctaagaatttttcctaatgacatactctaataagtataccaggatttttgtataaagaaatttatttagaacaactataaaggtcccaaaatagggaactgattaaacaaattgattaatctatacaaggtaatatcacacaggcattcaaataatgatgtagagatatatttatagaaaaggaaaggggtatatgatgtattatcagatttaagaatctatttatgaaataataggtagattatgattattttttgtaaaacagatatatacatgtatatatatattttatatatacacacacatatgctacacaatttatggaagttgtcaatgagagattttttttagtttaccttgatgttacaaattttctacagataatatataatactcaaattataaagaaataattttttcaaactatatttttcaaaatatttcaaaaatttcaaaaataattatttttcaaaataattttgaaaaagttatttcttatagaagggataattctttcagattggtattctccaggttgactgaatagtgcttggaacagagtacatgtgtgatatgtattagcaaatttaatgactgagtgaataggcaaatgactttactccaaacttggtagtgtaggttttattggtgagaattttctaaattttatccattcatcttccactggaactgcatctgtaggatagctgatttttgattcctgagatcttttctttttttttttttcctggttttcacttttttttttctctcttcaacttttattttaagttctgggttactagtgcaggatgtacagatttgttacgtaggtaaacatgtgccatggtggtttgctgcacagatcaacccatcacctaggtataaagctcagcatccattagcttttcttcctgatgctcttcctcccctgaaccgctctcccaataggccccaatatgtgttgtttcccccagtgtgtccatgtgctctcatcattcagctcccacttataagtgagaacatgtggtgtttggttttctgttcctggattagtttgctgaggataatggcttccagctccatccatgtccctgcacaggacatgatcttattcctttttatggttgcatagtattccattatgtatatgtaccacattttctttatccagtctatcctggatggtcatttgggttgattccatgtctttgctgttgtgaatagtgctgcaatgaacatatatgtgcatgtatctttataatggaatgatttatattcctttggttatatacccagtaatgggattgccggatcaaatggcatttctgcttctagatctttgaggaatttccacactgtcttccacaattgttgaactaatttacactcccaccaacagtgtaacagcattcctttttcttcacaaacttgccagcatcagttgtttcttgacttttcaatgaaccaccattctgattgcataagatggtatttcactgtggttttgatttgcatttctctaatgaccagtgatgaaaagctttttttaatatacttgttggttgcatgaatgtcttcttttgagaagtgtctgttcatgtcccttgcccactttttaatggggttgtttaattttttcttgtaaatttgtttaagttctttgtagattctagatattagacctctctcagattattagattgcaaacattttctcccattctgtaggttgtctgttcactctgatgatagtttcttttgctgtgcagaagctctttagtttaattagatcccatttgtcaagttttgcttttgttgcaattgcttttggtgttttcataattaaatctttgcccatgcctctgtcctgaatggtattgcctagattttgttctaggttttttatagttttgggttttacatttacatctttaatccatcttgagttaatttttgtataaggtataagtaaggggtccagtttcaattttctgcatatggctagccagttctcccagcaccatttattataaagagaatcctttccacattgtttgtttttgtcaggtttgttgaagatgagatgtttgtaggtgtgtggtcttatttttgagttctctattctgttccattctatgtgtctgttttttgtaccactaccatgctgttttggttactttagacttgtagtatagttttaaggtgggtagcatgatggctccaactttgttctttttgcttaggattgtcttgactattcagcctctttgttccatacaagctttaaaattttttgttctaattctgtgaagaatgtcggtagtttaatggaaatagcattgaatctttaaattagtttgggcagtatgaccattttgatgatattgattcctcctatccatgagcatggaatgtttctccatttgtttgtgtcctctctgatttatttgatcagtggtttgtaattctccttggaggggtccttcacttcccttgttagctgtattcctaggcattttattctttttgtaggaattgtgaatgggagttcattcatgatttggctctgcttgcctgttgttggtgtatagtaatgctagtgatttttgcatattgattttgtatcctgagcctttgctgaagtttcttatcagcttaagatgcttttgggctgagacgatggggttttctagatataagatcatgtcatctgcaaacaaagataatttgacttcctctcctcctatttcagtaatctttatttctttctcttgcctgattgccctggccagaacttccaacactatgttgaacaggagtggtgagagagggcatccttgtcttgtaccagttttcaaggggaatgctttcagcttttgcccactcagtgtgatattgcctgtgggtttgtcatatatggctctgattatatcatgatatgaggttacatcccttccttggtatgagtttgtgccccttcctgtgtctgagtgttgacgatatatttctgactggtcattagttgtttttgttcatttcattaagggttttgagagtcaggttccattaaccagtgtcattccaccattttattctgtgacttcttttggtgctattacatttagaaaattcttcctctctaaaatgtggtaaatatttacctacttagcttttaaaatatattttcatttaattctaaaatgtatttgaaattaatttttatatgatgtgaagtgagaccacaagttgatatttttcttttgaaatacataaccagttttacacaaaccgtttatagagtagtccattttttccatattggtttatgatgtatgttctgtcacatattaagttataatgtgtacaaggctctatttcaggcctgtttgttttgttgtgttaattcgtctgttgattcttataccaccattacactattttgtatgtgttataaaaggcagtttaatattgagtttgggtacatttccactgattttacttttttaaacagttgaactattttcacacacaatatttgccaaatgcaatgcttgacattatatcaaaaatataaattaattttggaataattaacatgttttattatgtagtctacctctccgggagcatattttatctttccatttgtttaagttttcttctatcttgcatccctcaaggttttacttaagaaatttatagtttgtaagtattatgtattgacctttccctcattacattttctaattattgttagtatatagaaaattgaatcttgaatatgtattttataattagtgattttcttgagtattattattgattttggttctttttgtatcttttagaaaagcaatcataccttctgcaaataattataacttctattctcttttgaaatagttgtatcttgtttcttttcttgcatgttagtatgatcttggacatccttaccttcctcctgattttaatgagagcagctttaataatttgcagctaagaggtaactggcctaaaagaaattaggaaatacacttagcttcctagtgaggcttaaaaatcagaaaaaaaaacagtgttgaattttatcaaatgatcttttgttctttttttaaaataattatgtcctcttatttgacctagtgatgcaatgtgttatattaatatatttctaatattaaacaatccttgcatttctgaggtaatccctacttgattatgctgggttattgttttaatatactttgacttaattttccagatttgttatttagaattttcacaactgtattcataaataaaacttgtttggaagaacatttcttgaaatgcattctaagaaggaatgttatgaggaagaaatggttccgtggtcaaatacacttgagaaaggcagattaaaacattttaacaaatttctttgctttaggtttctcagagactttaatatgctaatacatgctgtaatctctgagggagtgcttttcaagcacactcacaatagattccattcccccctcagaaagtgacactaatttccacagaaccctctttggaatattaatcattgtcatattttgttatgagggttatgtcaacgtcataaagtgagttaggatagcttttcctactttaacctaccctggaatggattatataatgcgggtctcataagtttcttgaaaacgtgaaaggcctagaaccagttttgcaaattatcccttaataacatttgctaaattttccatggctattcagctttcttataatattgaatcaatgttattaattcatatttctagaaaatggttcactttattgaaatttttaaatttgttaaaacgtgattgtgagtggaattctcttttaattcttaaaatatgtttcatttacctgttggtaaatacaatgaaatgaaatgatctgtgccaaatacttgaaacagtgcatggcacatggtaaatggtaaatgttttatttcctccccctttttcttattctgtatctttctttttcaaaaaatttagatttgtcagaactttgttgatttaaaaactttgtttcccagataataacctcttctgcttatcttttaatctacttatctcttccatctatttatttgattgtttaaaaattcatcactgttcaccctagatttatattttattcttcctgcttttttatagtttttttctttcttttctagctagcttcttgaattgattgaataattcttttaaaacaaaattcttgattagtaatgaaaatattcaagtctatcaatttgatttaaaaatagttctgtattttgtggtcctttatgcacattgtacaaaactcaaagcatacaaaagggcttacagataatagtgaattttcttcattctcctgccttagtcttcttgttcctcaccaggaggtaaccacaattatgatgttcttgtgtttccttccagaggtattctaagtggatttggctattgagtacagctttgtcagaactatatatatttttatttaattattactttcattattttaaaatagaatttgctattaatttaaatttctcacttgatacaataattaggagggtcaaattaaaatacttattcataggacattttttgttattaatttctagttttgctgcattgtgattaaagaatgtagtctataatttctgctactttgaaagtcctgaggttaatcatgtgaacaattacaaggtcaaatcttataaatattttatgaaatattttaaaatttataatcttcaaagggcacaaagtatataattaattcaaaataatttttatttattgtggtttacttgatctattacagacagcaataaatttatttccttctcaaatcgaaattttgttgttttatttatccttataataacttaaaaatttgtatgccataatattttgcataaattatgattatgataaattatgatgctatgagaataaacacaagcataaaagcaaactctggcttgtaaattttattaaataaataagtcctgaaagtaacacctatgccaggatataaacattcaattagtgcagcaggatatcaaattagaagtaaaatttttgttcagactccccatttctaatctcacatttcagtcataattacttttgaatgctttgtatttcttctaatagttacctccataactctaaataatgtgtttagatctttcattcttaattagtaactatagactttatctattgattcttcgatatgaaagagtaaggctcaagttatttatactaccctaagctttccttttcaaattcttcccaattgtaatttttttcttagatgaataacttttgtaatttttaaaaatacttaagcttcaacttcttgattcatcaactttaaacattttttggactcttggttattttttgactcttggggaatgaatttcccaatttagcattctctatgtcttcctttctctactgtctgactcctgttagctatgttatcactttatgtggggaatgtttagagcattctgttctctaattctaattaaattttctatactttgtaggttaattctgaaagtcaaatactggtggaattttaatataatagttatataaatattcatttcatgtttgaggaatattgggtatgtagagaaagcaatgcaactcaacacctacgcccctttaaggagaattttctaaaggtcaagattaaatggattttctctttctattttaatatttcatccattattcagactattgtcatgatttaacttgtttcatatttggaccattcttgggaaatgttttgggtttaattgccttttttcttgagaaaagaaacacatatctttttaccatattgccaatatcttgcaattgtttaatgctttagtaagtatcactctatttctaggtctgtttcaaagctgtcaccctgatatttctctttattccacttctagattagtttcactatttcttagatcctgtgtactcccttttaagaacatttctttttcctccccttcaggacatttattcaagtgattttttttccataaagggtgcatgggaggtaaacttcctgggtccttgtttttctgaaaatgtatttatttttccctaatccttgactgatagttttggtaggtacagaattctagatttaaaatgatttccagctgagcgtggtgactcatggcgtaataccagcactttgggaggctgaggtggtagatcacttgagatcaggagtttgagaccagactggccaccatggtgaaaccccgtctgtgctagaaatacaaaaatacttagctgggcgtcgtggcgcatgcctctaatccaagctacttgggaggctgaggcacaagaatcacttgaacctgggaggcagaggttgcagtgagccgagatcacgccactgtactccagcatgggcaacagagcaagactccatctcaatgataataataataataataataataataataataataataataataatttcttattagtaatttgaaggcattgcttctttgtctttcagcattgactgttcctaataaaaagcctgaggccaagtttattctctttactttctaggtaacctgaagtgctctatcacaaattatattttcttcagtttcattctgttcttcattattgtcaatatgcttttaaactcttgattttgttttgggtttccttatattttcatattttagccaattatttttttcagcttgttctctatttattgtgttctgaccttgtttcatagagatgatgaccttttacatatttatgaagacagcaaaactggtttaaattttcactgagaaaactctttttagaagtttctctttctttgaggttttagagagttatctattttttctgttgttgaagtatctttttttccataatcccattgttggctctttttctactttttcattcttgaattgtgtgagatttatccaggctttgtctttattaacaaaaataataggtgaattattttttgcttcacttgccgttcacacattttgcccagatttaaactaaaattttaatttgatggttttttcaaatgtctaacgggctttcatctgtcatggatttaggtgaattaatacaactcttgcattttttaaactgtaaggttacatgtaatttgaagttgtttgaatagtgtaaaacattaattagttttttctaaataactgtgcttccactcatgctgattattttgctaagttaagagatctgaggtcttttagcaaaagtaaaataagtagagctcatagaatgggaagactggtttgtgtaggagcccatgactgcagtaaagaaagttcccataagactgattgctgctcactatatttctcaccactgtagcccctgtcttctgaaacatggtgtaaactctatgggtaatcaacatcttttcttatatttttttgagaccagaatggaaggaagcacccattttatgtggttgtaaaaataaaatatgtgatgtatggtctaaaactacacctgccaacctattactgatgatacattaaatggaatttttatactcatagtaattctgatctttggctttctgtactttgccagtcaatgaaggtgtgtgcatgtgtgcatgtacatatgcgtgcatgattttttcataatgggagatgggggaggccctatcatacataatagcctgctgcctgctgccatgttaagaagtccaaccattagtctgttttgataagctaggcatctcaagtagccctattgatttttctttagttcttcttcttttttgttttctgttcatttttgtgtttttaatttatcctaggcagttgaattaaattgtcttccacttaattcatctcagcttccctcccagtctttttatgtccaaagtccttcaccagtcttcctattgcctccagattgtgagccaatttcttgaaggtggagccaagtctcactctttatatctccgtataatacatgtttcatacatacctactgataagctgatcagcttaatgatggggatagaagtgagctcctactcctgttttttccgtcaaaggtaaaccctggaaaaggacaaagttcgagtaatattttctacggagagcttggaactcagacgtcttctatggagttctcatcttcttgctcccttgccttttggtgagggaaagaatatgccacctgtcttgtctcctgggaccatgccaataagtgtgctgccccaggggctctgcaggatgggtttgttctcctgctcaccttgctccatccctgccctacctttcatctgctttcaggaggctcaaattgttttcttgtttccttctttccctttcccccaaacctccagtaaagaagagattttggtattaagaaaatgggctgttgaattccaaaatcagaaatagaccacataaatatgtatgaagcattaaaacccttcttcgaagtgtgatttcctggctaatggatgcttctgggatgattattatatatatttttgtactcaattaagccctattcagaccaacttattttttggtgaacttaaggaccttatgattagcatccattagcatttccattacatctatattgtaataataccatctaaaatttctatgctgtatctctcacagagtgcttttatgccattattttatttgatactcccaacaacaccatgaagaatgttgagattctcttaacatttttgttttatagatgaggagactgaggtgcagaacatttaagcgacttgtccaaagtcatgcagtgagtaagggagtggaatgctgactaggagccatgtcctcagctagtatggcaagggcatgctccctatcactgctagtaatagcaaatgatcactaccactgagtatttgcatcatgccagctactatattaggctctctgtatatattttctcatttaatactcctcataaccctgcaaagtaggaattgttattattccccccgttacatagaggggaactgcaatttagagaggttacgtaacttggtccaagtcacacagctagtcctagtatacctaggactatactgcagttggaacccaggtttccctgatttcaggcctcagccctagccacgtgggtccctcatggttttactggactgagctatgaagatattcaacatagcatagctcataaaggctgttccagttctcatgattccctgagctgtgattacgagctctccttgtgactcctatggctctggggcatattgccagaggtaaaattgggagctgtatggatcagaaaggcagagaaagtgaagggactaatatttactgaatgcttactatatgcccagtggccattaaaacccatatcacaggaaccttgtaagtctggtattatcatttccactttatggaggaggaaacacaggttcagagaggtaaagaaacgtatgcaagattgtaagtggaagagtcaggatttttagtcaggtctgtcagaccttatagcccatgttttctcctctatgcctaagtaggagtgggctcagtggtgatgttttaagggctaatgttgatgttttaagggctaatgagaaggagcagtatttctaaagggcttaaggaggattataaggaacagagatgaatttagaccctggtggttataatgcattataatcagtactctggagccctataaaggaactcataagagaacccaaagagaagaaaaactgtggcaagttttaggctacattgcctagcttatatcacaatgccagcagccttcaactgcaatacgtaggaactgggacttaaaaaccagcagaaacacattggtaaacatcataatgacacgcatatttaggaaaatgatgtttttaatttcaaaatctatgcagccttgccttatatagtcagtgctaggaagttgtggtgtaccaggaaatgatttacattttagccttaggcaaaaatatggaacttgtaattatgtcagagagaggcaaaaccttccagattttacagctttaaagctgtaaaagtctcagttaggatgtgtgttgattaaactgtggtgtggctgagcattttgcctgaaacttcatagggaataagcatctgttaatgactttcaggtaaaaaccttccttctaaacctttaatgcagtattgtcaaaatgtggaagtggtgggtgacaagcattttcttgttccttctaaggccttcctgatccaaggtagttttgagcacaaacggctgtgctggttaagcttttggcttgtgggaagaaagccgcacatcaactcctgatacgcacgagctagcctgaactctgtgatgaccatcagatgcagataaactgccagacagagaagctgtcttgtagatgtgactttgctgccttcaagagcagggctttctgcacctatgctctaagcgcccttagtgttcctctcccagtggtcctggattgatttctctaatggggagcctcctctgtagggtctacaaggtgactggtggattgattgccctactccacgtaatgtgagtaggcgattgtaaaggggaggctgaagagcttgcctgttttctttgttattcttcttactgagagaggtggactagagtggtagttcaaagatctggctctgcagtcacagatctgggtaccaatcaaggttctgtccctgattttctgtgtgaccttgagcacatcatttatcatctctaagcctctttctcatcttttaatgctttattcacaatacctggttcacaggattgttgtgggaattaaatgagataatgtgatattaagtccttaggacttttaaagttgacatagtattataactgttacctccgctaatagcgtcaaaccttgggtctaatcagggctcagtctctttactatttgtgtgaccttcctaaccattttgccattctgtctcccttctgaacatagcaaatataactagcttgctttggccttcaaattaatagaattcatcagccacagatctctgtgagccacttgctctgtaacagggaaggagtatgtgtgtctggcatgggagcttgccaagaatatttgctcaatagctatgctattataccatcacgtgctgctgtggctttataggaagtatatcctggatggttattacatatttagctggaatttagtttcctagggaaataaaagtttcatattttaagaatagacaattattttgaacaagtggtttatgtccacagaaagttcatgttcttatcttttatgtttgaatgaaggcactgtgtatgaggtgtccctgaacattggaagtctaaagagcatggatttggatgtcaaaactgggtccagattgaagttatgacatggaccacctgtgagagccttaatttcttcctgtgtgaatgtaaataatacctacctcatgggattaaaagagaaaataatataagaaagcatatatcatattatgtaacacatagtagcctctcaataaaagttactggttactattttgggcagatccaaacattatgttaataaatttcaatggctcccacattttattctttggggtggcacattctgtagagatatcttaggggctacagagggacagtgatggagggactaaggaaatagtatccaggctctctgccccacttcccaagaagctctgcttatgtctgttttatatctagggcatctgagattgttttacgggggagaaagaaggctttataagtgctttcagttcaatttattaatttttccctcaatgaaccgtagttttagtgttgtatctaagaaatctttgtatatcccaaggtcacaaaggttttcttctagaagtttttatgatttagagttttaaatttaggcgtatgatcaattttttagtccatttttgtttatggtaagaggtgtggtgtattagtttgctaggactgccataaagcatcacagattaagtggcttaaaaaatagaaatatattttttcacaattcttgaggctggaagtctgagatctaggtgtaagcagggttggtttcttctgaggcctctcttcttgccttatagatggccatcttctccttatgtcttcatgtggtctcttctctctgcctgtccctgtccaactttcctcttcttataaagacatcagccatattgggttaggacctacccaaatgaactcattttaacttaattacttctttaaagactatttccaaatgcagtcatattctgaggtactggaagtcaggactttaacatatgaatttggggggtacataactgagcttataattcatggatgaaagtgtttttttcccatatggatattcaattgtactagtgtggtttgctgcaaagaacctcctttttcactgaattgcctttgtacctttctcaagaaacagctgtccatataaatatgggttgatttctgcactccctgtttcgttccactgaactatttgtctatctttgctctaatatcatactgtctggattacttccattttataatatgttttagaattgacaaactggacttcctcaaaatgaaacatttctgctcttcaaaagacactgttaagggaatgaaaggacaagtcacagacagggagaatatatatatatacacatacacatctgcaaaaagtagagctgatatgggactactcatatccagaatatataaaaaactctaagatataaataataagaaggtaacctaataaaaaaggacaaaagatttgaacagatacttcaccaaaaaagatatgtgactagcaaataagcacatgaaaatatactcaacattattagtcattagagaaatgtaaaataaaaccacaatgagacaccaatacacacatattaggaatataaaaagactgaccatatcaagtgttggtgaacatacagaggaactagaactctcatatacttttggtgggaatgtaaactggtacaaccactttgaaaaacaacttggcagtttaaaaaagttaaacatacacttacatggtccagccattctattactagaaatgaaagcatatgcccatataaagagtacaaataaatgttttacttgttatagccctccttgttataggagttttacttgttatagccccaaactggaagcaacccaaatctccatcaataagtgattggataaatgaactgtgttatatctatattattcagcaataaaaaagaatgaactattagtgaatgctaccacatgagtgattgcaaaataaatatgctggatgatagaagccaggtataagacgcaaacatgctaaatgattccatttgtatcaaactctaaaacatgcaaactaatgtacaataacagaaaacagatcagtgccagtggtagaagggtaggaggaaaggaacaccaaggagcctgaagaaccttctgggagtgttccttataatacgttcattatcttaacatatattcattcagttaaggaacacatgttcattattttaactgtgataatggtcttatggatgtaaacatatgtcaaaacttattaaattatatatgttaaatatgtgcagtctattatatgttaattatatttcagtacagctgctaaaaaagtgataaaaaacatttgggccaaatatgaaaaacccaagactaaagtgaaaaattacaagactgttactgatcaatgttcaggcctattaaaatttcccctatcccaatggcacttgggcaactacttttcttgtatactttaggaagtatctaattcagacaggggactaagaagagactcttcacagtgcttgctgatagccccaaaatgcagcatgaaaccacccaaatgccaagacaaattgagaaaggttgacctttaaaatatgtagagttcagtacctttgaattaaattgcatgttcagctttggttctagttgctagaggctacttttttcaagtccacaattggctcccccaactgcgtttgaaattcagtaaaaccagcctttgcacctgcctttgttaaaatctgtacctaaattgtttggaacaagaaagaatagtaactagaagcagatttactgcagtctggacttagttgtttgggtgacctctttttgctggttttctgggttgattagactttgctaattgacagagtgtttggcgcaatagcccaggcagagccattctgctctggacttggatttggtacaagtattcctggtggtcaagtcatgtattttctagtttggaaacagacgttggaacaggactgctggagcaggtttgcaggattctatggtggagaaactataatgactttcaaaaacatgggccaaggtaatttggctgtcttttcattcccatctctaaaagaaagaacccaccaaagttcagagcatcttaaacattttgaagttgtgacagtgaatgtgaataattggtgtctgtgggactctaagggtagaaagcagggcttactagtgcttcttcttatttaacagagaagagcctggaaaaaaaaaaacctatagtcagacataaacatttcagccttatttattttcaaccagggaatagctaataccacgatgctgtaaagttcttgcatttaaatgtcctatttcacaggtccaaacccatgttccacatagtagtattataatagcaccatggagactatccagtaggatcctgaaagtcttcttacccactcttttccattttgctaagcacctggttaaattaaaattccaaacagtattattcagagacagcatggaacagcggattcttaattctggcccccccattcatcaagcacacataggccaggcaatgcatttagcactggagatactgaagtaagggattgcctctgccttcaatgaacctttggtctagagatggagactgagaaataaacaggaaattctaagcagagtgctgtgtacgatggagaaagtcctaaacagagtaatattgggacctgtaggaggccctcccactccaaaccatgagggtcaggcaaggcttcccaaaaggtaagagttacctcctcaaagaagcgggggaaattgtctcttactactctatgacaatgagcaaatcactcaaattctctgactctctcttttggaagaaataacatttactggttgcttttgaggattgaatcagatgagatatagaaaagcccttagcccagtgcttgctaggggaaagatcaatattggttttcatctttcctttcttttttcctcccctcctacctccatcaggtggggagtgtgacttccggagcacactacacagaggagacttttggagggtttttagttgtcatctctgtcacttggtgtttatcttcctgcttctagttcattagggcctttttcttctgatgctggcttgggctgtgtttatgtctttcatgtgcttctgtgacacttcatcaggggaagtggctggccctctgagcaactgctggaggcgttgggaagatgggaatcaaatgcagcctctgtaggtgggtgtggaacagaacagcagtgtggccctgtgcatgtgtcaggggcaggcagcagccatcatctgtcctcatgtcctgcctgtggggtctgatgagaaaagaatgagttagtaatgaagtagagaggagagagagctgagtgctaagtggagaataaaatcatcttcaagtataactcaggtttactctggagctgtgtatcctgcaaatagtacagtattcccactcttggccaggcactaacagctgtggaagcaaatggtgtaactgcctttagggggcgttctgactggccagcaggcattactgatgcagggaagcaatgcagaaaactccacggcaagctgggcacactttgctctctgttgctctgtgtgtcctttggtttatttttctgtgtactctcccctcctaagaagactgtgctctttccaaacccaaatcaccttcttatgttgcaaatccacctaaccgtcagaattttttcctgcacagctgtcacaacaaacttcccctcatctgctactaaatgtatcagacactgttgtgcagtctgtgagctgccgactcattatccgagggctttccaatagaatctgatgttatccaaagcttctcatctgtttcaaagggaacaatttcctgcgttctctggagggaaatcaaacgcactacgtttaggaagtaggacggtccttcacagatttagtagatcgcaaggcaattatgggctgattattcccaacttagtgtttcctcacctcatttcccataacagcgactagagtgacctgaagatgggctttttgtctttccagtgagacatcgggaaataaatcacaaaaatcaagataagttgtggtacctttgatttccctctgtcctcttcccaagccgtttttggcactccctagaggaaaccagttctcctctcctcttttacttctgcagtgggcacttgggctccaagtatcttttttttttttaagttcatcttcatcatcctttaaattaaacacctactcccctgataaatatgatgctctttttaacaattagtctttggatatagaagttgctgatgaggaaaaatccctttcagctggttacctatgcttttttttttttttttttttttttttgagacggactctcactccgttgcccaggctggagtgcaatggtgcgatatcagctcactgctgccgatgcttcccagattcaagcgattctcctgcctcagcttcccaagtagctgggattacaggcatgcgccaccatgctcggctaatttatggtatttttagtagagacagggtttcacatgttggccaggctggtctcgaacccctaacctcagatgatccacccacctcggccttccaaagtcctgggatttcaggtgtgagccaccgtgcccggccccatgcttctttatactagttctttcctcccttctcacctccagcctgggatgtggtctccactatggtctttattccatactccaaatttgtctctttccaagtatcttcctaattcctttttttaaagttacctttttaatttcctgccgtgaaacatctgctgtatcatcttgcttccgccacttcctagaaaacttgttttatgaatgttctttctcctcagtataattttcctggctgtgccctgatgtagtgctacaatagttttattttacattgactgattaagcactttgaataattgttttagctccattatggcaaatctatttggcttaacacttttttttttttttgcaacctttgattaatgcctgaccattgggacagaaaggaattggcgcattaatttccccttgacgccacggagagctgctctttttcctgtgcaagagcctgaagcaacagatgctctgtgttcgtattgcaggggagagcacacactgttgcaaataagtatgtgtgtgttcccggtcagtgtttgctaatggtgctgtgtggcagccatttcatagcagagagcaaatgttaggatttagggaaaattgtaccagcatatcagattttaaaacggaatggtgaatttttgttgagttaacagtgtgtagctagacgatgttttctttctaagctcatgaaacttaacagctgtttagtgaagcagtattttcatatatgcctgtttgacaggtttaatagcaaattttgcagtaagtgacttgctgaacaggacttctggcttgggctgtaacaagaactgtatttgcagcaagattcattgagggtctttgtgctttagtgtttacgggaaggggaagcctggctaaagtgaggaaaactgaaaggcataatccaaaggaaattactaatatctctaccagagtattcctcagaacttgttattaactagtttagaggaagataacatggggaaaacatgctgtttagcaataaaaacacatgagtacaatcagcttactgtaacccattattgctgcatagtaattaaatctatatatctccaactttatagttttctgcagcagaatctctgaaagacttctgcacttcatctgattcaaggaagcctatattctctcccctgtctctggaaaggctactgtgccttgtaatagctttttaatattgccagatcgaagacaaatgcttcactggttttactgggagaaataaagcacttcctattacacttataggggggatccaagtcttgggaaactagcactttatgaggttagaatcccttttcctttcttcccatttttgagttctctcagatcgtaggacctcagaatcactcattcctagggctacccactttgtatttggctcctaagtgcatttttcaggatttatctgtgcttttattgattgcatgtgcttagttatacctgctgattgtgggtgtgtgcatgtatgacagaatcacagatcatagacccctgttctccagggcagccaccctcatggtcagcccagcatcctcagctaacaaaaggaccaagagctgtcttacatcctctttggatttccgcatagattttgcaagccgtaaatacaaaatttgtctagagttcatagttggttctgtttactggatttttttttttttttttttttttgagacagggtctggctctgttgcccatggtggaatgcagtggtgcaatattgactctgtgcagccttcgcctcctgggctcaaacaattctcacacctcagcctccagagtagtggggactacagacacgtgccaccatgcctgcctaatttttgcatttttgtggggggtgggtagagatggggtttcaccactgtttcttaagcagcatgtaagggagcttcatatttgtttgtctcagtcccatcatgatgtaggtcaaaagcaagttacattcagctagctgtatgacaaagatgcctccttttgaacagtaagaatttaggctttgttgttttatacactcaggcaacttgaaaaggataaaagaaaggtggagaaaagaatagtaaagtgagctcaattaattttctaagaaggcaaactaaaaacttctcacatgtaaacagtaagatgtcagggacacaaaatgagttagcccgtgttgctgggatgaggagggatagcagagaaatggccatatgatgtctgagagtgtggccagtgggaggagaggggtctactggtggacttctctcagcaggttgtcacctccacactttctcatccagagctcctgggattccctctaggaaggaatcattataccatttgccctgctcccatcatctcactaacctgctatcactgtagtaactccaagaaccagtgagacaagaaagagggatgtcatgagctgcctctgcacaactgttgaattcaattttctttcttcaagactccttcccccatgtttctctaatgcccacactttattcaggatgttgtgttcagtagcagagacatttgaaatgaagcttccttatcatggcttttaggaaaaataatggcaaaactattggatacaggtgaattctagtccaatatggtaggagaggtgagcctggaattgccctttttacatatcctgcagtctgattctaataaaagtagacacagttctggtacactactatgtggttatttccagaaatataaatgagtgttattttatatatatatattatatatatataaaatatataatatgtacatatatagtattgaaccgacagtaggtacttatgccttctaaaaatgtagtagtaagtgaacataggcaggcaatataggaggtgatacctgaattagttttgaaaggctctagcacagccaccaggcatacaattagggaggagaagtggatgtacattctataccgaagaatagttccctccttataacccaaagaacagtgctgaatacatcttacatgctttgtaaataggtactgtcttgagctgttgtaacaaagagaacatattggagaagaggaggctggaggcagggagatcagttaggagattattgtggtagttcaggttgaagcaatatatatatattatatatatataaatatatatatttatatattttaatgtttataaatatataaatatataaaacattatattttaatgtttaaacttttaaaaaatcagataggtaggacttcctttttcttttttaaataataactatggaagtgcagaaataatagagattctattgtgctctttacctggcttccccattggaacatctctacaactctagtagaatgtcaaaaccaggaaattgccattggtacaatctatagactttatttaggtttcaggagctgtttctaggtgggactttctaaggattgcaaaccccatggctttttctttttaagcaggtagaattgagggtgcagtggaagcaaaggctcatgtctggtctcttcctttctttctgtattgccctcctatcccccatcatgtgaaaaatagatactagaaaactcatatcaaaaagtacagtctggatgcttactttgcagggtagtatgttaggtgcccaggaggacatgaatgactataagaagaaatggttctgtaatttggaatcgtttgtttatacagaaagattcagctcaagacagtacctatttacaaagcatgtaagatgtattcagcactgttctttgggttataaagagggaactattattcggtgtagaatgtacatccacttctcctccctaattttatgcctggtggctgtgctagagcctttcaaaactaattcaggtatcacctcctatattgcctgcctatgttcacttactactacatttttagcaggcatgagtacctactaactgtcggttcaatactagatcccaggggttcaaacatggattctacacattctctacccacaatgagttcacagtttagtggaagagagagacatttaaggaggaaaatgcagtagagtgttatcagaggtataagtagaggtatgagtagggtatatcttgaatgctgtggggtttgaacaaaggaggaaaaaatgaatttctttagaagagagataactgttgtaacaaagagaacatattggagaagaggaggctggaggcagggagatcagttaggagattattgtggtagttcaggttgaagaaagataactgaaaccaaggtggagaggaagacctaggggaagggatgggtttgggggctacttaggagctaaatttaagagcacttactgattaactgactatagagttgaaaagagtgaggtgtccaaaatggtcccagatgatggggtggtggaagtgccatgcaccaagagggagagtctgggagaagatcagactctggaagaaaactcttgacggggtatggatgtattgagtttggggtgtctgtgggatgtccaaactgagagagctcactcagttatagatgagctcaaatgatatatggtgccttgatgtgaatgactttgccagttaaagtatgtagtaggacaagaagatcaaggagaagccttaggaatcactaaaatttaaaggacagatgggggaagggaccctgcaggagagattaagaaggagagcagagtgagaggaagaagagtgtttggaaaacgagaggcagtcaacaatataaaatgttttagatgtcagatatgatagaaattgaaatgttttcattggagttagggacaaaggacattcttattgacctgtgtgagttcaatttcagctggctggttgcaggagacagcaaaacagtagatcaagtagtgatttttaactatgaaacaattaagagtttggtataaggcaatttagttaagtgctaacatggagtgtaaagaaaagtgtaattgatattaattatttaagaaaatccataatagaatgttagagcagaaatgccaccccatttttaaatataaagagagatttcaagtaaattgttcaaggtcatgcatctaaagaggaacagccaggaccaggtcccaggtctgtttactccctttataaaagaaaattctggatagactagtttaaaggagcaaatgaatgtctgttgcaggaaaagtgattgttaaaatgatgaatcagagctgtatacttctattgtgaaatataactacttgtttgatgaatttattcatgtattctataaatattaatagatattgtgctatttgtttaatatgcaaagacaaataaacaattagttgtagagaacatgcttggtgaattttataaaagtaaaatattatcgccattaagtgatatagtctagcagggtgacagacacaaaaatggtatcatacaatgtgcaattgaaaaggcaggaaatagttttgcctaggagttggagactagtgagctgaatcttgcatcatgattgtgatttctccaaatggagaaaggattaaagggaactttcaacaaagggaacagtatgaacaaaatcagaccagtataaagaaagtctataacttcacagactgttaaacagcctggtggggatacgatataaaggtagggaaataacaaagaattattttgaagactagaaaagtattagtttgtttgtgctgctataacaaaatacctgagactgagtaatttacaaagaacagaaatttgttttctcacagttctgcagtctgggaagtttaagatcaaggcaccagcattcggtgtctgatgagggctgctttcagcctctaggatggcaccctgtggctgcatcctttggaggggatgaatcctacatcctcacacatggaagggacagaagagcaagagagtgcttccttcaacttctagcctttttataaggctgttaatcccaggcatgaggacaaagccctcatgacttaattatctcccaaaggccacacctcttaatactgttgcaggggattacatttcaacatgggccaggtatgatggctcagacctctaatcacagcactttgggaggccgaggtgggcagatcacctgaggtcaggagttcaagaccagccttgccaacatggtaaaatcccatctctactaaaaatagaaaaattagccgggcacagtggtgcatgcctgtaatcccagctactcaggagactgagacaggggaattgcttgaacccaggaggcagagattgcagtgacccaagactgtgccattgcactccagcctgggtgacagagcgagactcagtctcaaaaaaaaaaaaaaagtttcaacatgaattttggaggggacaccatctcaaaccatagcaaaattcataaccataatactgaacagtaaatagtggggaaacagatgttttaagccaaggtgtcctttgatctgggcttaagataaatctggtggcaatgtggaagatgagttggaaagggacctctgtttaaggcagtgagatgtgtgcagaaatgtgtcacatgagtgataatgaggttgtgagctagggaagtgatggtaagagtgaagaggagggaagttagtcaagaaagaatttgaaggcagaattacaggcagggtttggcaagtgttcacctgttcttcctgagggaaaaagaagaatccgaaaaaaccccacagtcatttctaacttattgactagggtggggaataaagggagagcaagtttggaaaggaagattctgagtttggtgttggatatttagaatttcaagtactttgggaaatctaggttaaccatacatgagatcctaaacacagcatagtcataggtcttgcttatggtgttaagtagtgtaaacaatatatttaattatggatccccaagaagcacttaaaagtagtttataagttggaaatgtattcagatacacggcacagaaaatctgactaagtggctaaaagaaatagagtttatttttctcatatacaggaaagttggtgatgctggtattggttcaactgctcagtgatggcaagaccagttctctgggacttgccatcatggttataaatagctgatgcagctctagaaacataaccactttcttgtcaggtgcttctgtttgggtctgtttgggtagaactgggtcacgaggcctcctctggctggaaggttggctggaagagcgggaagaaaattgttgaattcacttaaatacatactttcccatcctattagacacaattcctcttttttaaaaacaaataatttgtaatgccttctttattatcctgaaataaacatcatagacaatctgcttgtgtacatttttaaataaatatattatcctaactgtaatataaaggaacaattaaaggaaaataatttataattatttcaaaatgtgaattctaaggcatgactgcactagaagacataatgaagaagtcagattcttgcacggtgaatgtgacagcaacatatgcaagtgatacaagggtatggtaatggtgtttccagtaccacaggcagcatattcatttgtgttttacttaaaagatgaccaattttgggtcaagttctgcacaaaacacagcatagtcttctcttgatatacaagatagttgtttcttgaaagagtcaacttgcatgaaaactgtgcaacaacaattttgtattcgtatacacaatagagttacattcaaggccaaggtaataggtttttcacatttggaaagctatttggaatgtaggagagttcttagtacacagattgtcccccacatagctgtctgtctagtgtccccggcctctgccaactagttaccagtagaatctccataccatggtgacaagtaaaagtgctccccccacatattcaaaatggcccctaggggcagcatcatccatattaaaaacaactggcttagattaatgggactggacactttgtactccaaacaaaatggaggttggttagcaaggaaaagggggaatggatattgaatagggaattaagtgtctaccaatagtaggaactgggttttccttatgtttgtatcttttcccaaattcttgcagaattccttgcatatagtgagttctcaataagctttcttgaatgactgaataaataactggaatgtaagctatgggaaatggaaacccagtattatatgagctttgaataaaggcaaaaatcttccttaagatacttaaagggctaactaccgtaaatccaggaatattgtcagaagttgggaagtgaactttggtgtgccagtgtctgtgctaggatttagcacttctggactttctgtctgttacacattctagactgaagactgagggttaaatttatatcagtgaatcctgttcaggaatggagggtttaggggaaatatttaagttttcatgtaagtagtatagaagaaaaagtaactgtcacaataaaagatcaataaatctcaggctttaaatcttagtctctctatcttttagcacattctctttccactgtgttcttttccacttctgtttgtctattcgctctggcatttttatcatagcctgagacattttcgaatgataatttttaggagaaatatttagaaacagaatcaaagggctttgttttgtttcctcgaaatataaacctattattagaatataattcacagtatgagaaatgtaggttttgcttgagtttgcttccagatttaagtagaaaagaaagaaaatgacattataaagaattttatctctttttttgtgaaaaagataatctgtaactatggattgtgaagacaatatatgaaaagcaaatctttttcaaacagtgctccaaagttgcctttgaatatataacttctgaattcaaaagcatgatacagcatgggtttttaaaaaaatagttgtttaacattttgaagggtataacatttgataactccatactttgaattcaagtgaaggaacaataacttcaaccttttgtttataagaataaggaacactaaaaaatgttgtgtagtttaagtttagacatttcaaatagtcctataattgcttgagagagcagtagagtttttttttcaattagtttattagtatttcagggattttaaatggaagaaaatcttgagtgtctttgtaaatgaattgcatcttttataggcacagatgtttttcgcagcattattttcatccccatggctgctttacaatatgtggcctatggagaaaatgacaagtaggtagatgatgagtaggggaaaatggtggaaggtacagcagcaataggaaggaagtattccccaaggtttgcctgaaaacatctactttgtgaagctccaacatttatggagcaaaatgccctagagtgctgcaacaggagacacaacttaccacccctcatacggaaggatgggagggagaaatggaaggggaaagggaaggagggagaattcctgtgatcttcactacccgctgtctccttagcacagagaattcatccattgccacatcagcacaaggacaacatatgaagttcctcaaaatttccaaataagccattacttattacctatacggttattccctaaaagtttcacactgaagtaaacaagtgtttttggtcatttcatgccaacaaactgatggcccttgatcatcatcctttgaactgactccaggtctagaatgaattttcctatgtatggtgaccctaagtctgtgtcttagaaaatatatatatatatatatatatatatatatatatatattttttttttttttttttttttttttttttttttctggactcactgcaaactctgcctccctggttcacaccattctcctgcctcagccttccgagtagctgggactacaggcgccctccaccacgcccagctaattttttgtatttttagtagagacagggtttcaccgtgttagccaggatggtctcgatatcctgactttgtgatccgcatgccttggactcccaaagtgctgggattacaggagtgagccaccgtgcccggccaggaaagaactttttaaggttgcccttgaataccggtcttgattaagttttattctgtctatatatttcattattttaattttataatacatttctatttcttgcttagaatttataaattatatatcagattatgatttctgtgttttaaaaatacctattatatcttatgctggttttcttaagtggaatgtgatatattaatatcttgttccatttttgttacttctccaaatatagacgattagtaatattctactatttattaatgaaaaactaccttagttggcctaatgtaactatctaaaaacaataataataaaattctgtagtgctgttagagagatatatgattatgcattccagccaggaattacatcagtaatttttagattatattccagggaaaaccaggttttgggtcaactaacacctatttattgttcacttatgttgaaggttctaggtgatttctcatatagctcattgttttgtgccttcaatcttagtaaatcttctaaagtgctaccgatatactcagggaaaactaactttgttaaaagaatatcttttaaattaacctacttttaaaaataagcattattatgtttgtggaatttgaaaatacagtctagttaaggtatttagaataacactcagtttctgtttcaaagtgattatatcattttagtatcaaaattaatttaattgaccatataaggagacattaagtattattataaaaatggcatgttatggcaaagtgtggtggctcacgcctgtaatcccagcactttgggaggctgatgggggtggatcacaaggtcaggagatcgagatcagcctggccaatatggtgaaaagctgtctctactgaaaatacaaaaattagctgagcatggtgacaggcacctgtaatctcagcttctcgggaggcataggcaggagaattgcttgaaaccagaaggtggagattgcagtgagctgagattgtgccattgcactccagcctgaacaagagtaaaactccatctccaaaaaaaaaaaaaaaaaggcatgttatttattaatacgagtgacatacatgcaaaaggatgtctgacttaggcaatgttattttctggacatattttttaaatagactgtgacctaagttctggtggtccctctagaaagggtaccattccctcttctctgcctgctgagccatttcctaagactgtcttcagatgttatgtcttctctagagcttttcagcattccttttattcttttttttgttctcatggtactctatgcatgagaatgtttgagtatatatatattattacagttatttgcctcttagactgcatttgggtattcctctttgagtttctatttcgtgtaaatgcatatagtttcctataaaaaacacaatttataatcctccaggaagtctgtgtaagtcagtcagtcaaattacctggttgattatagtttcaggtttatctgctgcctgggaatcaaaacacaggtcttgattaactttctataaagcaaggatatggactagggatcactaagctctcttttatctctacaatggtgtcattatatgattctaatccatcactagaaatgtattgtgaaatagttaattaatgtttgcagaatgcttagagaacttttaatgagaagtagatatttgtggttagtgctaatgaatagatgtcttatgaaccttttttttgcaccaacaacacattggaaaaatgtactttcaagaataaattgcaatctggtgaaatttttttattagttaacaaaatttagcttttaaaaacaagtatcagtatagtggctttagtggctttagaaaccaggaccctatgcatataaatagttgtaataaaaagggaagcagcaacagtgtatagttttcataatttttcaaaatagtttaaatatgatagcaactttttactcttacagcttagttgtgaaggaggcaaggccagtactcttatactctgggaagctaagacctagagagattaaatgctcatttatttcttaaataaaaatgtattgagtgcctgtatttgagtataacaattgaaggtgcagtggtgaataatttaccctacttgactttgatagtaagggagacaggtttataaacaaacatattagctgatagcatagttaattatggtagaaacacagaagatggtgcaaataactctggggtgttgtttagtgagcctttacagaaaaggtagtttttaaagcattttcattaaactgtaagtggaggcatttgccagatgaaggggaggaggtgaggagaagggtctttcaataaaagagaatgaacatatgtaaagacccagagttatgaaagagcctgtgcgtttgaagaacagcgtgaagttcaatgcagctagagcaatattgtccaatataaatatgaacacaaatgtgcaatttaaatttttctaatagccatagtacagagtaaaaagagacaggtaaaatcaataataacacattttatttaacccaatttatctgaaatatttatttatttttcaacttaagtcattaaaatcaaatcaggtgaatattttacacttacaaaacatttcaatttgtcttccttccttcctttcttttcttttctttctttctttttctttacttttttttttttttttagggactggatcttgctatattgcccaggctggtcttcctgcctcagtctcccaaagtgctgggattacaggcatgagccactgccctcagcctaagacatctcagtttggactcaacacatttcaagggctcaatatatagaagcttagcaatgcatgtatatgtatgtgtgtgtcggagagagaaagagagtgagaatgaaaatctgtgtgctctagagggggaggaggttagataaggttgaagtagttgttggagtcatatttttaaaggctctgcatgctggcttattttagaattttttcttataatttagtagtttatgattgtgcttctcatattatctgtggtgaaggaacaattttgaaaattttgcatttgttatagactaatgctttcgcaaaataataataaattagaaaggtgaaagtaaaaagacatacaaagagaagcaccattttttaatcattaaagttgacaagatgttgtcttagtctattttgtgctgctataacggaataccatggactggatagtttataactaacagaaattaattggtttacaattctagagcctagaaagtccaagattgaggggccacatctggtgagggccttttagctgcatcaaaactttgcaaaaggcatcacatagtggaagggcaagagagggagagagaaaaagcaagagggggtaaactcactcccatgataaataacccattccctcaataaaggcatttgtccattcacgagggcaaatccatcatgatctaaacatctcttaaaggtcctaccttccaagaccattacaaaggcaattaaatttcaacatgaatttggagggacaaaagttaaacccatagtattcctcctgtcatgtttttcttacatacaaaacacatttatttcatcccaatagctccaaagtcttaattccttccagcaccaactcaaaagtccgaagtcttgtctaaatcagatatgggtgagacataacacaattcattctgaggcaaattcccctctagctgtgagcctgtgaaattatacaagttatctatttccacaatacaatggtgggacaggtataggatagacattcccattccaaaatggataaataggcaaggaaggggtaactggttccaagtaagtccaaaacccaatggggacaacaacagtaaatcttaagcctcagaaataattttctttgactccatgctgccctgcttcctggacacactggggaaggggttgagcccccaaggacttggagagccctgcacctatggctttgctggaacgttggagtcttatgcttacagctctcctgggctggctttgtgtgctggtatctacagttcaggagtctcaggtgtggttctgcccctgcagcttcactagacattgctttagtggggactgtttgtggcagctctgctcctgcagcagatttctacctggatccccaggctgtctgatacattctttaaaatctaggtgaaggtagccatgcctccacagcttgtgaactctgtgtgcctgcagaattggcaccgtgtggataccaccaggacttactgcttgtgcactcaggagcagaggccttagctgcacatgtgcctgctcaagctatggctggagcagcttaagggcactgcaccagaatgtggggaacagacatttgggtaggtgaggtgcagggcagttaattctgaggtcccctgggtgcctctttggaaactttgccctcaagattctagcttgcctcagagatccctgaagtgcctttgcggtcattttcttattgtcttgatgaatagcacctggctctttactagccatacaaacctttctagcaaatggttgtgtggccacatcttttgtttgcactcctaagcacacatttttattctttacatggccaggctgtgaattttcataatttttatgttctatttccccttaaattatgaatactgtctttaaattatttctttcccctcacattctattatatacatttaaaagaagccacacagctccttcagtattttgcttagaaatttcttccatcagatattctagtttatcactcttaaattctgccttctgttaaagccctcaggcatggacacactttagccaagttttttgccacttaataacaaggatagcctttactacagtttccaatacgttgttcttcatttccatctgagacctcatcagaattgcctgtactgtccatatttctgtcagcattctggtcatgaatctctaagaagaatcactcaagtaatctctaagaagttcccgactttctctctggctcatctgctcttctgagccctttccagaacttcccttaatactgcattcattgtaatctaggcttttcctaggctgctcttccaaattcttccggcctctccccgttacccaatttcaaagctgcgttcacatttttcgggtatttgttataacaacccacctctctggtaccaatttttgtcttagttgtgtgagtgtgtgtgtgtgtgtgtgtgtgtgctgctttaacagaataccacagacggagtaatttataaagaatgaaaatttattagctcgtggttctgcaggctaaacagtccaagaatgaggggccacatctggtgagggtcttcttgccacatcataacatggcagaaggcatcgcacagaagaagggcaaagaggggatgagagagatcaaaggagacacaaaccccttcctgcaataaacattagtttattcataaaggtggagccctcatgtcctgaatacattttgaaagtccaaccttataataccgtcacaagcgcaattacatttcaacatgagttttgaaggggacaaacattcaaacaatagcagacatatagtttataaaaaagtgtctaaaccagtgctatccaatagaactttctgtcatgataggaatgttctgtctgtgctgcttaatataatagccactagccacacgtatctattgagtacttgaaatgtggctagtgtgactgagaaaataaatctttagtttaatttaattttagttaatttaaattgaagtgaccatatgagacaattgattactatattggacagcattgaatacatttactcataatctctgtatttacctattgtgcattagtaaaaaacagtttgtggactggtatggcccacaaacccatgctttgagtagcactgtttaaagcatggactctagagctagaaagcctttgtgtatctttggcaaactgcttaatcgcttggtgcctcagtttcctcatttgtaaaataaaggtaataataaactaccttatagagttgttgtgaggattaaatgcattaatgagtgtagcatacttagtacaaggtctgacacacagcatgcactatataaatgcttcctgttattgttattattatttattatgtaggtggtggatatcaaacagttaattggtaacaaagcccagtctttttattaattctctgctttttgcagtagcttagactttttccttttaaaaacataccacagtttgtggcatctagtggcttccaataaataccttttgaacataagcataaagtacttttcaagcacagatgaagaagcaattattgttctgaggtggggggggggttggtaaaattatcaaaaacagatgacagctgagaaggcctcaatggaggagtctgacaggcaaagaggagagaacacacctggtggagggagcaaggacacccatttggattatactctatttaggagactatacagcaggtaacactgacttagccctatcactgctaccaccacttctttctctccttcccagctcttttcttgatttatccttttagcatattttaaacaggattaataggtaacacgtgattctacagttttaagggaggtcaatcgttgcctctttacttgttcattcctcagagtaacagtgcctgaatttgatggtggatgttgggcagtggttgggaagggaaggggaatgctgcttgaaaagcaatccctgggttatgggcagatagctgtgagattcttttcccctaaaacataatgtttcttatttatgtagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggtattgtttgtcttttcagtttgatttgtattttataaaactaatgtcccttggtgtaattgagtacaatatgcatgattcatattataatttggataatttcctattccattggcttaatgagttctctacccttttttgtcctcccattttttacttctgtttcttttgtgaaagggaactgatcatgttggatcgctttttaaatgtagaatctgtagctactggtccatgatacttaccagccctatcactttgtaattgctatctagttaaacattagcatggttctatagataattgaaatatacataaacaggatacaaaaacgatgacttcttccaagtggcctcagtgtgaataattttttagaattaatgaaatagagaatagaactttgcactctgaattgatttaattatttttatagaactgaggcttctcctgcaaggaattatccaaggttgagttctacctttacttataagcaccctggatcagctttatcagataatatacagtaaatgcccagatcagggatgtatagccagtcatcagggagctatcagttagccttgaatatatccatgggctaatttccggtggcagaagaacgagtttctattcttttgacttttttgaatgccaagagaaaggcctagtgaagtacattgtcagtttaaaacattatttattgagatataattcacatactatgatgttcatgcatttagaatgtacaagcgatttttaatatattcacagagttgtgcagccaccacaatctaattatagaacatcttcatcaccacaaaaagaaactctgtgactattagctgtcattctccagtctacctatatcccagccctaggaaaccactaatctgctttctgtctttatggatttgcttattctgggcattttacatgaatggaataataaattatgtgatctttcatgaattctttttttcatgtagcatactgttttccaggttcatctatgttgtcacatgtttcagtatttcattctttttattgctcaataatattccattttatggatgtaccacatttttatttatccatgcatcagttgatggacattgagattgttttcaccttttagatattatgaatagtgctgctatgaacattcatgcacaagtttttcatgtgaacatttgttttcatttctcttgggcatataccaagaagtagaattgctgggtcatataccagctctatgtttaactttatgaggtattgccaaactgttttctgaagtggctgcacagttttatgtacccactgacaatgtattataatttttccatatgcttgccaacacttgttattatctgtcttcttggttatagctattctagtgggtgtggagtggtatctcattgtggttttgatttgcatttccctaatgacaagtgatgttgagcatccttccatgttcttactcgccatttgtttatcttctttggagaaatgtgtatccaaattcattgcccagtttttaatcggactatgagatttttattatagagttttaaaagcttttttaatgtattgtatatacaagtcccttttcatatatttgatttactaatgttctctcccattctgaggactgtcttttctttttttttgatggcaatatttgctacagaaatatttaatttttgattagtccaactaatttattttatttcttttgttgcctgtgcttttggtatcatatcaaaccattgcctacaccatggtcacaaacatttactactactactgtaatgtatctaggtatgtatatctttactctcatctcatattttcttctaagaattttatggctgccattcttacatttatatctgtgaattaattgtgttaatttttgtatatggtataagataaggcttcagctttcttcttttgaatgtggtcattcagttgtctcagcttcatttgttgaaaagactattctttctcctttaattcggtgcattacattaattgattttcaaatgttaaacaaaccttgcattactgggataaaccccacttgattacaatacataatcttttttatatggtgctgaattcagtttggtggtattttgcttaatattttgcatttacatccatagggatattggcttgtagtttcattttcttataatgtcttttttttttttttttttttttttttttttgtatcagagtaagactggcctcatgaaatcagtggcaaagtgtcacctcaccttccattctttggaagagattacaactgactgctattaattctttaaatttctggtagaattcaccagtgaagcaatctcattcacgcttttctttgtgggaagatttttaattattaattcagtttctttacttgtctaatcagattttcagtttcttcttgagtcagttttagtagtttgtgtcttttgagaaatgtatctgttttatctaagtcatgtaatttgttggtatacagttatttatagtatcttattataatttttttatgtttgtaaggatggggtctaaatcactgctgtcacttgcttttgggcagaacaactgtttagatttttctagcaacaaattctctgagcctttattcatctttatctctttgcttaaccttcagttttgaaagatagttttactagacatgagattcttagttgaggggtttgtttttcttttctttttttcttttctttctttcttttttttttattttcagcactttgaatacattatcgatcccattgccttctggactccattgtttctttttctttcttccttttttttttttgagatggagtttcactcttgttgcctaggctggagtgcaatggcacaatctcagctcactgcaacctccatttccccagttcaagtgattctcctgcctcagcctcccaagtagctgggattacaggtgcacaccaccatgcccagctaattttttgtatttttagtagagatgcagtttcaccattttggacaggcttgtctcaaactcctggattcaggtgatccacctgcctaggcttcccaaagtgatgggattacaggcttgagccaccatgcccggcctggactccattgttttgatgagatgtcagctgttacagttttggaggtttccttgtatgtgctgagtcatgtcttctttattgctttcaaggttttctttttcttttgatttttattattttgactctaatgtatctaggtatatatatctttattctcatcttacttggaggttgttgattttcttgcatgtgtagattgaagtttttcatcaaatttgagaagttttcagctatcattttcacaaattctttttcttcctttttttctttttcctctccttctggtacttccatttacagtgtgttggtgatttaatgatgtcccatatttctcttatgctctgctcatttttctttattctttattttctttgttcttcagattgtatgacctctatcaatctgtcatcaagcttactgattctttcttctattagcttaaagctactattgagcctctatactgaatttgtctttttagttactatacatttaaactccagaacttctctttggtctttttaaaaaataatttctgtgtctttattgatattttttatttgatgagatgttgtcatcatatctgcctttagttctttaagtatggtttcttttagttccttgaatatttcaataatagcttctttgaagtgtttgctatatcctacatctgggccccctaaaagacagtttctactgcctacttcttttttttcatgtgtatgggttgtactttattgtatctttttatgccatagttttaaaaacagaaaacctgaatatttaaaataataatttaaaataatattttatggcaactctggatgctgacttgtcttcctccctttcccccatccatttacctggtcattcatttgtttaatcgcttgactgtactaactctgtgatgtctatttctcctacactgttcagcttctgatgttcctgtttagattgtttttctgttttattttttgtttttcttttggctgggttccctatgagtcacccgtaggtctgcataagccacttattggtcaaaggttatgcttaggttcctttagacagttatatttttactctttgccatttgatgtttttatggcttggagtctgttattacaacttaagaagtttgttttttcccccaactttggccaaggccaaatgccttggaagttccttttctaatcacttctgagagggtgcggccttgagcatgcacacagccttccagattaccagaatgcaaataattttatttttaagcgtggcttaatagtattttctccagggtcagaatagcttattttttagccagtgtttgctcagaggttgtccttaaacaccttgagtgagtgagatttctgccctttgttgacggatctgtgtgcagcttgggaaatgttttcaagtctgacccatgtgttgttttgattgttcctgagtaggtatgacctaggacatgtgtgtagcttttcaacccccagggtttactgggatcccaggaaggcccttcttggttgtttctttccttggttctttctgttaaagctatggttgttctgccattttgcttgttgctagcagtatcgtgaagctaccagcacccccttaattgttcttcaccaagctctccattattttcagcaacacccttaagtagggaattctccgttctctgcactaaatgaagtcactaacatcaataagaactatggagctcttcatccttatggcttctctcttcccccaggagaacattcgtgctactgcaagggagctagatgcagtgatagtggcacctcccagtgtcacccagaatgatatccctagtggatgataagaagggaggaggtagttctcagccttgttggcttgcagcttccagtatgggaccacctcctatgagtgagctgagaaaggggtgatcagagtcttagtattcttgatggctacttagggtagagtttccaccctatgagtaggacttgggtagaggaatggcacctcagttctcttggcattgcttgactagaacagaggttctaccacaaggtaatggggttggggaatgagaaacactggtagtctgtccttccaaaggtgaaactgtagccctaaactgagaattgggtggagagaaagctcttacgttcttgtctgcacttggtcagaatacggtacctgtagtagagtttctgtaacatggggctgggggtgggagaggaaagcagatcatgacccagatgccacagactcttactgttctcatcaagacttggtaaattttcttggatgaatgttgtcctttgctgtatgcccttaggggagttttgagagacattaaattattttttaaataatttttcccactaaatattttgtggggtgaagatctgctgagttactcatgctgccatgctggaagaatcactgggatagccagttttgatctctctaaggctgcatgaataggtggtagaattctccaaggtattagggagctccttagcttgggttctatagtgttagtcagttttcttcagttgccttctgttaaatgctaatctatgttagacaccaacttaaatcctcctttttaagctctctcaattgtccagttatctgaaaaggattagcactttttttcccagatgagagaaccagactccaagaggttatgtaatttaccaagggttgcacaactggtaagaggccttgtttgggcatgaacaactgtcaaactccagagtttgtgcttttagtcattagactatattgcctcacatacaaatattttaatgttgtttcatttataagattactatttttagccatctagctgaagcagatctgtttcaaaagccgttgatacctgtactgtgacagcagaatatattggtttttgtgtgtttttttaaagaaagttttcttattcccatttctttctcattgtcatttctgattctacaactgggcctcctctttcctggctacctgcctggtattgaaaactaagccaagttactgattgctcctgagaccttcaaaacccagaggatatgaattttactcaccggaatctattctgttttccaagactcactttcaccccactcctcgttccatggggctcaaagtagataaacagttgtctggcaactggactattttaagctctgaagagactggagagttaggctggaccaggtgtggaaaagtcccacaggagacagtgtaaagttggcgtaacaggatctctaatccaggcagagtggtgcagagcttatcttctagcctctctctcaggaaacctgtcttctcactttggcttaccactaactagttgtgtgaccttggttgccatttaatcatcatggccttgatttcgtgacctgtgaaatgagagatggttggaatgttgaatctgtaaggtctcctctagattggaaagggtaatttttatgagactccataagggatcactgaagctagaatttacaggagctggattctgccaactatatgtgatggagtagattctttgtttaaccagattttttaactttttaattctagacttgaatattacagtatgtatgttagtttatgcactcttctcaacttcagtattacagtaggtatgttagtttattcacatggcaggattgagagctctgcaagttatctgtggagagtttgaagaaggcagatatacaagcaggccaagtccgaagagatgaaggacaaacttacaagacaggagaaagcacaatctccaatcagtcctgagataacatagcatacatcagatttgaatggaccaagtaaaagaatgagaatcaacagtcacatctgggacaggctgacatatgttcaagaaagaggaacttgggcagactatgcggttctttcccagcagacataactctgggtcttcatggtttatggtctctgagcccaacacagcaggtcattgagtatttattaatcctcattggagactgacatctctaccgaaatacagggctttcttaaaattttaggattgtatgtttttattatgtttggtgtatgttttattatgtttgtatgccatattatgttatgttttattgtatgttttatattagttagggggctcctggcggcctggactgagtcttatccatttctatattctcaacatctagcatcatactcagtaaatagttactcatttagtttactcatttatttgagaaacagtggatttttaaggtagttctttccttggggtattattcacttgtactaaaataaggccttcttctacattgtattagtctgttctcatgctgctatgaagtaatactaagacaggataatttatagacgaaagaggtttaattgaatcacagttccacatggctggggaggcctcaggaaagttacaatcatggcggaagacactccttcacagggcggaaggagagaatgagtggcaagcgaaggggaaagatggttatacaaccatcagatcttgtgagaattcactcactatcacaagaacagcatgggggttactgccccccatgattcagttacatcccactgagtccctcaataagatttgggtgggacacagccaagccatatacataatgaatgatgatactgttgagccatcatcatttactcagaatttccctgattataaaattaatacttgcttattatagaaagcatgtacataaatataaaaataataaaaatcacctgtattggtccattttcacgctgcttataaagacatacccaagactgggcaatttacaaaagaaagaggtttattagacttacagttccacgtggcttgagaggcctcacaatcgtggcagaaagtgaaaggcatatctcacatggtggcagacaagagaagagagcttgtgcagggaactcccctttttaaaaccatgagatcttgtgagacttattcactatcatgagaacagcatgggaaggacctgcccccatgattcaattacctcccactgggtccttcccacaacatgtggaaattcaagatcagagttgggttgggacatagtcaaactatatcattctgacttggcccctccaaaatctatgtcctcacatttcaaaaccaatcatgctttcccaacagtttgccaaaatcttaactcatttcagcattaactcaaaagtccacagtccaaagtctcatccgagacaaggcaagtcctgtccacttataagcctgcaaaatcaaaagcaagctagttacttcctagatacaatgggggtacaggcattgggtaaatacagccattccttgtgggagaaattggccaaaacaaaggggctacaggtcccatgcaagtccaaaatccagcagggcagccaaatcttaaagcttcaaaatgatctcctttaactccatgtctcacatctaggtcatgccaatgcaaaatgtgggttgccacggtcttgggcagctccatccttccaggctgctttcatgggctggtcttgagtgtctgcagtttttccaggtgcacggtgcaagctgttggtggatctatcattctggggtcttgaggacagtggccctcttctcacagctccactacgtggtgccacagtagggactctgtgtgggggctctgatcctacttttcccttctgcactgccctaggggaggttctccatgagagcaatgcccctacagcaaacttctacctggacatccagatgtttccatacatcctctgaaatctaggtggaggttcccaaaccccaattcttgactcctgtgcactggcaggctcaacatcatgtggaagatgccaaggcgtgaggcttgtgccctctgaagccgtggttcagattctacattggcccctttcagccacaactagagcgactggaacgcaggtcaccaattccctagatggcacacagtatgaggatcctgggcccagcccatgaaaccactttttcctcctaggccttcaggcctgtaatgggaggagctgcctgaagacctctgacatgccctggagacattttccccattgtcttggggattaacattcagctcctcattatttatgcaaatttcttcagccagcttggatttctcctcagaaaatgggattctctttactatcacattgtcaggctgcaaattttccgaacttttatgctctgcttcccttataaaactgaatgcctttaacagcacccaagtcacatcttgaatgctttgctgcttagaaatttcttctgccagataccctaaatcatctctctcaagttcaaagttccacaaattgctagggtgggggtaaaatgccaccactctctttgctaaaacacagcaagaatcacctttgctccatttcccaacaagttcctcatctccatctgagaacacctcagcctgcacttcattgtccatattattatgagcattttggtcaaagccatttcaacaagtctccagggagttccacactttcccacattttcctgtcttcttctgagcccttcatactattccaacctctgcctgttacccagttccaaagttgcttccacatttttgggtatcttttcagcagcgccccagtctactggtaccaatttactgtattagtccatttttgtgcttctgatgaagacatacccaaaactgggcaatttacaaaagaaagagatttactagacttacagttccacatggctggggaagtctcacaatcatggtggaaggtgaaaggcatttctcacacggtggcagacaagagaagagaacttgtgcaggaaattcccccttttaaaacgatgagatcttgtgagactttttcactaccaccagaagagcacaggaagccctgcccccatgattcaattacctctcaccagatccctcccacaacacatggaaattcaagatgaaatttgggtggggacacagccaaaccatataatcacctatgatattttcctctagagagtcattgctatcatttctatttttccttttgatatttctatatgcatatgtattttattttataaacttgtgttcacactgcatatagtttgtgtccttttatcttatatatcatgaacatttaccacatactagtaaatatctttttaaataagttttaatggctaccaaatttaaatatgcaataattaatataatgccttgttattggaaactagattattttcttatttttttctcttcttttaaatagcatgggtataaaatcttttaatgtagaaagaagtatagacttttaaaggaaattttatgtttttaataaatgacatataaaggaggaatcattggtatattctaggaagttgtaggagagtagaaacaattagttttgaaactgcttgtatagatgtaaaaaatgccaataaagttcttagaagctgttttattttttagtggttttagttgtttaaaaatgttaacacaatagatatgtaaacattatatataatgtacattttaatgatacaacgtaaatatatattttaattactttaaattattaatgtacatattgatacatttatattcttgatatattttgttaaattgttttccagattgtacacacctattctcttattagcagtgtatcttcaaaaccctgcaccttcacctgcatgggtattttttcctaatctttgccaatttgatgaaccaaaagtgatatttccctattattttactttgcatacctttgcttattgttcaagttaatattttcatatgtttactggaagcatatttttcttctttaaattatttgagcatatctcttgcctatttttctactggtgctttaatgatattctaattgatgaataataattcattattaatgaattattttaataaatcaattgtaattgattgtcctattttattcaaattgagtgttttaaaagatattaagatggtttgcattgatatatcaccttctttttcattttttcttaaaagcatatttctttctgtattttgaggatgacttagaatgtagttaatagactgcaaaatagcaaagttgactaatttccactccctctcccctatcaaagtgctctaaggaacagttctttaggttagcttacacatactttggaacatcagtgtcattattcgaagattggtgaatgccatgcttttgaatatgtaccagcaaacttaaggtctcagtgtagctagacttggatttttgagctgtgtatatggattggtacttctgctggtttatgtcaaactgtgtgtaccttatgacttttccttttgggaataatataggagtgagaggaaggacaggtaaagagcactagattgagctcaatgtgcagagttgactggatagttaatgttgagctgtggagattagcatctcctctaactggtttaaccagctatgaatatcttacaggattttaaatggtttacagaatcactgggtaagctaatgatgcagattttaaattgagcttctcaggaatgaatttgagaataattctgtagaaccaggctaccatgattcctgttgcctttcctagattaagcaatggcctttgtcagaaaactgccacagaaaatctagagattttcacaatggtgcttgtctctgaaacagcagaaaacagtctctgtctaattcctgctttccagatcttgttcaagtgcaaaaaattggtgacacttaaattacttctagaaccctaactgtagaaaatcccaggaatgtagttcttaggtgttcagtctttgtgactcagaaaagcacatttgaaggaccttgaatggatgttgaatgccaactctccatatctaacacaatactcctttcattatgtcccttaatcaacaatatgatatggacttttttgcataaataaacaagaacagattgccattggttatatagtacaagtaacactaccaatagcattgtggtcctctgtggttataggattagaatgaatttaataggacaaaaaggaatatagagcataatcatgaaaggaggtatctccaagggcattctgatggattgaagggaaattgctttaggctgtttgtcacatttgccatataagttaaagtaggtttggctgggtgcggtggctcacgcttttaatctcagtgctttgggaggccgaggcagatggatcacctgaggttaggagtttgagaccagcccgagcaacgtagtgaaactccctcactactaaaaactacaaaaattgccaggtgcggtggctcacacctgtaatcccagcactttgggaggccgaggcaggtggatcacgaggtcaggagatcaagaccatcctggctagtgtggtgaaacccagtctctactaaaaatacaaaaaattagccaggcgttgtggcaggtgcctgtagtcccagctactcaggaggctaaggcaggagaattgcttgaacctgggaggtggagtttgcagtgagcctagattgtgccactgcactccagcctgggcggcagagcaagactccatctcaaaaaaaaaaaaagttaaagtaggttctccttcattttttataccctttccctttatctgttttgtatgcttctctttcctaggccatatatatatatatttctggtcttactctgttgcccaggctggagtgcagcagcacaatcatggttcactgcagcctgagcctcccaggctcaagcagtcctcccatctccatctctcaagtacctgggcccacaggtgcatgccaccacacctggctaatttttcgattttttttaataaagatgaggtcttactatgttgcccaggctggtcttgaactcgaactcccagctcaagtgatcttcctgacttggcctctcaaagtgctgggattacaagcataagccaccatgcccagcccctagacctcatcttaaagactggcatttcaaaggtttctatcttttgtttataaacattctccttaagtgatatgatgcagttccatggccgtaagtaccaccttgtgcttcagccacatggggtctatttgcctttccctcaacatgtgagtaccccttgccttaaaagctgcttcttggacctctgtctaacctaaccctaaccctgaccttaacccaactcaacccctctctgcttggagaatttatactagtttttaaagactcatttttttctttgaagtctttctggaaccccaacctaaataaatttaattgttctttcatctctacttttgtagcactgtctgttttatacaatggtcagattttattgtagttgagtgttcacatggttatctcctctgaaaaactgaccttctccatggtaaaagccacaccttatttatctttccatctcctgtagcactaggcccagggcctggtatgtcatagatacatattagatatctgcatgttaaatcatgagtggattgtgaaaggtcacaaatttaaaaaggatatttgaaaactcattcatactaaaacaagcttcattttagcactgtgtgattctcataggtcttttgtgtccatgtcatatccaaataacaagaaattttggttggcatctcagtgaaagcagatgagaaagagaaggataaataaacatcaatcaaatggtgattaggttgttcaccatggcctattctttctggaaacttaagcagcacagataaagtctgggaagctacagcctaaacttatttccaaactcttgtctcataggaacctaaaatagccttcctgcatacttcaagcacatctagcaaaagaaggctttctatagccaataagttcagtccatttgttagtgagatgctaatttacctgcaaagtcccatcatcagataagtaattatttgcacatgacctcatctcctcttttgatctcatcaaggaaacagcattttcagtattttttttttagggcttaatctttgtctgatatctaattgcagaatgagcagaagtgctctagacagcctgtatccacagatgatactttaaaattggcggtatgggatcagttgacggatctgactacaaagtgtcagaggttgcaaattccttctctctgtatcaaattagggatggaaatgaggaagtagggggccaaggaatttacattgatcaagtgtttatcatattctagtctagtcattgtgcagattcttttatgtattttgtctgtgactataggggttgttcccactttacaaatgataagctctgggaggttcatcatcttgtccaaggtcacacagctaatacatggcagggtcttgccccaacatcatgccttcccagtagccttccctcttcaccttgcctcatggtagatctttttgcccatatcttttaagtatttccacttccctcttgactgtttctgtaagaataagcacacctatctcctatgcacacaaacatgacctaagaagcataaattaaaagacaaaaatattgctgaatttgattgcgtcagaacttagaatttctgttccgtgaaggataccatgaacaaagccattagaaggcaaaatgagagaagatattagcactgtctaaaatgttaaggaataaatatgtgggcctagagaatactggaaatcaacatgaagaaggcagtagtcctaatagaaaaatgggtaaaagttctgaattggcaacttaaagaagaggaagcctaaaagctagcaagtatgtaaagaaatgttcaactcattagtaataagtacaatgcaaattttaaaaacaatgagatcactttgtagcagggatgtattaataaaatgtgttggcagggctgtgaagacgtaggcaccctcatgcactgattggtgggtgtgaagcatggtgctgccattctggagaacaatctctagccaaattaaatatattttcatattctatgacccagtaattcacttttctggtatatttcccagagaaattattgtacagacccctaaaggtacatattcaaggatgattattatagcagtatttatgggggcaagatctatgtgggagagtggacatataaaatatgatggatggccccagggactatgacaaaacagttggaagcaatagactaatgtatgtattgcaacatgaatggctcttataaacataaagctgggctttaaaaaagtaaaaaatagaatgatatataatacaattgcatatgtatacatacaattttacatgcacacagaataatattttatattttgcaagaagatatacaatcaaaaaacatcttagaagagttttctacttaggacattgtgggagggagtgagaaatggggataaaagagaacaaatagttttttaaaagcaaataggacaaagagacttgcgatgaataggctaatgattttgtaccatgaattgaggcacataattaactgaacactctgaatttgatttttttttttttttttgagacagggtctcactctgtcaccctggctggagtgcagtggcatgatcttggctcactgcaacctctgactcatgggttaaaccaattctcatgcctcagcctcccgagtagctgggattacaggcgtacaccacaacgcccagctattttttgtattttttggtagagatggggttttgccatgttggccaggctggtctcgaactcccgacatcaggtgatccacccaccttgacctcccaaagtgctgggattaaatgtgtgagccaccatgctggcctgaatctgatcttaaaaacaaaaatccactcacctgtgaggcatgaggttaagatagatatatggataatttattacttacttcaagcataaaggaggccacttctcttttactctttcaatgcttatccagttcccttttcactcactattttatgacattcaattagatttttgcttttgattttatataatgtaaatacaatgtaaattattcactttttaaaaatatgtttttggtttttatgtcatacatctttgccattgttttcttcttcatttctaagcttttaagggcagggatgatatttcttttcacttgttattatatagtccctagcatggtgataatcccagtgttcaattttatgaaaaatcttctaggaggaggttttcctttttaaattctaaaagtgtggataatgttcctaggagagtagatgactaaataatgtaggctgatagcatcaggtatcctttttaataaacaccccattccatcttaacacctcctctctgcctcctctctgccttctctttagcaaatctgtctgccttttttcctgatagaaagtatcattggttaataactgtagattcttgataattgttattgtgaatgaattgcaaaatcgtggtcaataattaataggttataataagtattgagcttaatcaagtagaagtagtaaatttagatatttcttcttgatagttatgattccatctctttgtctttgtgtttattttttcagcttctctctgtgtgtctttttctatatctctctactaatcacctctttctttctctttatctccctctccctttctttctctttgtctctttctttatttttgactgtgtctctttgtttttatctctttttttcccctctcctagtttctggttcatggcctcaccaacagtgtagtccaaggctgatgcatttgcagctatgtcaggttagtgctctagaattaattagagcttctatcttttttttgagtctgtaaaagctttctttgacaggctcattgtagtcttggaattatagtcacttgaatcaagctggtgagtacatattttgtagcttcataacagtaaagaaacattttgtgatgcatttcacattgaaagtggctccaaaagagtcagtgccattttgatggcacttgggaaaatgcatcagtaatatcatttagctgaaggcactttgatttctccaggagagctgaatagaccaaggccttgtgagactctttacagtcctgattttcttttccttgaaaaatttcatggcaatttccaggaagtttcagaactttatgtcatcaaactgaaactttttttcttagaaaaacattaagatttttcttctttagtagtagatggcttaaaggttttaggtctgctattggtaaatgcattggatgttcaaagcttgattgactaagtgggtaataaataaaccactgggaccagatgacatcaacccagtatttttgaagaaagtagaaggtaatattgtcaaaacttggttcaattatttttaacccttgttagttggcactgaacacaagaactatcagatttttttgagcttacccttcataagaattatcctacgaagacttaagcagtacattttgttggtgattattatctctttatttcatccttgtattaatcaaggttctcaaaagaaacagaagcatacacacacacacacacacacacacacacacatggcctctttggaggccaagaagtctcatgatttaccatctaccagatggagacccaggaaagccagtggtgtagtttgaaggactgagagctggagaaccaatagtatacattccagtctgggtgtgaggacctgagaaccaaaaaatgctgagggcaggacaagattgatgtcccagttcaaatgatcaggcagagttattccagccttcttttgcctttctgctctattcagcctcttaatggttggatgatgttaacccacattggggagggccatttgctttattcagtccaccaattcaaatgctggatggaataagagaaagactgaagacagagtccagatttgagggatgaatggtttgatttaatggcttcagaagtggagaagcaaaaatgttaaagatctattaataccttttgtatatgagagatgaaggaattggaggaatcaaagattataaagctttcaagtttggattggtgagaaaaccataatggtattagagagaaaaagaagagggttgtggaggtaagttagctgaagccagtaatgagtttggttttcaatacactgaaccttttgaggttgattccataaaaggtagtcatgtcctcatatgcaatgctcccaagtgtcacagagtgataacaatggaccagtgtagtcactgatcccacccatgtagcatttcttattttcttcagttaaattctacaaactcatcagtatctcctactaatactgccacaacagtgatctctgcttagttatctgtcaggtcaacatactgtgagcctgattatggcaagggctgcctgtaatctgtctcccaagtcctgaagatagcacctgccacttggtaggtgatcagtaattggttgttgcattggcatccacagtgtgcccaggtcaaggtgatgatgatacacagatgagtcaaatgaggagatagcactggtgtaatgtgggaacatggagaagaggaggagtgataattctgtttgggggttgaacaagccttcaaagagatgtgacattgaaggataaaggatttactggggctaaggagggaaaaaagatatttttaggacaggaaactagaagagcaaaggcatgcaggtgtgagagtataagatgtgtttgctcaatgactggaggagcaagttcacagagaggagaaataagtggatggtgctagaactggaaacgtatgcaggtggactatagaaaaccttgctaaggctcttatgtgctctcacacttcttaggacagaaattatttttagagtgaggaaagaaggggagggaggttgttagatggtaatttaatctggtatcttttagtagaagcacagagaactgggaatgaagagttttgagttttaatttttgttgctaactaatgtgattaggacaaagttataaaaattctctgaactatctagggttagtttctgttatttataaatactattattagtagtataatttttatttgatacaagaattcctaaaagttttttttttcaggaaaatatctagtttttttaattttaaaaaatctaataaaccaaacaacagttcatactcttttggtcacataggcatcaatgaaataatttctattctgactgtcatggagaatcattagcctgttacctgctaatgttccctttgtcttttacactgtggttttttgtaaactatgtcagtcttactatgattcaaaggacattaaagcaaatggggtgtttagtgacaaaagtatttacaaaaagcttttttttttttaagttcacactgccgtattgtactctcctcaaccttacttttaagtacattttctatacttaatttgggagaaattaccataaaacatttagtgctttgttttctgatatggtttggttttgtcccttagttcatggaattgaacatttgccttcagactgtatttatgtattactttcatctgaagaacatttattaagcacctgtttgtgggcattgccagtgatataactggtctgaacaaaaatatagctaatgatgtgcaagcagaaagtgtaagtttcctgcagccttttaaaataatattttactgatcataaaagcaatgtgcttagaatgtaatatatgtagaactttgaaaaataaagaaaagcacaattaggaaaataaaattccatgaaattctactgcctgaagataagagctgtgaatattttggtctgtttgcatgctctggtttttttccctatgcatttaaatatttatgtacatttacaatatcttgtgaatgcttcccctcttttaaatgagagtatagtgtgattgttcaggacttggctttcctcatccaattaataatgacagtgtgacctttatcaacttatttcgcctttcaaaggctctgttttattttctgcaaaaagggaataatactagtgtctacttcacaggtttggagtcagggcaaaatgagataatgcatttaccgcactcagagcctggctcattacaggagttctttattattggatattgcagttatttcatttttttcatgtatgtaatgtttgctaagctatgcacagtcagtgccatcagtttccttaccattcagttgttaatcacagagtttgattccattacaataataatcgctgagtcagactttcaccccactgtaacttgtccctagtggaaatttttccattagtttctgaaacttgggacctctctgttgtttccctcatgcagatttggtcacactagatgacctcatttggttgtcgtggggtttatttctgtagtgatgatagcctcttacattccctccaccatagaacttggtagggatgagaactagctggacggggccagtaacggggttgcatatgaccttctgggtggttctagagtctggatctgagtcacttctggcaatggatcagccataggatttcataagagtggccattagagcccttttaagcagaatactgaagtctggggatggaaccaacctaggattaagagttggggaatcagctatcaccagcatgaggtgggatggagaaggggatgaggctagcacaacattagggaattttgctgctgttttggtgggcaatataggtttggctgtgtgtttgtcttcttgtgtcttggtgacatcttagagcctcacactactcccttcctcaacttatttatttattggaaaatataataaaattgagataatttttacctttaacataaaagttcggctctaaaaaatgtttggcaaagcagaaactctaagtactaatgaggatatgagttgctcctacagccactttagagagctactaaatgcaaataagcatgacctgattctaggctcacaccctaaaaaatctctcccacagtactaagacagacttgtacaagcatatttatagcagtgttgtttgtaaaaatatgaaattattattaaggaagagtagtaaaccaggtcagatttatacaaggaaatactagaaagcagttaaaatggatgaactgtagttacatatgtcagcctgaattaaacaacgttgaatttaataggtgtgttgagaattacaggtacagtatcatacaatttaaatgatattaaagaacatgcaaatgatactgtatttatgcatttatgtatagtgaaagtataaatgcattcattcacatgttgaatactgtatttagataacaagtgctatgtctagagaaggaagagaatgagatgggggagataaagcatcagagatttgtattctatggatatgtatttaagttaaaaaatgacagcaaaaacaaatatttgagggggtggataccacgttttccatgatgtgattattatacattgcatgcctatatcaaatatctcatgtaccctataaatgtatatacctattatgtacccacaaaaattaaaagtaaaaaatttaaaaggacaaaatattaagttttaaggagactgaagtatgttttatattctctatttgttatctgattaacgtatttcaccattttcttaaatggggaaataaggacagaggaaattaacatataaccacaacaaattctagcagtgcaagggaaagtaagcctttatcacactgctgatccctgatcccttgttcctgtggccagagaaaactgctgttttttttttaatttttattttttattttttgagacggagtctcgctctgtctcccaggctggagtgcagtggtgcaatctcctcactgcaagctctgcctcccaggttcacgccattctcctgcctcagcctcctgaatagctgggactacaggcacccaccaccatgcccggctgattttttgtatttttagtagagacggggtttcaccgtgttagccaggatggtctcgatctcctgacctcgtgatccacccgcctggacctcccaaagtgctgggattacaggcttgagccaccgcgcccggctgaaaactactcttaatagttacccatgaatcctcatgacagccggtgatatagaagcatattgtatgcacattccttttacacctgcatggtaaatgctctttgctcctttcactacactatgtataccttggaggtcatttatcctgcaatatctgaccttttcttctaaagaaacttttgcttcatgaaggtaagtacaactacagtttctctaaagctcagttttgaaatcagtgatataaaatacatagggtcagttttacatagtaagttgtcaagacagattgcactcagactcaaaccaaccttgaaaacaaagtactgtatatctgtatttacatttgaaaggctcttttcccacttcagtttgtcaaacagttgaatatgttaagcttgagactagagacaatgtcagggtgaacatatgtgagggattcacacttctcaaagaaaagcacgctttttgtggccttggacaaagctgggattccgtgctgttgttattttcacaagtccctctactgagatcatgactgcatcttagagttgctgttgaatacagatgatgttaattttgttctcattcatattctatttagtttttaccaaactaaatgtttattagttggtgatatttaggaagtttgataggattgtgactatatagctatattttatgaaaaatggaggaaaagttccctttaaaatacctaaattttttttgagttaaagaaagaaaaataaaattcatgaaatagtgacgtgaagcttggtagtttagctgcagctgccaggtgtctaggctggctcttgggagagattattatgggatcacagtgagcctggctacacagagcatggaaagtcccctcgtccttgtcatcacagagtttggcttacagacctctcctctcaaagatggaggcttctggtctttctgatattgttttctcttcctgtccctccttatagagagaaatccaaaatatttttgctaaaattctctagagttgaatttgggaacaccaggggataaaacccctcatgttaaggcatgtaggaggaaaggtatcctcttatcaatcgaattgtagttcaaatatgctgtaaacccacctgtttactccttcgtggtggccgtaagatgtgaaaaggcaggggctccagaagttctaggtaggagtcctttgttcttatgtttttcaagggtctcatggtgaccaacattgttaacttcttttagcctctgtttcctcaccctcaaatgaggtcaatagtatctactttcagaagtgatattcaaaatatctgatatgggagtgggacttggctgttatcagacagatggcatatgcatcccgtaatgttgtgcctggtgctgtaaggttgtgcctggtgaatgtcaactaggactgttttacagggttgctataagggtaagataagatcatgcacatgaatgtgctttgaaaactgcaaggggatacataaatttgtactattaatgcaaaatacatgcaatgggcaggaagtttgagaagtgctttgagctgtttgaccagaagattctttaatgagaataaggaattattgccctgtgatgtcaatgtatttaaatatatgcttattatacatatattgaactatatatataatatacatatattacacatatattgaactcagcaattgaatgcttaggtatttacctaagaaaaatgaaaacacaattctactcaaaggcttataggtgaatattcaccgtagttttattcatcatagctaaaaactggcaacaatttcttatgttgatcacctgctgaatgagtaaacatgctgtgatgcctccatacaatggaacactacccagcaataaaatggaacacatgcctgatggacacagtaatgtagacaagtctcaagtgcattatgctaactgaaagaagacagacacaaaacattacgcaccatatgattctatttctatgaaattctatcaaaggcaaaactttagcaacagaaatcagatagtggttttcaggggccggggtcaggggagagattggctgtaagaggtatgaggaaactttctgaagtaatggaaatattctatctcttgattgtggtggtggttacatgattctatatgtatttgtcaaaatctatggaattgtatactgaaaaattgatcaatttcattatacataaattatacttcaaaaaaatggaactgggtaaaaatagttccctcatgaaaaaaatagaaaatgcaatgttgaaagagaaaggaggaacattctttacaaaacaaaatgtttcttctttataggctatatatttcagtttcagcttcgagtaatgaattttatggcttcgtctcttgcattgagcattacactctagtgaacacccaacttgctaagtcgtcccccatacacaccttactgtttctctctttgttatcatttccttatgctgagcacttgcctggagtagctccctcccccagccttccctggggctctcatttcctccctcactcatttggttaactcttatttaccattgaagattcagtttggaattcaccttctccaagagccttcccctggtttctccccatccctttcacattggggctcatttgggtatccctggccattagctttgtcagtatactcaccagatttcactataagtagctctttatgggtttgtcttccccaaaagaggttaaggactatatcttacacacttttataccctggtgcccagcatgttgctgatggtcaatagatgtttgtagaattagtgattgggagtgccaaagggagtggtgaggacatgtgagattgtggaaagaatgcaagggaaggaagattatttgaatcccagtctctcacttagtggttagagtaactttggacaagttggttaatgtgtctcagatagaagatggagatctagacccatctactggataggattaccataagatctacataaaactatgatgtgaaagcactctgtacctagtaaagcagttcacacacataagttattattatgtcattggaagagtgttgtttctcagctcttggatatagcaatgtaaaccaaaccaaacggataaaatatattcaccttcaactttaagggtagtgtctgcattgcattgatatgttcacctgactccttatagcatctagttagaacttcctctgctcataagagacagctatagtcttgtcagtcctttcactctgttatttctcattgaagcaattgctaaccagtgtatataatttttgaaaacatggatcttgttttatttagctttgggtcctctatagcacttactagagttcattgcatctagaaatgttaaaatggcaagccaagtagaggttaacatagacatctagagaaatgttatccagttttccagagaaggctaaatatcaaaatagtgttgtaattaaatcttatttttagaatctgataaagtaattttgggttaccacagaaatctttcaagtttaagctaataaaatattaatgtcctggatctttggaaatctactaatgtcttcatttggaacttcataagaatcaagaatttcactgcatctaagatccgttttccacaagtcttaaaatctgaactacagcacgttatctatgtgatattctttctagcatttcataaacgtattcttttaaaaaaataattattttatcttgattatagaagaatggagtctataccttatttgtaggtgatagagcaagcaccaggcccttgacccactcttactgcctccgttcatcattatttttagtttctactaacctttattgtattatttggaacaaaatggaagaaaacctaactgggtgtataaattttgatgtacattaacaattcatcaaagtgatattatagataatgtgactgttttcataaacaaaacaggactaaaataaatgaatatgcagaagaaagtgtgagagatactgaaatattttgctggtatagtatattatgcagatgtttgcatttatgaggtagaactagaaaacaaaaaaactctatgttataatcatttttaataaatgaatttttatttccaggtaatttatacctatattcaagtcttggtaagcaatttaaaataatttgctgacttgttgatctcacctttcaaataatatgccaagggccaataacttcttgcaacatgtatagatatttatccaaatgtgtttttgataaggatatgaaaatatttggggaataaatccaatacttatgcttatttatggtacataaatcggagtttcccatgagtgaccgtaaaaattggaggaagtggaaagaaagaggaactgaaatataaaccaaatgtttgtttatgggctttatttagaaatccacattagtgattctgacattgggatattaatccaaaatttcctttctttgtggattattttcacacaaaattgtacattctcatgaggcaattctctttggagtacccatagagaattattacatttttaccagataggttctttttaatattctaatctagcaaatttgcatttaagaaaactactttattccaggatagcttttttgcacaagttattgttctgcccacctcccctcaaataaaaccagcatcataacttctcagagctttgtctgctttcaagattctttggcacctgcactgggttatatgccataccaaaaatgtttcccagccattcatgtttaaatacatttaagtttacattaatttttaaaaggattaaaagcaccttcaaaaatgaagcatgtattctctaagcagcaagtattaatttataggggctgttcatggaaaaaaatgctgttattgtatgtctcttgccccatgcataataaagaacttttctttttgaaagtaattgctgtaaaatattccttgagggatcaaaatattagtatgactgggaagtaggatctctgttcttaggcagattgttttgttacttagttccaaatataaaactggacaaaagtaggtgaggtaagggaatgatagagtggttagaagagatctttagataagaacatctttggcaacagggatagggccttcacgatctttcttaaaatcctggagcggcaggcttcacgtgggaggaaaccaggggttgccactagatcagctaagagacaagcaaataagaggctgggtgcagaaaatgctgagtctctccgaaggtttttccctcaagctgagctggtgtctggttttctgaccacatgttgtttcttctctttataagagtgaaacaacattcctgtttaaaaaaaaaaagccaaaatgtttgtcatcaagcctgacagtgatatgggtcctcactcaaatacagtgagacttcttcctacgatattggtcctgtggagttaggtcagaaggatgtggttataaaataaagtgatttcattttgtttatctcctactcagaaactttcagtgttccccctttcccgcagtgacaacaggaaaaggcccaaaagcttcagcatggcaggtggaggccttctagaacctggttccaatcttagcataacttttaccacttcctaactcaagcctcaactctagctcaaccattcttctatgtaatcaagagatattctaggcacttctggtgggaagtagagaataagccaaggctgggaggggtgaggcctggggaactttaacagagattagtacccagatcactaaatttggggttggagggtgaggcaaagaactctggtactgtctacactgacagtctttctaaggtacctttccaagaagagaagacagtgcttgcctagtgactgtgatggttcagggataatgtgacaattcttgacaccctgctgttactttacttatagatcagaacatattctgtgagctgatatattagattttagaaggagaagccaatcccaaaagacaggtaggaattaaatggggaactcaggatacccaactatcagtttggtggccagagctggacttgctttcttgaggaaattatgatgaaaaccagggcctgagtcttgcagtcaaactggcctctgaaagagagggctggaggtgggaatgggtgggaaaatggcagctcactctgctgcctaggactcataacgcctggtatatcagataccagaaaacaagtattatactattccagagattatctgtcttactaatagggccctgggtagggcagagcctataggcttttaattttgacacctgggcaggacaagttctttcagtgacggacacttatcttccagcactataataggcctcattatggtacatatgataaattatcttgtccaattaatttatgccactttagactaaggactgtcatatatatacatatatatacacacatatatatacacacatacatatatatgcacatatatatatatagtttctttaggtcttaccaaagtattaaatactttttgaacaaataacgtattttggggggcattattctgtccacttacctaaatcaaggatgatataaacaataaatacaatttcaataaattagattttaatttttttttaatgaacagaaagccaattgattggtttcctgaagctctattgtttcctcctgtcaatggaatacaaaatcacaggaactctttatcacttagattggagattacgaatgccgtgaaggcaagtaactgcctttcttcttctaattattttggaaagaacatatttttcactagaaagaccagaagctggaaagccaaaggctttggccacaaaactgtgaagggactctggatggatggaggctccacaagagcttcattccaaattaagatgttcaggctacattgaagaaagcaatctatttgccttggaaaaatttattagtgctaagagctaatatatgaaatatacaatctgtatctggatgtttgcatttctctaaatcttgccctcaacatatatatcattttcaataaatggttttgagccataattttttcattcattctatatgccagttggtgtgcaggtggtgttgatatagaaatgagtaaggcacaggtgctaacatcaggggctcacagtcctcactggcatcaggtgaagcactgcatgcaatacaaggacaagtcctcaagcaactgatgcatagatttttaaaaagtggtatagccatacaacagaatagtctttggcaataaaaatgaatgaagtactggtgcatgctaaaaacctcagaaacattaggataaatgaaaaatgccaatcacaaaagaccacattttatatgattccatttatataaaatgtatagaataggcaaagacatggaaatagaaagtacattggtagttgccaggggtttggcaaccccactttgccagcggagggtgcagatggggagtgattattaatggtactgtgtttgtcgtagaggtgattaaaacctttcaaaattgattgtggtgatggctgcataactctgtgaaatactaagaacctttaaatgaacgcttcaaatgagtgaattgtatgacatgtgaatttaacctgaacaaaggtattataaaaagagagagagagaaatggtaggaggagatagatctttcaaaaaattgtgaattaggggaagtagagaaaagggaaggtgttaaaagaagatgttttaatctacattggttatcaaatgtacacaacagttttaagtacacattctcatttcatccaaacaacattgctgtgattttgctgttatttagataaggaaatggaagcttggagagcttaagcgatttgccaaaatacatacaacttaacaagcagaatgggctattaaggtcagacctgaggaaagcagatcacagttgagggggttggaggaaaaaaagaaagaaagaaagagaaagaaagacaagatgaagatacagggattttgaattctctgatcccagaagctctcattggctaaatcacagttttagcactgttcacttttattcttttgtaggctaatgtactaagctaattatgtatttacattttaaattccttgaggactaggcaatgtctctatcatttagattcttctaggtacaggcatccctcggagatattgtgggttttgattctggaccaccacagtaaagtaaatatcacaataaaattttttggtttcccagtacatataaaagttatgtagtctattaagtgtgtaatagcattatggctaaaagaatgtacatactttaatttataaatactattaatatattgctaaaaatgctaactgtcatctgtgccttcagcaagttgtaatctttttgctggtggtggtcttgccttgatgttgacggctgccgactgatgagggtggtggttgctgaaggctagggtggctgtggcaatttcttaaaataagacaacaatgaagtttgctgcaatgaatgatatttctttcatgaaagattcttctggagtatgtgatggtgtttggtagcatttttcccacagtaggacttccaaaattggagccagttctctcaaatcctgccattgccttatcagctaagtttatggaacattctaaatcctttgttgtcatttcaacaatgttcacacaccttcaccaggagtagattccatctcaggaaactcgtttatttgctcatccataaaaagcaactcctcatctgttaaagctttattgtgagattgcagtaatttagtcatatcttcaggctccacttctaattctagttcttttgttatttctcctacatctgcaggtacttcctcctctgaagtcttgaacccctcaaagtcatccatgagggttggaatcaacttcttccaaactcctgttaatgttgatatttttacctccttccataaatcatgaatattcttaatggaatctagaatggtgaatcttttccagaaggttgttgatttactttgcttagatacatcagaggaatcacaatctatggcagccatagccttatgaaatgtatttgttaaataataagacttgaaggttgaaattgctatttgatccatgggcttcagattggatgttgtattagcaggcaagaaaacaacattaattttcttgtatatcttcatcagaactcctgagtgaacaggtgccatgccaattagcagtaatattttgaaaggattttttttctgagcagtacatctcaagagtgggcttaaaatatttactaaaccatactgtttaataaaccatatctgttctataaacagatacgctgtcatccaggctttgttgtttcatttatagagcactgttagagtagatttagcataacttttaaaagccctatgatttttggaaaggtaaatgaatattggcttcaacaaagtcatagctacattagtttccaacaagaaggtcagcctgtccatttgaagctttgaatccaggcattgacttctctctagctatgaaagttctagatcttctaatagaaggctgttttgtctacattgaaaatctgttgttcagcgtagtgacatacctcaatggtcttaactgggttttctggataactagctatagcttctacattagcacttgctgcttcaccttgcattttcatgttatgggccctctttccttaaatgaaccaacctctgctagcttatatgggtgcagttcatggtgctccaaaacaattatgatagtaaatcagaactcactgctcacaggttatcataacagatatagtaaaaatgaaaaagcttgaaatattgcaataacttttcttttgtagcttccttacttctttcagccatcatagaattgaagagagttagggctttcctctggattaggctttggcttaagggaatgttgtagggggtttgatcttctgtccagacagccagaactttcaccctatcagcaataagactattttgctttcttatcactcacgtgttcgctggactagcactttttttttttttattattgagacagagtcttgctctgtcacacaggctgcactgctttggtgcaatcctggctcactgcagccttgatctcccaggctcaagcaatcctcccacctcagccttctgagtagctgggactataggtacatgccaccatgcccagttaattttaaaatttttttgtggagacagggtctcactatgttgcccaagctggtctccaactactggattcaagcaattctcctaccttggcttcccaaattgctgggattacagcaatgggccaccacacctagccagcactcataatttccttcaagaacttttcctttgcattcacaacttagctaactgtttggcacaagaggcctagcttttgccctatcttggctattgacatgccttcctcactaagcctaaccatttcttgtttttgatttaaagtgagaaatgtgtgactcctttcacatgaacactaagaggccatcgtaggttattaattggcctaatttcaatggtgttgtatcttagggaatagggaagcctgaggagagggagagagcaccatgtactgcacccatataagaagagaaacctaatcaataaactttgtgttctgactgctccatcaaccttccggacaagtcagaacacaagcaacatttattgattaggtttctcttcttacatgggtgtagttcgtggtgctccaaaacaattacaatagcaatatcagagctcactgatcatagatcatcataacagatatagtaaaaatgaaaattcttgaaatattgcaagaattacctaaatgtgacacagagacatgaagtgaacaactgctcttggaaaaatggtatggatagacttgcttgatgtggggttgcaacaaactcgatttgtaaaaaacgcattcatctgtgaagcacaaaaaggcaaagcaaataaaatgaggtatgcttgaatatttggggacctgactacccatttgcctgttttgggcaactgtattctgagaaaaatctgagctcattggcaaccaatcagtagaagtagggtggccacagatacagacatatgtccttgttagttgttattattttgtaagagagtatcacctgtagtgtcaatatgtattaccctgccctgaactgataacatggaacacacattagctccaagtttttggcagagatgctgtcctttaactctttgttattcaatcctcatcaaatccttctttcctttttctaattgcactccttttatactcccgtatcaaatccttcaatgtaaactgttaattctatttctaaaatatattgcaaattcagccacttctttttctcttctgtgaaatcaggcctggccatctccatcatctttgtttaggtctttcttttcagctggttacattactttcaagtctgtctctcctctactccgtaactgaaaaactatattttttttctatggaaattccatcacatagctccctgaaggtcctcctgcctagaaaaattatcatcacacaattaccttttaaaacacatcttaaaaacccaatcagcaaatgtttgaggggctaatatgagggagcttcaaaaagtttgtggaaaaagtgaattaaaaataaaaatgaaaaatataacctttatttctcaacataagctccatcaagttcaaaacacttttgtaagtgatgatatcagccatttagtttatccctaaataactgggcactctaggtatataaccatatcattgcagtcttttttacattattaactaaagaaaaatgggtgccctttacagatttttaagattaggaaacaaaaaaaaatcaaaaggagttaaatcaggactttcaggtggatgcctaataactttcccttgaaacttttgtaaaattgcccttgtttgatgagcagaatgagcaggagcatcattgtggtggagaaggattttctggtgaagctctcctgggcatttttctgctaaagatttggctatgtttctcaaaacactgttataataagcagatattattgttctttcacctgcagaaagacaataagcaaaatgccttgatcatcccaaaaaactgttgccatgacctttgctcttcattggtcagcttttgctttcacaggaccacttccacctcttggtagccatggctttgcttgtgctttgtcttcaggatcataccggaaagccatgtttcatctcctgttacagttatttaaagaaatgctatagaatcttgattccacttgtttaaaattttcattgaaacctctgctcttctctgcagctgatctgggcacaatggttttggcacccatcaagtggaaagtttgcccaactttgatattttagtcagaattgcataagctgacaaatcaagatatctatggtgttggttattgtttctgctgttaattgtcactcttcttcaattaggacatgaacaaagtgaatttttttcctcacagattgatgtggatggtctgccactgcaagcttcattttcaacattgtcttgtcccttcttaaaatgagttatcgatctgtaggctgctgattcctttgaggcattgtccctgtaaacttttcataaagcagcagtgatttcaccattcttcttcccaagcttcaccttaaatgtgatgtttgttcttgtttcaattttagcagaattcatgttgcactgatgggggctctttttcaaaaaaatattttttattgtactaaaatatacatatataatttaccatctttatcttttttaagtgtgtagttcagtggtaataaatgcatttatattctatttgtttctttgactcttctcccctctccccttcctggcctctgataactaccaatctctatctttatgagatctacttttttagctcccacatgtgagtgagactatatgatatttgtctttctgtgcttggactttttcacttaacataatggtcttcaattccatctatgttgctgcaaatgacaggatttcattcatttttatggctgaatgatatttcattgtgtatatatatggcgttttctttcttcattcatctgttgatgggtacttagcttgattccgtattttcactattgttagcagtgctgaaataaacacgggagtgcagatatctctttgatgtattgatttcctttctttttgatatataccaagtagtagaattactggatcatatggtggttctacttttagttttttgaggaaccttcatactgtacattaggctgtactaatttgcattcccaccaacagtgtatgaaggttcccctttctccacatcctcaccagcatctgttattgtgtgtggtgagatgctgtctcattgtggttttcatttgcatttctctgatgattagggatattgagcatttttttcatgtacttcttggccatttgtatgtcttttgagaaatgtctgttcaaaccttttgcccaatatttaatctgaatttttttttttttttttttttttttgctattgagttgtttgaactccttatatgttctggttattaatcccttgtcagatggatagtttgcaaatattttctctcattctgtgtgttgtcttttcactttgtcgattgtttgctgtgcagaagctttttaggttgatataatcccaattatatatttttgcttgggttgcctgtgcttttcaggtcttaaacaaaaaatatttgcccagaccaatgttctgggacatttctccaaagttttattctagtggtttcattgttttaggacttctattgaaatattttatccattttgatttgatttttgtgtatagtgggaaatagaggtccaatttcattcttttgcatatagctatccagtttttgataggggctcttttaaaactgatgtcttatccttcttagtgcctcaaactagattctgttcagatatgttataataaattagtatgagtttattttgatgcaaaaaagttgaaatctatttttttataatacacatttttcatgaacttcttgaagacccctcctatttgccagacactgttctttcattgactaataaataaattctctctcctttcttttttcatttttcagctcttgggttttacagttttaaaaattaatttttaattagacaagtaaaaattatatgatttgtactgtacaagtgtgatgttttgatatgtatgtacactgtgtaatggccaaatcaggcatatccattacctcacatacttaacatttttttgtggtgataacacttagaatctatcctcttagcaattttcaagtatacaatctattgttattaactatagtcagcatgatgtacaacatatctcttgaactttttctaactgaaaatttgtgtcctttgaccaacttcttcccaatctctacattccctcatctctggtaatcattattttactctctgtttctatgaatttgagttttctagattccacgtataagtaagctcagatggcatttttctttgtgtgcctggcctattttacttaacataatggccttcaagttcatccaagttgttgcaaatgacaatatttctttttttggtaaggccgaatagtaattccattgtgcctatataccacatttcctttatccattcattcactgatggacacttaggttgattccatatcttgggtattgtcaataatgttgtaatgaacataggagtgcaggtatctctttgacatactgatttcatattctttggatatgtgtacccagtagtgggattgctgggtcatatggtagccctatttttaattttttagctctatttttaattttttgaggagcctctacactgtttttcataatggcattctcaatttacattctcttcaacagtgtacaaggattcccttttctacttatccctgccaacacaaattctaactcttcaccatggcccaggaggtcctgcatgatatggttcctgcctttttgtcagattttgtctcatgtttctctttgccctttctcactgcactccagccacaaaaatcctctttcagcttcttgtgaaggttttcctgcctagaggcttttgtaggtacagtgacctctgcaatgagtattcttgtctccattcttcttgtccatagttcgttagcataaaatccttcagtttttcagcttaaatatctcctcagagaagtcttccctgatcacctaatacaaagaagttttctgtccccctcattcttcagttagctaaaaataatagaaaacccaaaacaatagttgcttacacaccatagaagtttctttctctgtcatatgaaattatagataactatgcaccagagtgttagcaacccagattccactgtccagatgttcctttccaagcctacctcgtcatccaggatggcttcttccatctgcatttgagtgaccaggataaagacatgccaccccctttaagtaacatggccacatctagctacagggaagctagaaaatggggtctttttaaaactctagacagtcatcttcccagcaaaattaaaactgttattactaagggagagggagaaaatggaaatggagggatgaagaggagttacattccacattttatactcatggtagaaatggacttttgtacattattgtatcacatggcatttttaattatataattttcttgtaggcaaataactttcttatgggaaatttgtgctactcttaagcaactggcttgttttcctattatggacattgtgaatcttctgcctgattatgttttgctttttgatttgtttgccaggaagtttgtagctaaatttatggtcctctccagcaactacacaaatcctatgatggatattttttctgataatattatctgtagcgttattttattttactatactttcttcctttctttctttaccttcttcctttctttttattttcttcaatgtaattttgcaagtctcttcaaattcctttggtaataagtcaggaaataagtaaaacacaagtataaataaataaagtattttatatttaatgaaggtgataaaagtgcctacattatagggctgtcgagagaatccactgagttaatgtaagtaaaacatttagagcagtgcctggcatattgtaagacctatagaaatgctagttcgttattattattattttaattaaatctttcctgaagtgactgtcagataaatctgcttgataagacagttttactttaacttttgttctaggttaaacaaagagggaaagattaaaatatacatttaaggaccactcagcaacaatcattctatgtcttcatattctaatctacatggcagctagtaaatgcattgtgctgtgtaagataatgtgctaaaactcttagtggagatggcctctaaattttttatgtttagtatttaggcatcttgtagataaaatgtatggatgaataatcagatgaggattcaatgaccagaagtactgttgctctctctccatctctttctgttagaaatagatctccatcagataggtctgtgtttgaattttagatgtactaccaaccacactatgtgacctaggtcaagtctcagctttcatgtcaatatatttaccgatgggtggcagtaatacctatcatatagggacataaggattacattaaataatacatgttaagatctttgcatggttcctggccagagtacacatacaatagctatttctgatatcattattttcactcaagtcttttaaattgaagaattatcaccttttagcacttgaatttatattgaatctatacacacatcatttttttatttaaatatttgaaatccttaccctacaatccaatggaaattctgcaaatgtttaaagttttggactccatgacaaaattgtatagatagaatagtggttttaaatatggctcggggattacaaatggtccacatggatccttgggaatgaatcaagctacgagctcctatagcaataatatttctattaccatagcgtatgtgcctaagtttctggtgtggattaataaattattactgttgttaaatggatgcctggttttcttaattggtagctcatcaaaagcttattaaaaacttcctattcattttgttgatttcagtggttggggataaatggcccaggaggctctttgccctgctaaagtggatcatgaacaatgtgggatatttaattcaattcaattcagcaaacatattgaattcaaaatatgcaaaaagcattgtgctacaaattgtgacaatatcaagggacatcccctgtggtggccttctgttatttggtacccaggatccatttttattctatttgggaactacagccttggcccactccaagctatgtggtttgggtaggattggccccttacccaggtctgggggtggaatggccttgcttggcttaaggtagtcagcataaccctttcctatggccatggtattagatttatgagtgggcatataactcatgaatctttaaaagacttgtgcctggggcttctgaaaaaaaatgaagtctcctctgtctttgcagtgggaacttctggaaaagatactttctctttccctgggcctatagttaggatgtaaggtataggagagcctgcagatgttttgggggagaacaccacacagattttgaatatgaagctaacaccatgggtttggagtcggtctgacctggattcaaatccaagcactgtcactttctagtttggtaaggtatttgagcttcgttgtgcctccattttgtcacctataaaatgtggctaatgcccttactctctcctccttaaaactatttggtactggcttttaattgtaacagaattaacatcaataattggatttgtgcccatcaagccaatgaactttcataaaatgaaatccagaaaattttcatgtaattcatagagttcttatatttaacccatgtctctagaatcttcttctagtgacaaattatgttgtattgaatcatgtgaaactgagccaagtttatcattatttagggtagaaattctgttttgttacagtagtttcactcaagttttacttctctaagaagaacataagacacacttaaaattttaagcatatctacataaaaaagcccagtttgttataccattttcatagagttattttagccctctaatatagcactgtaataacattttgtacttgctacaaacataagcacactagtttctatcatttttgcccttggtttataaagatggaatttagaaagcaaatacatttagggatgaaatagtgaaatctgctgaatgtgtgtagaattattaaagagtataacatggctgcttgttttatttagaaatgacattgggtgggttagctaaccaaagctgccaatactgtattttaatgatcttgagtttatctcctatttacaattctttgtcatttagtctacaggtgttagatcacttaacacttgctgaattcttcagatttgtttgtttcctgccgtttggtgttgatcattttgatgtgtgataggaggaggaagtagttatctaattttcactgaacaatcttccctaaggtatcacatatattcattctatatcttctatcagtcagccatagattgtgaaaaactttgatagaaactttaaattcagagcccctgaattagtcagttttcactcagtaatgctatgataacaaacaacctccaaaatctcagtggttcacaaaaaccaagctttaattcttgttctgtatatatatatacatatatctgccgattagtagtgcctttgctcctgcctcaggtatctttttttaccccagaatgcagacagaaggagcagcttccatctgggacatgccattctcctggctgagggcaatgatctctctttttcttttttcttttactttttaagttctggggtacatatgcaggatgtgcaggtttgttaacataggtaaacgtgtgccatggtggtttgttgcacccatcagcccattacctaggtattaagtcaagcatgcattagctgtttttgccaatgctctccctccccgtactccactcctcaacaggcctcagtgtgtgttgttcccctccctgtgtccgtgtgttttcattgttcagctcccacttataagcgagaacatgcagtatttgatttactgtttctgcattagtttgctgaggataatggcttccagctccacccatgaccctgcaaaggacatgatcttgttcctttttatggctgcatagtattccacggtgtatatgtaccacattttcttagagacaatgccaaatcttgcaatggtccttaaagctcctgctcaattatgactgtatatcatgcgtattcatattccattggccagagaaagtctcttggccaagtccaagctcagtgtctttgactgagatatcgcagtttacaaggcaatgggtgggcatgagttttaagaggaaataatggaacatatgtcataggtctgttttggacagggctactggtgtatttttctcttatgtcctattcttctgctgtttttttctccaaaaactcccttccttggttctctcatccacccctccatcacttcctctgtactcttggctgccaagtagacccatggagcctactccacttttctgtccagcctgatgtagaatctttaggatataggacctaaattattgctttagtaaaaactggagctgtctgatgttataaggaatagctctactctgagccaagtaggcttggtatttactgaagtcatatccactttgttttattcctggtaatttggcttgaagtgaaattttaaataaaccagatacttattgcttatgcccactaaatatatgtccacagcccttaaataactacctttgtcttatagtgctttatggaacatagagcaattttaccaccattatctcatatgatggtcacaagaagcctggtgatgccaatattattgtgattcccatttcacaggataaaaaaaagttaagtagcttattcaggatcaaaaggctggtgagctttatagccagcattcaagccagggtatatagtgataggcatttcttgttattgacaaagaaatcctctgctttaagcatatatcgaataatgcataatgtaataaataccctgttttttcaaaaaaaagttacagagtaagatgttggcttgtttcactgaaaatattcaacttaaaatttttagaaatgtcttattagttttgaatgatctgatgactaaatttcagtttatataaaactttccctcataaaacaatcattacacagtttgggcactatgcttgctggagtataaaaccccattgcagtaaacagtgtgtcatcatgctgttactgaaagtggcctactatgctttatctccactgccctgtcccaatctaagccactgtcacctcttacccagaatgtggcagtagtcctttcaacagtcctctataccttttctgacttcctccaagcttttcctcaagctgagcctagtgatatttttaactgtgaatgtgaatttgtctgacttccctatccttacccaaagtccttaatacaagtctcccatgtgatatcaccctgcaaacgtggccagccttctatcgtcattctctccctcaatttctgcttactttctcatcttagtcctctctcctacccaccctccagccagtgtctcctagtcaattggcactcatttttcccatcccagcttcccagggaagctagccatgacccccagaccatgataactagcccattttagtctactgtagctggcaactcacctccatatcccacccattgccacacctggattttcctctgtaaatactgcttgaacctgactgaggtgcattatgcttcctgctgctcactttaccaggttagatgacagcggttttcatgaaagccgtccctcactcacgcacattagtcacctttacaaggaaacacccagtgattagagagaaagcaaccaccatgtcagccatgcttcaaagcaaccatattcaaaacaagttgtttttggaaaagagtatatttcatgttttagagtataaatgttccctgtgataattactataagaaatcaagatactccagtctgagtgcctgttcatgctgctgcaaaaacaatgggaaaagtttggattttaaggcaatccaatttctaaggaccagaagcagtctatgcttatggctgcttattgctagttgggttcttataaacctggagtgtcctacatttcatgttgaattgaacataatgggcctgtgataggcacctctccacaaaataacaaaagtctctgtataaactcaatattttagaagtcaaagtagacaggatactttgcttgtggcttgtcctcaggtatcagtacagcaagtggctctcagcacaccaccaaacagggcaggcagctggctctctagagataattataatttattgtgcccatggattttgatgcagtggggtctgggctctctcacaaggccaacagagcaggtctaatttgagccagatctcaggagacacagtccggagaggatgggtcatgtgccttcagttatcacttggagttgcactttgccccttgttcctctttctctcaactagtagctgagttttaatttttttccctgaaaatttattcagagagactgttttccttttcttcctggaattcacagaatgaagatggaggtccataaataccttggttaaaagttggaagatcatagagtgtcccactgtctgttttggggcctggcaggaatactcctaatcactgtaaatgaataggtgtttcatctatttttgtcttctcttctttgttctctacctgaaaatgtccttccctcattttcaggctactgaaatcttctaaagccttcttaaagtttcttctttataggaaacttcctagatttcttcctttagtcagaattaatgctgatttatgttctctcatgaaattgtactttgtactttcatttagtgctgtgactgttctttttaaagttattgtttacttatttttttctcctccagattatacaatccttaaggatagtactggaatttcctcatcttcctattgtccacattgcccagcgtgaaattttggcccagtaggaaggctatacatttgttgaattaattttgatctgtaaggcatattcttccacgaaaaggacattgcacaatcacaatattctccataaacaaatggacactcagaaagaactgttgtgttcttttatctgccttccatgaatgtgcagtttccttaccacttctccatggacctagttatcttgcatagtgcacacattagaagattatgtgataagagtagaaagctaggtttcctttgggtagggctagactatttcctgttcagaggtgaagacttctgaaatcagaatcaattttctaaaacataccacattaaaataagaccatagacacgtttttctgtctataagtctttttattttgatggtagaaaatgttgtaagattatttcattatcttcttattgttaactgttttggggaagaatcaaatcaggagagactgagattggagtctttttatcaaattctctatagactacatgatccgtgccaataccacagcagtcagcagctgttgtctgtgctaggagaccacagtagtaattacacacaggttaagtggcttaaaaaaattgatcggttttgaaaattaggtgtggaagatagaaaggaacctgaggatttttataatatttttgtgatataatagactatagccaaaagagttactttatagtgagtatttttagcttcagtcccacattctcttcagaaattagtattataatccttttcattactctaaccgagtctgatgactcctgtcctaggatgaaacacccctcccaactcccttattaagagattgggacctagtgtgattaacagcaccctgatcgatgagcaagattcttacagattaaggaaaagaattgctgacaacttaggctgacttttatatacctatttgttttccttcctaattcctcttaaaatgaaaatgccaagcttttcttttgatatttgttacatttgtgaaataatataacaatgcagttaatgggaagagcatgacccctggattcagatatccaatagttacaaatctcagcttcagcacctagcagttatgtgaactttcttctctgcacctcagtctcttcataataactactttgcagagttgctgtgaatattagtgtaaataatggacattcaaatatagctattactgttattatcatcatcaattattctacctatagaaatatgcaagttccttggaagtatacatttctggagagtgatcagggatggggtattatacttttattttttcggtttctcttcattcattcagtgggttatgggtatgtgtgtgtgtgtgtgtgtgtttcacacattatgtgctaggcactatttcaggcacttggaacttacattattgtaggggtacaactggaaactgataaatgctgtaaaaaaaattaaacaagctaagaggtacaggaggttgggagagagttgcaattattaatagggacattagggtaggccttactgtgaatatgacacaggttttgtgttcttagaggttttcatgaactatcttttggaatgggaggatgggaagaagggagatgagagtaaagagtaagagcttgctgatttgtaggcaggcatgaatattccctttggtataaggtgtcaaaacacaaactaatatggaagggtaaaattttctaggtggtctagttttattttattccatttgagcaaaaatcttcctaaagtattttgtacacaccctgccttcccaaacaatggctactgaatacagtggcccaccttgtctgtgactgctggaggaggtcatcaccatggctcacatctgttattggactttcatgaaacaagtccctcagggccagaagagatgctgtcatctgtttgtcctatgcaatggcctgagcctgcagtcattgtgagttctacccacatgtggctatttaaatgtacgtataaattaattgaaattaaatgacattaaaaattcagattcttagtcagtctagtcacatttcaagtggtcaatagccacatgtggctaatggctactgtgttagcacagatatcaaacatttctgtcactgtagaaagttctcttagtgttagttattttatatgtttctgactccaacattgttttttgtggtactgttgtcagttttcagaccttatttcctctttttgatttgttgtttctcatagctgataggtttaaatgccagatgtagaattttgtgtaaagtaagggtaaccaggctctaagagatcagaagagctttcttgtgttcaagtttttgtacttggaatttttatttctattctgagtgccccaaggcctcttttgcttggttattgttctgcagctgtactgtaggtgtaagggaatcagactgctgagttcctatgggagaagggctatcaaactttaaaggtaaaactgaacattcatggaaatgctttagatccagtcagcagtctcttatttggagcagcacaactccaggggtgcttaatgaccaactggctacatgtacgccaggcactgggttagtcccttgacacacaaacaagaatgaacatggacccaaatggaggaaattacagtttaaggggtagagagagtttcattaagtcaattcccagatatgtcccaggtactctgaaagtccagagaagggcggtacctgatccaggcttccctgatgttacaggagacaagaggccagggaatgctccctaaagaagtgattcttgagtggaatcttgagggatgcataggtactggtcacatgatgaaggtgggaaaaggtgtctgtataggtaggtgtctatacagggaaaagtgtctgtataggtaggcagactttggatgttgaaatgatgggttttcggcagaagtggaaatggggaagaggggttggggatgctgcctggggcagatctgactcttcagtagtttgacttgttcactctggcagctctgtgaaggtaaaaaggagccaggctggaggctggcacaccggtggtatgggagggccagggagtagagacctgtaatagttcaaaagagaggtaatgagggcctgctgtgagagtgtaagggggttgaacagagttcatgatttcaattggtattgatttctaaggagtaaaattatcagtattgggggattgattacatatgggggataaaggagacagaggaatcagagatgactgtgagttttcagaaaaacagattaatttaaactcttcttccaagttcacagtgataggttttgacctgtagctgctactagtgatttgcattggcaactgtggtgtctagattaggttttggcactttaggactccactctcttgtttgttaaaaacaaaacaaaacaaaacaaaaaaaaacttgaatggaagcatagaccataatgaagtaccaccctcgtgtgactttaatttcacagtggcctatgaaaatttatagaaatttggcttcatttctagtggctccaatccggatgccaaaattgccctattgttgcgacatcccttgagtggactatcgaacctgttattcattaggagcagctgcaaaccatcagccaagttcccatactatgccaacaataacgccagtcaaatttcaaggtaactccaggtttcagaaatgtatgaatctcaaaatctgtctagccaaactcttatttgtatttttatgtatgcatattatatgaaaaaagctggtggtttccttagtttccataattatacattgcttcttttagactataaattgagttctcagtgttggtgaaggcatacctatagatcttagccaatcactttaaagtgaaaatagaaattcagtctggatcatggtaccaggggtagccagcccaaagggcccattatgatgaggcctatattgaaagcaaaaattcttgcatacctgtagtgcattttaaaaggattttccaagtaacagttaacatttgttaagctttcagaaaaacttatttctctagtttttaatattaaggaaatatggaaatatatgttgatactttgttttttactgacatacttcatgactgcatggctaaagccacaaaacactaggcacttaccactttctttcttttagatatatttagccactgcatctggcctttgttgccaaatattttttcccttttactctaactactccatcaatttggatctttaatggtcaggcaaattttgaatgatttcttggaagatgtgaaaccctgttccctaatcaggaaaatgtgggcaagtcttatggtatgagaaaagaagggacatctcttctaacaaagacaacaggattatagcgccattacacaacatcttcaaagtttttatttgaaaaataatgatgtgtttggtgatgaacaagtaccgtaaatgggaagcatgggaagtttccactctttaagaatgtttctatgcaaaggaggaaggaaagcttactttttgtggttcttcagagagattacattaaccatttgttgaaagtttcatttatgaacaacattggcttctaagagtattcttcacacactggcatcctttgtatgatgttgttgtaggttgtttagcaacatatcaaaatagttatataaaaagattaatatgtgtttcattaatcctaaggagagctttctgaaattcatttttaaaaataaatgattagcatcattctttgaaatttgtgacttctgagggtgggaaagaattaaaaaagaagctatcttttcaagcagtttgtgatttaataccagctggtcaagtgagttgaaaaaccttatgatttttatgttatattattttgaatgccttttcactctcttgggaagttggctaaccccacagtccttttcccatggtaaatggctctaaaactttgatcttcttataccagtttgccagatgtagcagaaagagcatgtatgtgacctttcctgtgccaattcaacccagctgatgggaaactgtaagttaatcttgcatgacttttatttctaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggtgggggctttggcatctctcattcgatccgtggcctccttctccatctacaggtttgtcacaatgttcatttgaattcctttcaaaaacaagggttttccgtgaaggaaaagtccttatgaagtaaaaacaaaccattcaaatgaaaatacttattgttcatggagtttcccccccaaacacacacacccattccacatttggtcatttgtttgtaatatcttctttggcttttctggattccaagcatcacttgtgcattcctttaaaaagctttaaggcttttcacatccacagtgatcccattacattccttatataactaatatattatgtattttcattggaggaagaactgcgttcatgtctgcatttcatcaaagattcctaatgacttcagagggagccagcctgttttccatgttgctagagaagtggagtaaaaagagagtgggtgacatgatgggggccatctatggtatagtgaagagttagggaattagaggaacttggatacagacttggctctgctcccaaacaactaggtggtcttaggaatgtttcttaaacttctctaggcctcataattttcttctgttaaccaggggtaaagaataataataaatgtacaaaataattttgagattaaatgaggtcaacttgaaaaagatacttaattatctgtaaatgattatctacaaaggtccatataaatatttggtaatattgtttgagagtaacataggacttgtctttttctttgtagttttgattgaggtaatgccaaataactttattggccctcagtcctaggatgaaattcagtattacagtggataaaaagtctaaaaactgagatgtagatgttcagcctagtttaatagctattatggcagtgtcatacgttaaggataaaatatttgagaaacatggggaaaagaagcataactttagtgtgatagcctggcctaagatttttttaaaatgcaaaaataatagcagatagggtttatttgggtctccggattggatttttaatatctattggaaagggaagtttatttattctgcacaattgctatttggaactggagacacagctgcttgaccttaattagcaccctacacccctgaaaataaaaataactggggaacatatgtcagcagctaggaaatccagtcagaggaaagttgtacaaaagtgcagggaaaaggaaagagacattttccttatacagggataagatatcttcccaggggaggaggatggggcatgttaaaactacatgttagaaagttatacgactagttacattgatgtcatagtgctaaaaataatgttctttgcggggtctttagaggtttcaagactagtgaaataatgattgcaccatattcttttggatgattaagcttcccaggagggaagtcctaaaatggctagcttacttcccataatacctccatcaccccttggaataacatattcagcaagctgtggccattcaccatgatttcacggtcatgagacttaaattatggagctggtctgttgctttgtgaaactgggtgattgccagaaacctttatttaagaactactactcataagactaataaattcccaaatgatttaatgcacagtaatttgtcaggattcactggcatttttttttttttttctggcataatgaagacatctggaaacccaagctacaacttaggagtaccagtagaattgtccagcaagggacttcagaatctgttgctagcctctaagactgattataatgtttcactgattttatagccaatccatatttcactggactcttaacttgtataattctattctttcaacatttataaatacataataacattggactttacatagcactttagaatctttcccatgttactttatttgctctgacaacaattcagtggctcatgcagaagggtcattattagccctattttattgatagggaaataaaagttcagacaattagacatattaacatgtttaagttttgcatcctaagaaataaaaacgaaaataaaatgagataaactatgtttgtctacttctagcttattgtttttagaaccaaatttctttgatgagtattctatattcctacctctaattcctcacctttcatttgctcttcagactattatagcctggcttttgccaatactgaaacaggacttgttaaggtcgcaaataactgcctacgtgtcaaatttaatggacatttttcaggccatcatcttacttcacttttatgaagcacttgcctccatcaactgcattttcagtgtttcttctctttggcttccatgacttctttctcatgttttctctctctttcttgcttgctgtcactctcactctcttctctattccttccctatatctctggcttctcactgtgactgtttgacctgtgtatcctcatcatgctcctatgaatgcggttcatacttgtgaagatgtgacttgaaccacaatctacattgtggccatttccaaacccctctctcccatccataccactgccgccagctctaggcctatatattcacctgcctgtggattcttctctgggatgttccatagctatttcagtttcaatttttttcaaaattgacctcatccttcatcttctaagtcacatggtcctttattgcttttttctctttctgtgtccatcatttctaacagacactgagtctcttaggttctgctccttatcagtcatttcaacaattacacacggaacagctccatttcccagcatgactccacattccagcagtcagcaatcactaacacttttcccacgcaccacgtttcctcaaagtgttgtgactttgcatatgctttctcctctgcaaccctccatttcccttctcactgccacacacttatgagtttcttcctctggggatccctccctgatatccacttgtagcccaggtgagttacctcttttttggtatttccacatacatcgttctgtgcatgctctgtatcataatgtcttggaagtattgatagttttggttcgtgctttggtagagtagactaactgttgtaacaaacagcttcaaatctcagtcacttcacacaataggagtcttttgcatgttcacataatggtttcaagggggtggtcagaatgtggccttctgctcctttccatctgtggctctatcatttttgagatctgagttctctgcagagtcttctgcattcatctgacgcataaggggatagagagagaaagtcgataacctagagggagattttccatggttatccatatctaggcctggatatggcacacctcacttctgctgacattctattgggcagaatgctattacatggaggctaggaaatttggcctatctttatgtccagggtgaaaggaaagtgaatttggtgaaatactgcccagtctgccccaattgcctgtctccacactagactctaagttccagaaagacattgattacgtgtattttttaacctctggattcctatcatctagtataatgtttgaaacatggtaataacttaggaaatgtctacggaaggaatgaatttgtctgaggatgtagagtaaatcatggcagggctctcgtaacaaaccagctgacccggttcctggtgctctttgtccgaactatgtaacccatgtatagtaagtttgaaacaacttgaacttttagggtactttgctctgcatttggaggaaaatattcagatgcccaatatgccagattatacattttttctgccactacacttatgaacaaagatgttttgagttgctgattaaggaaaatagctcccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttgtggtgtaatcatcaatatcatcagccattttgggtctgcagtggtcacacagttgcatgacagatgtcctgaaaaaatgtccattgcttgttgtcagcatcgtctccaggttcattattgttattctctgtgttgccattattagtgttcttgggctcaactttacttctaggagatattccctttattaatgcttttctaatgacacttctttccatcaccattatcaactgagacccccccattagagcttttttagtttttctgatggtaaaatacctttctttgcttttgtcctgggaaatatgttttaagaataaatgcaattaattagagatttaagtcccacagaggaaagcttctctatggaacaatttgtcttgcattatttctctaatttatcatattgtttagtacatatttcttgagagcttcctagttgctcagaaatttccgagtactaggattactaaggtgaattccatgtgttttttgtcctcaagaaatatttttatgtagccaaaagagaagggggtaagaacatgtaagtgattagtgttatttattttatatttagtgctaagtgaatgattgggggaaagggataaagaaaggaaattactatttattaagcaccaactttgtactattctaaagggttaaagagtttgtctcaattaattctttatgtaacccaatagaagtagatactgtattggtatctcttttactgaaggagagacaggttcagaatgattaatggcttatcatgctacacatctaatgaaagaactaggattcaaactcagtctctggctctaacttccatgctgttagattgtaccaagcaacctggagagctaatgctataggaatctagaggagataacagaaatctgattggggttggttgcactgacaatgtggatttggggtgtgttcaataaaaaggcagaattgaccaagagaaaggaggtggaaagactctctgtaaatatcaaagcaaggtgggactgcatgatatatttgggtaaaacacaagcagatcagtttagctggagccaggcctcctagggggtcagagaaatgcaattctggggtgagaggaagagaccaggcttgaagaattcagggtagcagattaggcagttttaagtctaatgtggaggaaatggagaaccatggaatgtgttaaagatatggggtgaattttacagcagtggttcttgaagtgtggtccctggaatagcaacatcaacctatctaggagcttattgatgtgcaaattattaggccccacctaatacccgttgtatcagaaaagctaagggtggggtccagcaatctggtttaacaagccctccaggtgattctgatacacattaaagtttaagaactactgttttagaaagatcaatttggccattgtgcatagcatgcattagacagggaaggacaggttactcctctaataatgcagatatgaagtaatgagggcatagatgatggcaattggaatggaaagaaatcagcaggaggcatagtatgagaacattagaacttggggattgattgtattcaaagggggaaggagtaggggtccaagttgataggcaaggattaaaatctatgggatgaatctgtatttagttcagcccaaaatttaaaaatcttaagtttcaaataacaataaggatttgtggttttagagaaaaaccagatttggtgatatatcttgtatgttccattgggcaaacttcagctgagcagattagccatcaaattcttcttgttgatgggatgtcccccctcttatctgccaagttttcccctctttttttatatactttattcatttatgttgcctattcgagtcctgtagatatttgagctgatgatccctgctctaaggatcccagcttggggacaggagaataagaaatgtaggggtcgggagagggagctggcttggagggaaaccagccagtttggtttctagacattttgagtccgaggcaactgtaagatagtcccattaatctggtctttatattttgcaagaaaaacagttcagcatttccatttctctgttgtccgctttttagatcacccaaggcagtttaaaattctaggctggctttcttgcaataccttgggacttctgcctcctgctttcttagcatgcgagctcaagaatgcaaagtaatttttatattagcccatgtaaaatataattcaaaaggtaactctactgaggccaaactgtttgttgtattcccactgccacacatacattttttcctagttattttctccattgccccagatagttgaacagggactgcgacttttaatcagctaaggaagcaaaagactttctcttcactttactgtgaaaattgcatcaccacactgggtatgaactcattgaggtgggaatgagttgttgatagggcttggctttggaaatactactggctgatgttttatatcacttggcctttgtgtactgtattgacagagtatagtgaagaggaggaggaagaggagcaatttagtttgaagatgactaagagctgattaaacattcagctggggagagagatgagtgaatccaggtgatgtttatggagtgtcagagagggagaatgctataccatctggtgagagagacatgaaaaagtacataaatcaatctctataatgatacttaattaatacagagttgataaatgacataattgaagcaatgggtgggctacatcatagagttaaatagcttcaaagagggtgctgattaaagccattacaatttataaaacattcttcatgttaagaaagcatcttgatgagatttcacatgaacattttgtaatcagagggccagcttaaaacactcagagcagaggtgaaatgtcttaagaggtctattttggatgatttttgaaaaccagttattctcagggaataaaaaagcttgctttccccactccctttgttttttaatgggaaaaaaattaatgttgcattcttcacctttagacaatctcagatttttgatgtcctggtggtttggttcttaagcatgaccttaagataattagctatcaagcttcatttaaattgttttgaaatatcattgcaatttggggagcatatgtgcctgctggtgaaaaataaggaaaataccactgggactcaaaaactgtacaagtgactcacctcgattagtaggcttattttgtttttgcttaactcactctgaagctcataacagatgcacagtaatcaagcagaatgccaattctcatcattcatgcaggtggggccactgtgctcccaagggggaaccagagaagacccacaacaaacactgcgttttttcttctcatcatcctttcttttccccctttctgatttttggaaggtacattctttgtttggaaagcctttgttagaaattccaaaatgttctttaatcactggattcttattattgtatcaggtagtgtgacaggcatgcttcctcataatggatagagccaggcaatgtattttggagcccgcattctggagactccatgcctgtgtctttgttcagccacttgccagatgtgcctcattggtgcctcagtttcatctgtaaaatgggggaaatatcttctttgtttttcttcctggagttttgagggttttctttttttgtttcattttgtttttgtttttctgaggcagagttttgctcttgttgcccaggctgcagtgcaaatggcatgagttcggctaactgctacctccgcctcccgggttcaagcgattctccggtctcagcctcctgagtggctgggattacaggcacccgccaccacgtccagctaattttttgtatttttggtagagatggagagtcaccatgttggccaggctggtcttgaactctcgacctcaggtgatctgcccgccttggctcccaaagtactgagattacaggtgtgagccactgagcctggccttttgtggggtttaaaagcagtaatgttattaatgcctgacctatagtaagttttaagtacatgtaaagttgctactattatacagtcttattaactattgactggacatagttattgaatgaaaaggaggaagggagggaagcaggtaatcagggagggattgagggaaggaagaaagagaagaaaggaaagaaagaagaaggaaggaaggaagaagaaagaagagcttgatttagttaatgtcactgttgtaattggtggattataattgaagctgtctggttgggagacaaaccctatgccatttagatctctgtctgttcagtttgtccaaactctgctggggttatgtatttactagtctgtctccctttttggattggcaattctgcagacagactgtgtgtcttactcatctgggtatcgccagggctgtgctctatacctggcacacagtagtgctggaataaataaagagctggaagcagcacatccctttctctaacatgtaaattcaaggtgtcaccatttcacattcatagacattgaataataatgtagatgaggtgactaaccttttgaattgctactcatcaaaaatggaatctctggaatctgagaggagactatatagttatgtaaatttcggcaaagtattgcaaactccatattactatggtgctttgtggggctgctataattaatggtctgtttgcatttctagtacaggctgtcatttttcatctgcttataaccttgatataaacatttattcttggctgctattttgcattcataattgtaaaatatatataaacgttaaccttctgtttttcagcttttttatttatcaaaagcacagctcaagaatcacatcattgtggcatgtttttctgaatctctagtggcaaaaagaaatgaatgcattttgaattcaggcttcaggattaaggcaatgttgtttgcttatgcagtgccctttgaaaaatgtgtaatgtagcatatgaaccaaaagaatcctgagaaactttttccagccggtctttttctattacttatgccttttttatccctctgtgttcctccccacctctgtcatcagttcaagatgactcttaaagtcctcttgcatccatccaaatgacccattggcctctttaggtgcctggagaaagtaccagcaaaggtatttgttggagtctatcaaaggtaacaatacatagagtgggtttcaaaatcagacaggctgggttctattgttggctctcccatttagatgctgtgtgaccttatgtacattaaacaaccagtgtgagcctgttttctcatctgtaacatgtggagaacaatgtttacctcatagagttgttgagagaattaaatgaaatcaagcccttgacacagactgaaacatgggaagtgattgatgaaatataactgacgtcttatcttggccatggtcattattatcactgtcatcattagatagtgatgggactaagctaggtaggttgacatgagctgacttatcttaaaaggcaccagctctagatagagccctcctcagtgttcaaagactcaaaagacttgggttctgtttatctcccgatttcgggagcccactctccttagtctccctcagtcattgactaaaaactatgcacttgtcttttccattctctctatcctcatgttaaatgcttgatattgttcttgcaagctgtaccaaagttgtggtggcccaaatcagtatcagtggccagcttacccaaaatgcagcaaatattctatttcaaacaatacccaagatattttccacctcagggcctttgcactcactgtcccctttgtctggaatgctgtttccctgctttgtgtatggttggctctgtttcaatctttacattttaactgaaaggttctttttgtgaaaagcctttcctgactatactaagtagagtagcactctccctcaaactctctcacacataatctcctctgtatgcacagaatcctaattatatttggtaatttatgtctatctacctacctacctatctagttttcagcatgtacttctgcataaaaatataaattgcatgaggactggaactgtgtctttcgtgtacctcattgtattctcagtacctaggagattgctggcacagggcaggtacttaagagatattgattgaataaataactattttaaaaatcatctaagacaatagagaaccaattaaacagatacatactgtattatagctatttttctgaagccacattctaaagcaccacagatttttttctcaattttttgttttgttttgttttgagacagggtcttgctctgttgcccaggctggagtacagtggcatgatcatggctcactgcatccttcaccccctgggaccacagacacaaggcacaatgcctgtctattttttaaaaaaaattttagtagagatttttgtggaaaaatataaatctatagtaaggctgaaagaatagtaaatgactcatttactcttctgagatcagacaagatctcagtgtggtatggccatagatgtgactcatatactctttataagaaattgcctaactttttatttttatttttattttttgagacggagtttcactcttgttgcctaggcaggagtaaatggcgcgatctcggctcactgcaacctccgcctcctggattcaagcgattctcctgctttagcctcctgagtagctgggattacagtcatgcaccaccacacctggctattttgtatttttagtagagatagggtttctccatgttggtcaggctggtctcgaactcctgacctcaagtgatccacccacctcagcttcccaaaatgctgggattgcaggcatgagccacggcgcccagcctcctaactttttttaaggaagttgtaccattttatattttcggcagtcatgtgtgacacttcaggctgctccacattcttgccaaaatttaattttagcctttttggcagatatgtattggtatatcactgaagttttgatttacatctccctgatttctgaatccctctttgtgaaaagtctactccaggcttttgcccatctataatttttttaaaaattactgagtggtaggagttctttatataatttagatacagatccgtagtcagatatatgttttgcaaatattttctcccagctgatgtctttcccatcttttgtgtcatagagtcttttcttaatagtgccttttgatgagtagaagttttaaattttgaagtctaatttatccacttttagttgctttcttttatatgcatctacattcattactcaatattttgccacatttgctttctctctctctctctctgtttctggatcatttgaaagtaaggttgttataacactgaaaacatttcacccataaatatataagcatgtattcataagagcaaggaccacctctaacataactgtaatatctttgtcatgcctaagaaatttagcattgctatagaaatattatttaatttaaaattcatccatattcagattttcccaattgtttcccccagtaatgttgttgatcttttctttctgaattccataatccaatcaaggacatacattacatttagttgtcataaagctttagtctccttatatctaaaattgctccctagtctttttagtattttatgacactaacattttcaaagaatataagggagttattttgcacaatgactctcagtttggagttgttcctcattattagattcacgttaaatatatttggcaagggttctatatggataatgtcatgcccctcattgcatcacataaggaaacaaataatgtcacttttccttattggtgagaccaaatttgatcacttgtctaaggcattatctctggatttctttatcgaaaggtagcattccacctttgtagaggaaatacattgcaattattgtgggatgctcttgagactttgtgaatcttaagttctttaacaaaatttcacccagtgagattttaacatccgttgatgacccctgcctgaatcaatcattgtactggaagttgcaaatgtttttctaattcaattatttctattacaattatttgctgtgtgcttttgtaataaagagcatctgcctccttttccttctttttgtttctgatgatcacttcatgggtttttaaaaaatgtatgtgataaaattcattactatcatcattctttttgataaagcatcaaaaatttcaaaataattaatgtaaaagttagcattacatgataagcttgaatatttgaagcactggaaggaatactctttttattcatccaaagttacccagactaccacagataagtcaactaattaggagtgtgtaatcaatatcatttcctctgaactttttattaacagcatgagctttggggtaataatcctgaagttatttttagtttacaattgccaatgtatagaatatgcaaataaagatccttcatcccatacataattgctgttaattgttaaaataagtgagcaaaatctcaggtccagcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccagcagggatgtatctttaggatgggtttacctcatatctgtgtaatacagagaactataaattatccacccactccaacctccccatgtcatcagtggttgtgaaggggtaactagcctctgcctgggtgtcaacagtaatagtttaatagctcagtgaatgtctgttgcctcactggttactgctccgtagagtaaatatttgacatcaaggacaagaatttaatttttaactttctcaacttaattttattcagtaaacatttattatgtgtcttctatatttcaagccaggagaagacccaatttttgtaggggtaggaacttacataatttgggggcctctttaagaaaaacaatacaaagttacttctacacatttagatataaaatcaacatttatttacaatagggaagaaattataacaatttatgaatttaagagagccaccaaatactacaaacgtgacacaattcagaaaaatatcttgttttgattaaataactacctatcaagctgctgtactttgtctgcattttttatttgcacattctttgattgctctttgtatgacagtgcttttgtgttgtagtttctaaaacaagaataaaaaaggaattcagtctttcctgtagtatggttgatcataatttagcttttattattgatagtttggaaaagtttatttcagctttatagcttttttattggtagtatcattatacaattttaggattgttgtcaaatttgggaaaatgttatcaagttttgttcatgtatgggctgtaagatttcaggacattttatgtttttgtatagtgacaatgaatgaacatcattccatttagtttgctgtctagatcctcgtttttagtggcattttatgaatttttgttatgtttgtatttgtcagcattttgtgtcaaaccaacaagaaatttcaatcttttctcaaggtgatgtactttttcattatttggcttattgagtgatctgtgagactactcatcccaaatacccaaagtatgtctctttctgtcaataaactgtagttttgtatggcttttgtctgggaatgccatactttgtcagaataagatgtggtgtatattttaacatgtaatccaatatgttaacacaaataaaactgtgacttcatacatagatgcatttgctctttgagctctacaatcacaggaattctgataaattctattttgcatgacttccttaaaaatataaaattagaggttgtgttcgcaatagcatactctgaattactgaacctattcttgataggagagaacttccattttaagtaggaattaatgaggattggatacctcgactgcagttctgcatatctgataactggaagcattttccagtgactggcttctggatctccaccactgtctccatgctttcactgccagatgttgcaggatgcattcttgttacaatatgacctctgaccctgtgtctttgtattatgacactagtagtcccgggacacattcctgtaccaagatggaaacaactgtgaatcacctaagcacatccctgtaaacccaagccaatatatctccaggtcagcttctcctagctggatcctcaatgcctatagtcaatccagtgctgctccatatgttgggaagtatgacagaaaggaagtcagagtggattaaaagattccacacctttggtgtgcatggattggtgcagcccttctagtgagacatccccagatgttagctgataacatcctcaccctcatcctccccaccatcacttctctatgttttactggcctgatccagtttttggtggcttggcacttggaattctttacaagcactttctttctatattgacttactatcatttttagaacccagattttttaaatgttcaagctggatgaacccttatacatttgctctactctttcattttataaatgaggagcttggggctgaaggtcattcagctaagtagaagaacaaggacacattattttttagctctttatgccatctttcttttctttcaagtctccatcagactacacccagccttccaggattaaagtaagttaattaggcatgcattgatttgatctccgtaggtcccccctaaattgatatttttaggagttagaatattcaatgtgctccccaaatgctacgtaatagtggttttttgctcattttgatagggcttttagcagagtgaactgtttcgtggacactgtcacaggaagtggaaactcaccttgtgaaaaggtaagctttccatgggctttgagttttcctttcctcagcaggggaagggcctatatgtgttagtgttagctgcctggccttcctctggggcttggtttttaatctccagggaggcaaggctgacaaaatgtcatctatttgcctactaaggaaagaagctgtgaaatagatctccattgcttatgcacctcaagtcgcttagttccagctgtatccataatatcatggtgtatttaaaatactgctcattgcaatccttttgaaaagagattctgatgctcgtaaatactccaaaaaggcattaaggtgttacactgatttttatttttattttattttattttattttatttatttatttatttatttatttatttatttatttattgagatgcagttttgctcttgttgcccaggctagagtgcagcagtgagatcttggctcaccacaacctctgtctccagggttcaagcgattctcctgcctcaacctccctagtagctgggattacaggcatgtgccaccacacctggctaattttatatttttagtagagacagggttgctccaagttggtcaggctggtctggaactcctgacctcaggtcatccactcagcctcccaaagtgctgggattacaggcatgagccactgcacctggccgctttttatctttaattggatttattccctttagaaaacttaagtttgtggattcatatccaaatattgccctttactgatctagctttttctgctgtaagttctaggaaccttttaattcagagaggggtaaagaaaagagctagcatacactcaatagcttttatgttttggatgcttcataaatatcacctcatttggacccttacaagagctttgggaggcagggagctttagacacattttacacctgagtaacttgatcaggacattttgaaaaaaaggtttttgattatctgtttttcaacttgagagagtcgtgagataactaaactacaaatgaaaaatacgtaggtaagtctctttgtaaggtcatattcgtaaaggttgcaaaagagaccaaacaatgtattccaattgagaagtccaggtagagtatttggttcatttgtgctgctataacagaataccatagactgggtaatttataaagaatagatctttatttctcacagttctggatcctgggaggtcaaaaaacaaggcactggcagcttctgttgtctggcaagggctgttctctgcttccaagatggcaccttatttcttcatcctccagaggggaggaacgctgtgtcctcacatgtggaagaacagagggacaagtgaaccaaatctttgtgtgaaacctcttttataaaagccttaatcccatttatgaggggaggagccctcttaaaggccccaccacttaatatcatcacattggccattataagtgtcaacacctgtattttggaggggacactttcaaaccatagaataaagaaaacgaaagggggaaaactgcaaacaaatgtgctatgagattagatggatttgaaggggactcgacagtcttgggccctttgttttggaagatggattttgaaagttatcttttattgtattcctgtgaggcccatttgtttcctacccttttctcttgtccccctcttccttctctttattcagtatcttcctctggcaaatagcagttactaaatttggttctctgttatcttccaactcgaaaggcaaaaggcacaggcagtaccctcctggtaattatttatgatatttctccttccagagatttgccctatggcagcttcaatccgttaccatcactttttatttttttgcccatattggcagcttcccaagactttgggaggaaaaagcagatctgcagatacgcaaacctcaaaatcaagacttggttaatgaaatcactcctccacttgcccttgcctgttactgaatcctgttccagctgggatggaaaaagtgcattggtcatgctgtcaaaagcatatcacatttctccactgctatttccttccttcttaactaaaaacaaaacaaaacaccatagacaacaaatagacacacacacaaaaaaaaagacactaggtgagagtgaaggtagtttgtactattttcatttttcgtgtgttcaatcgtatttctctcagcaaatatgattggaagtggtgcttttccttccttccccaccttccagcattaggtttgtaggtgaacataaaaatacactgacactcaaagaaagagctctttctgctctgcacacatcccatctcgccctcttccttgctcctgcttatttctctctctttctgcctccttacctccttcagtttagagcttagagaagtttttcactcttcttttgacaggtgtcagatagacagtatgagctcatttaagctgaactgtctgggggaaactaaatttgttcaggagaatagcaatttggatgacaagtgccaggacataccagatggcacggctggagaaattcttatcgggctcccagctcacgttccaggcggcctctctgtctctctcctctattcttatttgttcatggttgacccagatggaaacttgaaatgcaaatgtatttcttcttggaagtttccaagtaaaaaaggtgatagtgactcagcataagatgcttacatgcccccaaaagaatagccagtacttgttatttatgcttattactactgatgcttcccagacccctgtgggcacatatttgaagaagtcttaattgtgagccctaaactgattgtgtaattccagttgtttactaaaataggactgttacctaagctgcaaaatatttgatgttcttgtcaggatgtgaatggaagtgttcttaaacattcttcctcagttgccacacagtttgactgattttgttggccctcactttccagaaagggaaccgtggacataaatgtcatgggaaggtatttagtagaaggtgtgatttttgggggcgcatatgaaacattctaaaattcaaggccagggcgctgtgacaggctctaatctatgaatcattatattcttaacatattctgagaacaggaagagaaagctcaacctttatagacacagatggaatttctcctgtgaagactggtaattcatgtgacatttgctgtttgcttttgtttgcagtcaaattctttctctcaaccttgcactgtgctgttactggtcacttaacagaccttctgaaagagcaatataagtttatattttaggtacacaaacaaagcagatgtttataatactgggcatgattttttttttttttggtcaatatttggttcacatgagaagatcaactttttctagcctgtatactttggctctgaatttacgtgttttgaaaggtttgttgttgttgataatttagtgatgaaacttactcgtggaaaaggcttattgtgagtgaataaataaatagtataggctaaagtgtgtgtagcctacattatttggtagtgtagtgtacactccacatacttttatcattttaattttctactaaattatgcatgtcctggtattaggattcccatagtcatggcaaaaccaatgatggtaacgccatacttatctggaggttaaagtttcattaacaatttaaggtggaaatcagagaagaaggcctctgagccagcctaatagctattctaaccccacacagcaaggtagtatattgtattgctgctcttctcaccaagagcttctgggcctttagcacattatttttaacatgtttaaatttctgggttttgtggacacatcacattagcagatgtgggaatgatagaggttattttgacatacagagaggagacaagaaaacggaagtgtaaccacaaagctgggttgccacatcctatggaggtgtaaattcataaggataacattgagtcacccagaaaagttgtattgtgtcttccttttaagaaacaatgtgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagcagggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaatgtggtggaactaaaagcccagtaaaagtgtaacatgaaaggaaaggctatgttatattcatccaatagggtgtgtgtttgtgtatgtgaatatgaagaaatttatcataaagaattggttcatatgattacagaggctgacaagtcccaaaatcttcagggtgagtcagcaagctggagacccaagtgagctaatgctttagttacagtctgagtttgaagcctgagacaggagaactgattgtgtaattccaatcctaaagctagcagactggagaccaaggaagagttgacgttttacttcaaatgcaaaggcaggaaacattcttcctcaattgccacacagtctgactgattttgctggctctcactttccagaaagggaaccatggccataaatgtcatgggaaggtatttagtggaaaatgcaatttttggggtccatataaaacattctgaaattcaaggcttgatatcccagtttgagggcagcagggcaggaggaattctctcttccttggggagggtcagcctttttgttctatttgggctttcagctgcttgaatagggtccactcacattgggaaaggcaatgtgctttgctcagtttacaagtttaaatgataatctcttccaaaaatgccctcacagaaacatccagaataaagtttgaccaaatatatgagcaccctgtggcccagtcaagttgatacataacaatcacagccatccttccagttagtcacagaaagataccttcctgcatctagacaacaggcagctgctgaggagggctgggaacagcagttcatgatctggtatcagatcatgaacccaggggtccagcacaaagacgtagatccagccctgataggagaatgcctggtttttagaaatagggggattagcttccaaactatagaaagaattcattcatccattcattcattcattttaaaattcaggtcttaattcaaatatcacttccccagggaggcctttctgatacattgtctacagaagtcctttcagccgctctcatttattcattcacgaaaatgtatcaggcctaccctgtgaaaggcactgggaatccaatagtgactgtgaataacaagcaaggtcccttccctcacgcatcttacttactagtggggacagacagaaactaagtaagcaaataaagaaggtaatttcagatagtgataaatgccataaaagataaaatagggtaatgcattagagtgttgatttgaggacagggggaagttacactagatacacccgttagggaagacttctccagaagagcagtcagcttggattgaaggatgaaaagtaaaagctccattcagagctcttggggaagagcctcttaggcaaaaaacagctggtgcaacagatcaacggacagaaccatttggccagttctgggactgaaagaaagccagtgtgactggaatacactgagcaagggagagaaaggtcagagaggtgagcagagaggttggcagggcaagatcttcatggaaggtcatataggccctgattcagagcttgcattttatcctgattggaaataagttttaagcagaggagtgatatgatctaatctgtgctttgggaagatcactgcccagcgggacacagattgtgtggagcaggaatgttgtaagaagtacagacatgtaggaggctattccaatagtccaggtgagaaattacgatagctgggctagggtggtagctgtggagacagtgggcagtgggcaagcttggctgttctgtgaaaaagtcttcaggaattgctgatggtttggatataaggggtgagaaaaataaaggactcaagagtgactgctaggttttattttcttaatggcacatatttttatttgaaattatcttgtttatttgtgtacttctttactgttgatctccctcatcaggctgtaggtacagtgagagaaggaatcttgcttatcgtgttcactgcctcagcctcagtatccagaagagcacctgttccttgaatgtatgtgtatataaatattgattgagtacttagtatggaccaggcctgtactaaggctgagatacagaggagaacaagacagagatgacccatacgatcatggaggctgcattctggcagaggagatagacaataaacacatgaactgagttgtttcaggttttcataaatgctgtgttgacaaaaggatgaagagagtggttaaggaaaaacctcttctctagtggttctgttattctacatgtattcactagactctaacatctgtgaaagcaaggactaggtcttatattcttcgtgtagtgctaagaagatagtatgtgcccaggaaataaaagtgggcttgtcaagcctggaagccatgctcagttcctggagcatcctcagtacctgttttgttatctatgtgatgtgacctgctagggaaattgtccgagtctctcctttcttgtgtaggttgacaatgcctagacccatcagtctctgcctggacaggcctgtaatttaactgcctgcctggctctgattgctaataggcatgggtagccacctatggatttgcacagccacacacggccttgctgcaaatttagcagcagatagtgcctcaaggtcactagagaagaaatgaatctgtaaggtgaataaactaaggccaataagcatagagtgccagaaagtagtgcccagagggatccgaggggcatctgcatgtttattaataaacaaacacacaaaaacccccgcctcctcctctacttaaggaacacagtgagatctcctcttatgaagtcatttctcccatgacttctgctttgaacagaagattttcaaaagagctttgtttgcccttaagcagtcttatcctcagataaggataaacgatcagaggaaaatttcactgggttgttggtcagctatcaaaatgaaaaatgaaaaatctttcttaactggagtaagtgtggaatgcttgaatagtgcagcagcttttagtcattcttttacaactgctgtacacattgcagccagaaaagacattttagttgtcaggtagtcaataaatatttattacctgcttcctgtatactggttctccactgggaactgttcctaaaggtttgttttcttgttacttttcttgtccctgtgttcctcataactcaaaactgctgacccatttaggaggtatgggaaagcaagattgatcagaaagcagactgggaagagacaagtcatgataattcttatgctgtcaaaaactgagtttagcatcatgctaagcaggcagtattcaattcataattcaaaactgagtgtcgcagtgaatggggccctgcaaagtcaatgtctgattgttttcttgctgataagcaccatgatcagaggtctcttcactttggcttaaatcataaacatgtttggagcacctaccatgtatggccactctcctaagagtgaggtaggatattgaggtactcccagtgtagtgtctggcttctggggactcagtgttaaatgagtgtggagaagatgtgtatatgaagactgtgtcttaagggagaatgtactaagggaaatatgaagtctggtaggtacacaggagaaggagatattaatacttcctggggggaatccaggccttactagagatccttctgcacactgtcccccagctcctcactttgagtgtttcttttggattattcattttctctatcttgtggcaggcctcatcaagactggtatgtgcatctgtgtttgcttttatcagataatcttctacctactttgagtttaccttctatttctaattccttgcttaacttctgggttccttgcacagcagcgtctgatatcctgcatgttagttctttgttttccctacccaactgaaaattactaatgcaaaattatattagcaaaatgggcataaccagaatcaccactgctggggtagttaatgagcagaggtctcccatttgcttcctgcccaccagtctctctcctgccctttcaaggcagacgggttgctggctcactaatttcccacatattgcaatcttttcctgtgatgcagaaagctatgtgtatttccccactcctgaggtgactgaactgtttaagtagttttgataattcgttgctttaaaaaatacacaaagatttgaataatatagataaatgttttccttgactacccacaccaccctattgaggtcagtattcttagatataacgaacaatgtgagtttgatctatattcttccagactttgttcccatgcactgacatatgtatatgtgtgtgtgtatgtgtgtttgtgtagttttgtgcttttttctaacaactcagctgccaaatgatcagtgcatatagcactacttcattgtttttattctcttgagtgtcattcatgtatttctaactctttgtatgcctaatatttttttgtttgaatgccaggcattgttttaaaaagctattgatgctccataggtttacctttcctctactaggcagatcaggttgaaagactgattgccttaatccaacaactgactaagttgcatcagaacaggttgcaattttgttaaattactttttgttctccctatttcagaagcatggccctccagggcttttgattgtaattctttgtctcctcagcactaagagactgcagaatatcttgtctgcttttgagagatttgggcttagctctttagtcttctgtactgtgcagcttctgaacatgacaaataacttgacagggagaccaactctgtgttcaagtctcctcaaatcttcaatttaaccactgaagccgtacatggtttccagaggatctgctggtttctttgtcccagcagcttccctctgcctgaacctaccctagattccattctctagaatgagccagcttagggtggcaagtgtccctgaagttggctgcatgtcctcagatcacctctgaaatctttcctttctataattttactgttgttagaacttttggcttcattaactttctaatgtccttaaatatgtgatttttataatttatttaacttttctagttgtttttagtgggcatgttggcctgccatgaacaacttcattatacttagaagtagaacttctccctcattgcttttaactccttcagattctttcattgcatgatgtctgtggcttatttggccatttccctgttgatagacatgctgatttttatttgtcactgttacagtcttataatttaaaatgaagtacatacattttgtgtacttatttatagcaattactaatatctggaatttctggatttaaaatatggatttttaattttaatagagattaccaaattgttctccaaaaagacttaaatttaaatctcaggggctgaggcttccctttaaataaaccaggtctatctctgatcttataggttggccctagtaccaaacagttctactagtaacattgagagttctatgaactcttttagagactctgagcacactgaaagcttacctgctgtgttgtccttgccactcttacctcagtgctctcctgtgggtacatttagtacctttacaacgtgtgcagtgatcatgccatggattacaagagtttaacacattttctaagacaccaagtgagtaatgtagatactgaggagatattcagtagaaaaagccaaatcactaataatagcatattttcaatatacaggcaatttctcagttgaaaagcttagctattattgctatggccatggcttcaaagctgtgaggttcgctttttatttatattggcaattttcccatgtgcttataaaaatcagtcctttggatggttcactcagtgtatttgaataccttttccaattctctgaagctccttgatccagtaacagtttctttccttggcagaccatgaggagtgggaaagtagctttttctaagtaggcattgattggcattgagcagtgggaaagattggagctggtgaacatggggtgtgcaaatgtattcagccaacaggagctcttccagttcatagggtggatctgctggaatagttgccttggttctcctttcacttcagggtggaattaagctcctggctcaatagggaggaagcaggataagtcttagcctctggacacttaacctaaaattctaaagaaaaattccttattccttttttccttttcaatggcttacctttaaacagcattaatatcctgcctgttgtactgaagcaagaaactgtagtatctattttcaaaactagtacatggattttcaatgtgagtgtcttggtaataaatgctggtttattttgaatttaaaaatgtattttgattttgtactgacagtttaactctttgaaatataacggaggaagggtcagaaataaagcaatctttctttcttctggacttatttattcactcttctttaaacagttgttaaatctctcttatgcatttgacattgggctttgcactagtgatagaaaaatgaataagactgtgacatcttttggtactacatcatataaattgtctagattgtacttctaagccagcatgagcattttagaatataagaaatagaaaccaaaccaagaaactctagttcggagcaaaattatatgcccagttgtctaagaaagggctttgctttttaccagtaatttagaattttatgactaagacaaagcagaaaattgggaagaacagtgaaaagggcaagaagttaatggagtgcggtcagagctgagaggacaaaatctaaatgaaagggggaaaagcaataaggattgaggaaggttgtttaggtcattaagcttacaagatcttctatttcccaattagtacattctgaccctgaagacgtttaagtacatgacgaggatgtcactggagtgtgacaaattcttcacattctcacttccctttgctaattctggcgtcagaagttattgcagagaacatagtcaaccgtctgtggagatacatctaaaacagatgtgcctattgttaaacaaacatggtatgtttaaatccatatttatttattaaacaaaaattagataattactccgattatctggtacccacagggatcatacaaatgacaaacacaaagggccagcactctgagaatgagaagcctagagagaggccaggctgggatagtgccaaccctgacataagatagaatataattaggactttaaaggaaatacaaacaaatattgtgggcactcaggaagaaaagcacttttggtggttgtggatacaggtagagggagaaagcacaaacaactcagagaaactttcttgaaggagatagtatgctaactggccatggaaaattgtttgaatatcaacaagtgatgggatctcaacagggataaaggatacaggtgtcataggtaaggtagtggcataagcaaagccatgaaggaggacagcttgtttgatgactagcagtgtgtgttataggagatggggtggaggatgcagagaaacaatgtattttgagaccacacaactatgcctttaaatcccagcccttccgcttatgcatacgggaccatgcctaggttgcttaacctttctaaatctcagattactcatctttaatatggggacaataatattgatttttgcatttgtgtgtgtgtgtgtgtgtgtgtgtgtgtgtgtgtgtctgggagagagagaaaggagagagagaggagagaaagactggttataatctatgtaaaccttctggtgctcaataaatggtagtaattattatggcaagtagttaggctatctcaattttggacaatgtgttagataaaataaaaaaaataatttgtgatcaaattttgggtgatcttaaggagctagtttaggaatatggagttactttgataggcattggaaagccattgaagacttttgaccagggaatgatgtgattagggcttagaattgcagtgctgattctagatatattgtagagctacgacataaaggattagacaattagatatgaaccatggtgtcagacacctacatatctgttctttactctcttgcagttataaaaaccctgatttttagctggaaacatgactgtctaaaatgaagaccctatttacctgttttgcttgtggctaagtgtgcctatgtgacgatgttctggccagaagtatcatgcagtagcatacctaaaagatggctggcccaccttcttctttatcacttcctccatcctgcttcttagattacctgccatcttggtctaggtccagctgctaatttggaccctagcaatattggagggatgaactggcaggagactgagtcccaaagaacttcatggaacagaattctgccataccatcccttgactaaatttcactagccttctacatgagaaaagaatgaactaccttgttgaagcctctgagattttgagattctgttacatgcagttgatcttacaatctgattctaaccaattcagatatggaggaaataaatgaataagaacttagtttctaggatttcaagccagtagccattataggaatataaggaaacatgtttggagcagggggaggatgatggttttggtttgggattcaatccaggtggagatgtcaggtaattggaaacaaatgtcaggagcttggaagagaggccagagttggaggtttagacttggggtgggaagcaggactttaaatagctctgatagttgaatgtatgataggggaagacattttcaagggataaaagtataaaaagagtgcaaaaacctgaaggctgaccctggactaagtgtctgcttatacaggtgaggaggcaatagagatagtgaaattgggcaggaagaggtgtggtgaaggtgagggtaaagggaagaagagttgaggctgaattaatgagcttatttcttttgcatatggcatgtaggagaggaaaaggattcctaggtttctcatagtcaagaatgtactgattatatgcatttgcttcattaatgaatacagtgctattttgtttagtgtttcaggaaatgctttgattccagcattgttttccgcttttaatgcttggaaacagctttgctaggctcttctcaggtgagtagctgcacgccaaagtgtctcagtgacagcattgctaaggagttttatggagaatggatggtcttgactggaaagtcacttaatggcttttaaagttgtgagcagatgatcatactgtataagtgacagactgtgaagtctgagacctcatgaatggttttgatgttggcatcagataaaattactaacaaattagatctgacatattttaatggtatgtataattattattggtctttgtgattataggctacatagtaactgctatcactggtaatagccagtattacttttgtctggacacacaccagacatttacggaaatagctggaagaagaatgatattgagaattgagggagagggtggtttgtgccaaaaggaaggtttggaagaggtggacactattcctctctcacttcctaactggcttattctggagttggaggcctgcagtgcctcaccctgtcaagctgacctaggcacctagtatgtttagctgttccagtccccactctccagatttggccacattctcccagttggaaatgatggaagatattgccatctggagttctctgatttcctgtaagttcttggagactttatgcatggccccacccaaagcttttccttcaccccaacaggagagaaggaggctgcagaccacagaaacttcagagatgatgatttatgtggactcatcagaagtctaaaggggcatgtctgtgttcttaaagggtacgggaacctcagagagccaattggcccaagaagcagtatgtagaatggctacatattctatattttcaaagatcaaacagtgcagagtgcaagattataggaaacccaaaagggtcacaaaccaggataagaaaatatcccattcactgccatattttccaaacctaaaagagtgcctcaatcaatgtttgttgagttttaaataaatatctttatttcagtaatatttaaaaatgtatcctaaatctacttgttgtctgtattttcaaacatagggaaataagcaccaatagctaattggaggaataggatgggggatggggcacagcatgaggagaggagtgagagtatgtctctcccagaaaacatttattgtaggtattgattcaaattccagttcctttcattcctagctgtgtgatactggacaagttacttaaatttgagccagagtgtctccactgttaaactaagtaacaatatctactttataagattattgtgtaaagtaggtaaaatttatgagaacatgcttaataaattctaagtgacaaaatgttaggtgttattactgacatttataacaataataataataataaaataataaagattggaacatggccagggagtggtgaggggtcatagcattggtgtgaaagttggatttgaatgtcagtttctctggctcatatggtaactctgcctatccaggatttaacttagaatcaacagctccccaaacaacagcagagctctatccagtttgaacacttgaactagttcttttactcagtgagaacctgtgagtctgtctggagtagagaggcgggtgttgagattaaaccaccacagtgggctgtctctgtcttagggaagaataacagagaaggagtttctgcacaccagtctgacttagagctgagcagcacatagacgtgtacccaggtatctcatgccttatgcccagcgggacccttcctggtgtgtatggtcgatatgctaccctgtggagggtggctatttattgaattcctattccactcaacttcagtttatctgactttggaggggttgcaacacggccttgcctcttatgctgagctttctttggaattgctatgtgactgtttctttgacagacttagttagaaattcagatgatactgatttaaaatagacccgtggggtttgagaacagttagagagagcacagatgagaaggagaggttaaattttttctaaactcaagttgtcagtactaaattcattatcccccattaacaggcataataatgaaaataataatgtataactttttcactccattcactcatttattcatgaaatatttattaagtgcctatgtactagagtgtatactaaatgctagacatatatagataaatagataaaccatgcctgtcttagggagtaaggtggaaagcctgagggtggcatgtaggttagtctggcatataatctcaacaagcttttggaaagatgaaatggttgtacttagaggcagaaattgcattggttttggtcacagatgtagcctacctccattgcctgccacagaacctggctcagctaagtacccaatagatgttttttgaattggcttaatatttctaattgcatgattaagtggccagaatcagttaatttaacccatgagtccttttcactccttttacagagctagaaactttttgtggccagtcaacctggtaaccaaacatttaaattctggtaattggtaaatatgcctcgtcacaggtttgttgaatgatttatttttcataaaagcaggaggttcatgacaagctcagcaaatctgttggcagttttaagacattataccgggtagtttagggaaatttctcagcacatgagaccctttagattatgtaatattcttgcaaggcaactaggaaaaatagtttttaaaattatgtctattttgctatatttaaaagcagaaattatcttattacggagaattgattaaatatttgatagcatttttgtatgatttaacatatttataggtgttaatttctcacaaaatttaagttatagctctaagtgtagaattaatagtttccctttgattacagtttttttggtgttaacgttcatctatttttggatgatttgacttacccttcctttttaaaattcagactctaaatttaaggctatacatcaccatagtgtttatgaagtgaattaaatcttacagaatgttccagtgcaatctgaaactacagcaactacttgaggttttatgtctgaaaagtgttttaatcagtgatggatttggaattattgcagctgattcctgaattcttaggcctaggccttaggaacacactatccagatgtttataaaatgccattttaccaatgtcctgtttatactttgactttgtggttcaaaaaaaatacatttgcctacttcaaagtaccagatgaaagtattttacatcaactaaatactgcatttgagctgcccaacagtccctaacactgactccttctgccttaaaggcatttatttcctatcatcacctgttttctccaagacatgtgagaagaataaagcctgtattgtggcattttgtgtgaatgctaagatcttggcaatgtttcttataccttccctagctcttctattttccctaaaaagtattctctttttgaaagaaaaatttaatttctcaatttcttaaaccagattattaattaaaactgcaaaatgaaggaaggaacacccactaattcttcaaagctcagcaacagaatcaaatcctttgaagatctgtctgcttaactcatcactattaatcagtttaagactatttagaaaaggtactgagagaaagaaatgaataaaaatgggtgaataaggcaatattaagctgacactttatagtccggttggtagagtaaaaaagcaatcaaacttaacagctttttaaaaaattaagaatgttatataggttgatgttatttttattattataaatataatatttactccttttgccaacttggaaaatgtagaaaagtcaagaaaaacataacattcatccatgatcccaccacccagacaaaaccacttttacctttcccctattttttaagtcattttttgctatgtaattaatcaatttgcataaatacaaaattgaggtaacggtatatgcacaattttgaaacatgttttaatcactttcttgtggcattaaatattcttcaaaatatgtttttagtggctgcagagttatgttatgactttctcatcctttagttggtctttagtgtgtttttatggtgtccagtttcagtattcatgttgatctcctttcaccctttgtcttcactgagtcactcttggctcactatggtaatcattagcactggtttctagatatttctggctcttcacctgcacataaaacagggctgtacatctcagtcccttggagtttgggtgaggacatgtgactttttctaaccaatgagatgtgagtagagcatttaattactgatgagagagacctttcagagtgctgtcctctttgccacagtgactggcagctttccagagagtggctgctccattagcgtggatcccagagtgaggttgaggccaacataaacacctaattggcctgggatggataggtaatgtgagaagaaaatgaaactttgttttagtgagtgaaatcttaggggctgtttgttatcagtgaataagtttgcctgtcttaactgataacaccaatcatttgtatctagattgggaatctgatttagaccttgtggtcatcttatagactcatgttcaccttcacatctgtaaattatgtggcaggtcatcatatacactttctcaaacaattggggaatctttgcccctatgcatctgttttcagggtgtttctttagttgacttcaggcgtattcaataactcatatcatatacatacataaacactcataccttcattctcacaatgtttatgattagccttgttcatacttttctgttgcctaggaaaatgtcaatagaaattttaaagtaaagactgattttttttaaagtataaacttagtagttatatgaaaatgagaaaattcataaggaaaaaatcctgtcatttcccctgccattcaaacctatttttattatcccatatttcctctattccctgtgtataaaactttatattgcttatcatagtttacatacaacttgacattttctatatatataaaaattttcatgtttttcctacacttcataattaacattttaatggctgcaaaatattccactgaaattgaacaccgtaatttatactacaatttccttattactggttttttagtttgctgcaatttttttgaaattctgttggaataaataatttttagagcattttaaaacaaatatactagaatgtatacatctaatcagtattatcatataaataacttctaagtctaaacacatattctaatgcaggtgccattgatataaacatttctaatctcttttaaaatggtctttatggccaattgatgagctacaaattaaaaattagtctcattattttataatatatcttgatttggaccccaaatcattcattcattttgttaatcatattttggctgttttcaaaagttaattctaattttaaagcaccaaattttgccttcatttagaccatttggaaggctgccaaatgctctaaaggcaatttcagaggaaaagttccaaaactgttaacagcactgggcaattgctgcgataactgagcagcctaccatagtgatggttttagagaaaaaaacactcctttttaaatgtgagtttgagtggatttgttactgtaatcattaaatccacaactctatagtcacactgggcatggatgtaatattgttcaaaataaatgccagttgcttgatagcagggactgattctttcatgacatctacattagtgccttgcacatggtaactacttaggtatatttgtgatcgagtctgtgaaagtgatccctgttgagatcacactttttccattggcaaggacctatctttgaataaatcctttctgctggtgaagtcttgaagtctccagcactctagacttacagcattagcattatgtgggaatttgttagaaatgaaagttctctggcctcaccctggacctactaaatcagaaattctagagattgggccagcaatctgttttagcaagacttccatgttattctgacacataataactaaatggtaaagttagcctgaagaaaaactgaaaataaaggtcaaagaggtgattctataatgaaagaaagttggtgttagaagccacagactagcaaaattcaataaacatcttcagagcacctactgtggtccagaaattgagcttgtagatactaggtatgcaaaagcaaaatagatagtgtctatacagaagacataaatgtgcgtaaatgggtataaaataaatacaatgctgagtgatacttcgatatagaagaatatacaaaatatgggtggtgatgatcataactaccatttataaaccacatgttgtctgtcaggcacagtacagtgctttatatatatatttttttggtatgattatcagaaggaatataaagattaaaaggtgctgcattacttaaataggttcccttaaacctggaaagaataaaatcctggtcacaaagttcatttcttgcccagagcacttgacccattcagggatcctgtgtttgtcatttctcttcagaaatgattatattggcacctatctcagaattgatatacagattaaatacggtcatggatgaaattatttagcccactatgtatcatcaatattcattagatagtaatcatttttattgctactaatagtaatcatcatcatcattagaggggtgagcggcaatataagatagattctatagaggttaaaagcatgactccagccagattcagattgccagggttcagttctgtctttgtcagcttctagctgtgagactatgggcttagcctctctgtttcaattttgtcatctgtacaatggggacagtaagagtccttcacagggttgtaataactggtaaatgaattaatgtgtgaaaagcacacagcacactggcaggcacagggcaaatgctcagtaagtgctagcttggagtgttctgtcaaaaagcctaacatctctttgtggtattttgtgatttttgacagaatggtgtatgctttaggcatctatggaacaaaaatatcacccttccttaaatctgtggcgttgagggatcactacatatttgaataaaggcctttctctgatgtctaacaggaagaagaaaaccactgataccaaactaaggtttaaaaaaggccaaggggaagaaaattttaaatcaaaagtcatccattcttatttcatggaaatacgttatttaagcaaatatactgataatgatgcacagatgctgtttgtatacattactttcctcctttgaattcactaagtactgatttcttattggtgccagcgatcttcagaattagttctgtccccttctgtatcattgtgtgagacaaatatctcatatacaacttttctaaagattagaagactaaaatatgtgtctattgcctcaaaggcagagaagaggtacacaaatgtgaataaacagttaaaacattaacagatgtattggaagagtccttgaatacacatgtgattgatatcaagaaaacattagctttgtaattctgcctagatcgaacactgatgggctggcactacagaaagattcagctgcaagtatttcatgtaactgatggtgtaacgcaaaaacatttcagtagatatctttctaataatttgccacaggtgctcaaatgcctgggagctagaatttcaaggattcaaattgctactgtgatagcttcaggctttgcttccaggtttttttttttttttttttttttttaagcaggctgtggcacatgtttttaagaatttaagtctgtttattggtgatgctgcagtttgcttgattacagtttaagagggtgactgtagtttctcaaagaacccaatgaatatgaactcagtttacatcattgaaaactcatgttcaatctctatcctgtgtgtactgtgttcagttattttctttgaacttaacattatttcatctacatttctatgtactgctttcgacccatttacgtgtcatagatgtcttctcttttgccacttcctctcctgaagtttctgtcctgggtttcttctagagttcaacgtatatatagagatgcagagaacatcttagtacaaattattttttctttttttacgatattggcgatgagtttgttctccaaagcaaaataaccaaaacaaaatcagaatttttataggtttgctgcattttgggagatcacactctagaaagatcaaactaatttaagtgccaccagcattggttatacagattgatcatcccttatccaaaatacttgggatcagaaatgttttggattttgaattttttcagattttggaatacttacatgtacataatgagatatcacagggatgggacccaagtcttaaacatacagttcacttgtgtttgagatacaccttatatacataacctaaaggtaattttatgaaatatttctgataattctgtgcatgaaacaaaattttaactgcatttttgactgccactggccacagaagtcatgtggaattttccatttgtggcatcgtgttggtgctcaaaaagtttcagagcatttgggattttggatttttggattagggatgcttaaactgtatgtgtaattttcccatagcttatacggtaccagatttttattataatttaggtgtgtaataacttcttacagtaattttaatttagatttacttagttggtaggaagttatatatctgtgagagaaaattcttaatatttataatttgaaaatatataatgcactgatttatcattttggtcatggcaaacattgggatatatttgtctgcaaataaaagaaaactcgactaatggtggttgtattagtcaggactatccagagaaacaaaaccaataggatgtgcaagtaagcagaaattttaacatacggtagaattaaattggaaaggaaacaaggaaactcatatattttgtgatgtttactatgggttacagaatgtacagtaaacacaaaagctaatatttattcaatactttctagctcacaaaacattaagtgtaaaattttagctattttaacttttcttttatctttatttcacaggcacttacctcctgtatctttgaatcttctttatatttttatgtttaagagaaaaaagccaaaagtccttcctgtatggtgtggatgttaaataccaaacagttttattccccttaacattttgaccatcttccttcttccttgcactcttgtggagttggctgctttcctttactttggaagaagctacgtttttctgaccctgtaatggtgttcttctgagatttgcggatgaacataagatattaaacatatcggttgagttttgttcatgtggagtctgtcatcaatatggaatagaattcaataatttgactttttcttgcctctcttctgccatttcaaatgaatcataaaaattaggaaggaaatttagtcccatctcctctctcttgagcagatttcttttccttctcttttttttttaaacctgtgggagttgggaatattttagtgctccccctttgtgaattatggtgtaaatgaaactttttgcttttgtgttattaatgacagtttaaaagtctgagatggattttctcttattgttgttaatgacagtataaaagtcttaggtaaatttactcttaaggtgctaaattaaaaaaaattaataaagtcaattgaaaattttccaagagttattttaaagttgatttttaaatcaaataagcttttctattaagcaaaataagtgctcttttaattagaagctttaaaaaaaactctatggaaacaaaagactataccttcaaaagctcacaatctttacaattcccacttccagacctttttttaggaaacattccaaggctttaaactatttgtgaataatttttatcttagtcaatgtgttatatgcccctgcacagacttatatattcttcattgagatatataattgtcctcttgttggatatttaacctataagctgacactcactttcaaggattgatttgagctttgcaaattttgaaatgctcagaaacataaagtgcttggtatcttttataagaagctagtcagaactgcctgacatgaagggagtttgattgatgtgtgataatcaggtgggaaatttcaaacttatttatttaagcactgcatttattttatgtagatcaaaggaaaatattcagctggcttcaaatgatgtcacttttcataagatacacaagaaatttgatgaaatttgaaaaactgattaagacttatatttgttcatgttcattttatattttgggtgtactatcttgcaagcacaaacaccagcaggctttgcttttacacatctcataagccaagtccatggaagtataaatttttaatgagatagatactaggattctctccttaaaggaaaattggaaacttaggattcttattttgacttttataatagaagttctatttgggatataattcagacacaataaaatacactcctttaacttgcacaactctatggatttagtatattcacagagttgtgcaaccaccacaactaattttaggacatttcatcatcccaaaaagaaacctcatacctattaatattccactctcccctgccagtcctgggcaacctaaaatttactttctatctaaaacctaaaatttcctttattgaatttacattctatctagatctgcctgttctggacatttcatacaaatggaatcttgcaatatatggtcttttttgactagcttctttcacttagaataatgttttcaaggttcatccatgttgtagcatgtaccaaatgtcattttgtattgctgagtaatttcatcatatggctatactgcattttgtttacacatttatcatttgataggtattaaggttgtttctaccttttgactattaaaaataatgctgctatgaatatttgtgtgtaatatttcttcatgtgggcatatattttcatttcgttataatatataccaaggggtagaattgctgggccatgtgataagtacatgtttaactttttgaagaactgtcaaattgttttccagagtaactatgccatttcacatgcaatgtacaaggattcaaatttctccacatcctccccaatgcttgtttttatctctttttggtaatagccatcctattagatggaaagtgacatctcattgaggttttgatttgcatttcctttatagctaatcatgttcagcatcttttcatgtaattatagtccatttatgtatcttctttggagaaatgtctattcaaattattttcccgttttcataattggattttaaaattattgaattgttaaatatctttatatattttagatacaagtgccttatcagatatatgctttgtaaaagttttctcccattctatgggttgcctttttactttttgatggtgtcctctaaagcacaaaagtttaacattttgatggttccatttatctattttttattttgttgcttgtgattttggtgttgtctctaagaaacaatttcctttcccaaagtcatgaagttttgtagttttagctattacatgtaaggctatgattcattttgaaattgttttgtctatggcatgatttaagaatgtaactttattcttttgcatgtggatatctggtttgcctagaaccatttgttgaaaaaactgttctattcttgttgaactgtctgggtatctttgttgaaaatgaattggccattcctagaagggtttatttctggactctcaattctactctattggtttatgtatctatccttataccagtaccatgctatcttggttactatagttttatggtaagtttttaaatatggaagtatgagttctccaactttgttctttttttaaaattctaacttgttttgtttattttgaatgatttccatatgaattttataatcagcttgtcaatttctttttttaaaaaaagcagctggaattttgatatggattgcgttaaatccataaatcaacttgaggggcattgccatgttaacaatattaagtattctactttatagacatgaacatctttccatttatttagatctttaatttattttaacaatatgttatagttttcagtgtacaggtttcacatgttggttaaatttatttgttctattttattgtttttattatgaattacatggattgcttagttaatttaattttcagattactctttgctattgttttgcttttgcatcgttcattgctgctgcacaattgatttttgtatgctgatcttttatctgctaaccttgatgaacttcttaattagttctaatcgttttgtgtgtgtatgtgtgttccttaggattttctatatgtaagatcatgtcactctttctagaaatttggctttgatattaaaaatacattaatataaaactaaagaattagttagaataagattttgttaaaaatattaacttactcaaaaaaaaagatcatgtcatctgtgaaaagagatacttttacttcttcttttccaatatggaatttaaaaaatttttttattatttgattcctctggttagaatctccagtaaaatgtttaataggagtggggagacaaacatccttggcttatttctgatctcaggggaaaagcattcattcttttcccattacatatgatgttagctgtgggatatttgtagatgctttttatcagattgaggaagttctctttcattagtttgattagtgattttatcataaaaaagtgctagattttgtgaaatactttttcagcatctgctgggataatcatgtggtattgtcctttattatattaaaatagtatattacatcaattgatttttggatgttaaatcaactttgtgttcctgggataaatcccatttgtttgtggtatataatcctttttatatgttgccggttctctttgctggtattttgttaaggatgttttgcatttatatttataagggatttttggtctgtagttttcttttcttgtgttgtgatgcctttgtctggttttgatgacagtaatggtggccttgtagaatgagttgagaagggttccctcctcttctattttttgtaagaatttatagaggattgttattaatctttaaatcttatttagattagttatggcttccttggtagtttaccctttgcttttataaattgcagaaggggcttgtaaatggggacaggacggtggtgtttgtgctgattggtccctttacaataattttactacagtgaaagtagaggattttaaataaaactgagtcttcattttgcctccttctataaaacaatgatagatgctccaccattggaagacatgcttagttgcagaaacaaattcaaaggtttttatatcttaaattaaaattagaagatgcctttcagtgccgtctcctcagctgagccatgggtgcatgcccggctcactgtccccactttaagaagtcttaccagtaacctataagtacaaatctgtctagaaacactacttaaaagagcctgttaagaagtgttatactgaccttctcttgggtaagagcctaagaacaaggagagtttgttgaatcccagacatcacgtaaggtaatatgaataataaatatttagattgtcttcctacatgttgcaaggtaatttttggtcattaatcactccactagctcagtgggaaaaattaacaccaaagaagtaataacaactaatttttactaagtaattactatgtgccaaacactgtcttaaatcctttatgtatactatctcttttatttttcatagcaatattatgaggtcaatgctaacattattctccactttacaaatgcggaaatttagaaacaaagaggtaatcttagttgcaaagaatgctggagctgggatccgacctaggttaagtgaccccagaacctgaaccagaatttggaatagattatatgcatcccagggatttagactcagggtctctgtattccaagttctgggtttggaagataagtctttgtactccttttgatgaataataaaatttgcagtccaccttttcttttctttttttttttctgagacggagtctcgctctgtcgcccaggctggagtgcagtggcatgatctcggctcactgcaagctccacctcctgggttcaagtgattctccttcctcgctatacctgtaatctctggggattacaggcatgtgccaccacacctggctaatttttctgtatttttagtagagatggggtttccccatgttggccaggatggtcttgatatcttgacctcatgatccacctgcctcagcctcccaatgtgctgggactacaggcatgagccaccatgcccggcttgcagtctactttttagaaatgttcatagagggtatactcagatggtactaatcacttgagattagacagtctctgcagggataattgaataagcaagttaataaaataaatatttaaaatgcattgagtgattaatgtgtttgagggtaagtgatttagttgtataattaattatttctgcaaaataactctatgaaatggtattattatcacttccatttgtagaagacacccctgaaacaaagatgtgggtaacttgccctgggccagttagcaataagcccagatttgaacccaagcagtcttgttccagaccttctgtttttaacaattctacattgcagtttctctaagtaaatagtcacctgaaatatggctacaacaatacagtcacaccaagaatgtagttagagataagaatgcatcattgtgtttgtgcatgtggagactggagctgcttctataggagataagcaccaagctatcatctgttggagagaaatgtgttgtgggtgaaaggaggaggagggctgttctgtaaatatgagacaagctgaaacaaatatagaaatatgaaaagaaaatctgattttcaaaagtgaagtttttagcctatgctttaacagaagataggaatagactgtggcacgcacttggaagctgtgacagtttggtcctgagagcactgtggtgtgggagggttaggagccacacctcaggggtgaaaaggaacagtttgaaagggcaattttagaaaatgactttgataagctccattagtagatacagaggttgaatcaacagattaatataggcttcaattataagtgtttctatgaatataagaagcatctagaaattaacaggaaaatatctgaccagttgggatggtatttctcctttagtgccaaaagtataatagtttttttttctcttgtggcagtaaaattaaaggcctggatttattcagcaacttttctttatgagaataggaatatattcccagacattgttctacacttttcctgcgtggtgttctaccaccaatgtggagttatagatttagacctctgtgtttgggtgggaagagagtaggcccactggcaggcagtaaccacagaactacatgtatctgggccagttttattccagacatgtggatcttctggtctgcagccttgacaaacttcagagttcccttgtctccttgtacagatgtgtgtaccttttgatcatgaaggcactattaatgtccttcagagtttgtgtcaatttgcaactttgaaggatatccaaattatcaaataatttacatatgatgattattaaattgaagtttctaatttattcttaacaaaaaataaaaattacattcacatcaaaagcaagtaaatcaatacttcccacatttcctgtttcccagatgcaaacaaagataagtggaagttaaatatcaatatacaggtgctttcaaaaaagtcttttggtctatttccactttcaaggtaacctggtggcttcttctctcaagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggtgagtgaaggagaaggctggcctaagaatacagtttcctggtctagtttgagttattagagatagtttgggaaagagagaacgtgaaaccacctagatggtcctcatagattcgttgaaggcagaagctttatatatattttttctcatcaaaattttaccatgtttaccatctcacaccagtcagaatgggtattactaaaaagtcaaagaataatagatgttggtgaggttgtggagaaaaaggaacacttatatgttgttggagggactgtaaattacttcaacccctgtgaaaagcagtttggagatttctcaaataactgaaaacagaattagcgtttgacccagccatctcactactgtgtattgtaaccaaaggaaagtaaattgttctactaaaatgatacctgcactcacatgtttattgcagcactattcacaatagcaaagacatggaatcaacctaggtgcccatcaatggtgggctggctaaaaaacaaatatatggtcatatatatatatatatatatatatatatatatatatatatatatatatatatatatataccatggaatactacccagccatagaaaagaatgaaatcatgtcctttgcagcaagatgggcacaactgaaggccattatcctaagtgaattaatacagaaagaaaaacaaaaagcatgttctcacttacaagtgggagctaatcattgggtacatgtgtacataaatactggaagaataggcaatgggggctccaaaatcggggagggagagagggaagcaaggtttaaaaaaactacctgttgggtactacattactctttgggtgacgggttcaactgaagccaaaactttagcctcacacaatatgtccatataccccctgaatctaaagtttaaaaaataaaaaaataaaaattttagcacattgactgaagaagggcaggagtaattgaaggacagaatggtattcgtgatgtggaaattcaacctcggaacaattgagagtggtatttgtccacgtgttgtatttattccatttgaagctagcctggcatttgagataaaaccaatagttaatacttattgtgttaattatcttatttaatcctttcaaagcttagtgaatttgcatatattttctgtattagtccattctcacattgctataaagaaatacctaagactgggtaatttataagaaaagaggtttaattggttcacagttctgcaggctgtacaggaagcatggcggcatctgcttctgggaaggcttcacagagcattcaatcatggcagaaggcaaagggggagtgaggtgtcttagatggcaggagcaggagcaaaggggaggggagatgccacacacttttaaacaaccagatctcatgagaactcgctaacacaagaacagcaccagggggatggtgctaaatcattcatgagaaacagcctgtataatccaatcacctctcaccaggcctcacctccgacattcgaattacaattccacatgagatttgggcagggacacagatctaaatcatatgaagtttcttcattttataggtgagaaaacaaacctagaaggaaactcaattacccaaggtccacacagctaagtaggcagctaagaaggaattcagacccaggatcttgtgaatattaaaccaagctttaaaccacagtttatgtgcagtttccagagttcatgaatttatctgcaaataaagggatggtatgcaagtaattaacagaattattgtgaggactagattaggtaaggcacatcaaatagctttgttgagtgtttggcacatcacagctcactgaatgtaagtttcctttgtatggcatcaagtgtgcaataaacactttttataaggtttctggtgcaaatctcatgcatttgttattgaaattctagaaatggaacttaaaaatgttatttagaaatttcagacttgtattttatttgacagcatcagtgggatgaaggaaagggtgaagagtgatggcatttggtgatggagaaacaagtcttatgcacatgacttctcccagactaaggactgggagactcaggactcaggacttctcccagacttgagggctgtactgcagtaaagattcattttaagctcaggactcttttccctcttctaaaatcatctgcttcaaggacctgggcatcaaccatggcttttgccacagggatgatggaaaacaagaactcagtagaatcacagggagtcagacagctgtagagaaacggtggtttcaaatagacaagcccagccccttgtccctttaagaaactgataacaacagaagagccaagagtctatatttcagatgctaaatagtcagatgccttaaagtgtaatccttcccaggtattttccccagtcagtagttccagggtaaagttatgtcatcatcaggtagctagcccagggcttgaagggtttaggattataatactatcgctgtttggtcgagcaggctgggtgagctggcctaaggttgtgggcaggtgggtggcagggtgagagtgagttattgggatccttagtctgtagcagctatggagtctcagaatctgaggctgaagtatttaggcagaggagttcttgagagccagagggctgagatagtgctggctctgacagcttcatgagggacattaacatcttctggctaggagggcttgggcctatttgtcagctcagcctgactcattcttttattttttaaaatcagctgaattgaggtataacttatataaaataaatcaaccaatctaatgtacaatttgatgagtttggaaaatgtataatgtaaccactactacaattataatatataatatttccaccacccaaagtttcccttgagttcctttgtagtccatctccgactctaccaccctgccctggcagccagtgatctcctttctagagctatagttgttttttaaattattatttcatatataagtgaaataatataatttgtagtcattttctgtgaggcttatttcactcagcataatgcttttgagatgtatccatgttgttgattcagttgtttcttcctttatatccccgagtaatatttcattgtacagatatatgacaattcgtttatccattcagcaattgatggatatgtgggtggtttctagtttttgattattgtgtataaagcttttgtgaacattcttgtactagtctttctgtggacttaatgttttcctttcttctgagtaaatatcttggagtggaattgctggactggcctaaatttaagtacccttctctctgtcaagatgcttcactctgtattttgtcggggtagcaccttctcccagaaggtagatggacaatttcagagcaatcatgagatttaggatgttgcctagaattccaagagttgatcataaatactttgttaccaagatgtaaaaggtagaagtttaacaaaacttcttccacaaagaagtaacagcattactttcacagaaaaaaatgaaaatgaggacagtaaagtcaagtctgtggttgcgttttgtggagggaatctgcattctagctggcctggaaccgcaggggacatacagactatgaaggcaagcaagaagcatgaagtccctctgcaggtgttaagttgactaatgagcctgaaaaagaatggccttatccccaataaatgtcgcttcttccatgaagactgctttgataacattcccctcatcccaacacttcatgccactgttatggtgtcatctcctagcagaacttgcaaatgccctgagagcaggcactctgttcactctatttcctttcttttcctttttcccgccctaatggctatttcaggaacttggcatgcagtggcttctcaacacatgttttattttggtaaaatgaaggagtaagtaagaaaaaaatggttggaggatgttactaatcttgatcctctttaaatctggaagttttactgcccttttagaataccaattgttcattggcacattgaacctcatccctgaatgtagtgcaacatgtccaaatatgaacacattggctccctcatacctgattttttgtctttgtttcttgtttctattaaatgaaccatatttatctaacagcaaagttataaaacttcaagttaattttcattccctctcctttatcactgtcctacagtcaggtatcacatcctattcagtctattttcagcatattaaaaaaaaattctgttcctaccttgcctttactgctactactgccttaattcaggccctcactatttccccccgattttttttcttctggtcttttccatacttctttgcaatgaggctcaaagttattttaaaacatttgatctcaacatggtgattccctgctttcaggtccctctctcctgtttcttataagataaaggttgtgatgaagataaatgctgaggtgagtaatcagaggtgagcagaagacagagaaaaaaagacaaagagagaggggagtcagggttagataagaggcagttatagtaagaagaaattatatggtaccattcataaatgaacagaaaatgagaatgaagaaaggggaaaaggaaatgtatgatggtgaaaggcaatgtctggtggagattcaaggtcaactgagaactgatctttcataggccagggaaggagttcagttccaaagtctagcagactttcctaaaatcattcatttttaagttatcagtaatgctaacagtaacttaaaagttggtttttataatttaggttgactaacttctgcctgacacaaccttgctactttgctccatagcatactaaagaatagtggtgctaaataacttataaaattagctgcagtggaaattatctctataaaaggagaaggtctgttgaaactatcattattctgcctgcagaataatgcaaatatctttggagacttgaaagtaggcagaggggaggaaagtgggtatcttagtctgttttatgctgctattgaagaatatcatagaatgggtaatttataatgaacagaaattagatcagagttctggagacagggaagttcaagagcatggcaccagcaatttgcaaggaactaaggaacttcatgctgcatcatcccatggcagaaggtggaagggcaagagatggtgagagcaagagagcaggaggggaccaaactcctttttataacaaactcatttttgagataattaacccattcctttgataatcatattaatccattcctgatggcagaaccctcatgatttaattacctcatattaggccccaccttccagcaatgttgcattggggattaagttctcaacacatgaactttcgggtgacatatgcaaaacattgcatggactaacactaggcagtggctaatagatattgttcagtaataacacccagtatagttccttacatctcatcaaccatgcagagaaccttaataaaagtaaagcagttagcatgtaaataatccttccattttggcccaaaacccatgggcaaaatgtggtaaatatcagctttagaaaagtgtatatgtgattgataaagtattagtacatttcaaaaccctgttgcataattcatccataagcctggaccgaattaaccacaggctttaaaaagatgccaataggccaggcgtggtggctcacgcctgtaatctcagggaggccgaggcgggcagataactaggtcaggagatggagaccatcctggctaacacagtgaaaccccatctctactaaaaaatacaaaaaaaagttagccgggtgtggtggcgggcgcctgtagccccagctactggagaggctgaggcagaagaatggcatgaacctgggaggcggagatcgcaccactgcactccagcctgggcaacacagtgggactccatctcaacagaaaaaaaaaagccaataatgaaaatactttattgggtttcactttgtgaaaatagcagaataggggtaatatatacctaaaatctaccctctttccaaaaaaccgatggtggcacattctggctcctctaagcccagaattctctctccactctgacttcctcagaaactgtactcttctgtgatttgggcatgttttgcaggacccagaagatcttggacagtgtgcatgagtgcacttcactggggctaaagcagtcctctggaagctctgacattagcctcagaactgcattctctcaagacagctttatccctgggaaatcatggtatatttaagacccatctatggttgagaataaatccgagtaggtgaaaatgagcgctttttgatttctgagctgatacttcatggtactaaaatagcaatattatttctacccccacttatcaaggaactactttgcatttgaaaattcagaggaaacttcttaccatctgtgaataggttttattttttgttaactctatagaggttatcctaacaattaaaatagtcttagaggcagagacagagagtagggatcctagagatttagtacaaactctatgactttcagattaggaaaattgaccaaggagaacttgtccaaggggacacagcaaatatgtggtacaaacacatctggaacataactctagatttctggactcccatttcttttaacctctaagagattccattatgcctgggcatgccttagttgaatggtgtataaatttgagggctatacattgattcaggatataggcagttccatccttaccaagtcatttttataggagaaattgtacctttctctcatgctttttctcctgacatcttttccctaagcacaaagagttctcatatctaccgtcctttgtcgtctcagagtttccttagagcacccctgaaggagtttcacctgggaaagtcgcctgtgcttgatccattgattttatgtatcctccctctaagtcctccttgggtcatttctttttagctccttgtcactttggaagaggatctgatgaatgcatcacttctggggtgttaatgactctttatgacgccttgttcccctgtgcctcttttcacaccccttcaccaatcagctactcaggtccatctttatcagagggcaacagaaaaagccaaaatagatgcactactaatcatattatattgtaaaataaattttttagaaataattttagactcacagctattgtaaaaatagtgcggaaagttcaaatgtatgctttgaccaggctaacatgatcagtgataacatcttacgtaaccatagtacattaacctgttgaggacactggtgagaggagactcctgagagcgagctgctttcttggaaagcgagggctgtcttgtgggcatctctgtgtagcacccagtgcagggtggacctgctctgactttagcccccttagtctttttccagttttaatttatgatgctttcatgattttccacaaacagatgaacaaataaacacagaaggaaggttgtgcttgaattgacctgaccagaggacaaactgatcctaaactggactctctctcaccagtaatggattctctaatgttgactcttggggctggcccatttcttttgatccccagcaatttcctaggtcttattttgaggtttgcttagtaaaggcaatatttttaaaatgttaatatattcatgaattattctgaagttattgtatggaaaggaaagtgtttgggattttggagtggttggcggttgatggtattcaaacccattttgataaggccttgatgcagtgaattttttttttaacatgcctttttcttacagcagttattttcatgcattcaaagaacaaattcagttttatatgccagtattattttaaatatagtacagtactgtgaaggctagtggggaacattgaaatgaaaactctagtttgttaactgaacacttcactttcttttttcagtgtggggcaggatttctcaacatcatctctgttggctctttggatcagataattctttgttgtagggggctgtcccgtgcattgtggggtgtttagcaacattcttggccactaaccactaatgtcacttcctaccccacaccacacctcctgcagtctcgagcatcagaaatgtctccagacattgccaaatgtcccttgggggacaaaagccaccccaagttgagagtcactgatgtggagtaatggaaggaagactagatgggtgttgtgaggctttggttctggttttatttctggcacaaataagctgagtggcttaatccttcatctatagaaggaggaactttgtctgaaaaagcttgaaggtcattgccagccctaaaattcctttattaaaaaaatactgaaagatgaaaaaaaatacttaaagatgaaatttatcatcacactaatggtaaattctgtgtactgttaaatagcaacaagacgtcatggaagccctttctaaagctggtgctggagaaaagcattatttacagagtaagggtgttgctgttttgttttgtttttaaattctgtgttcgaatacagttgggaactttcctattcaaaaagttaaacaggctccctttttctgtggtacttcttaagcctttaatgtgctgatgtgcactgggaatctttaagaggtagctttgcagtattctgcaaatttttgatcatggaacactgttttcacagagtatcttaacataaaacattttgtgaaacagtaggatgaggcatgagttttgctgggtagattatgttttagtgttttttattatattctttttaaattgctcttacattaattcagcatctatttacttattgggtattggtatgtgtgaggcactaaggttatagcaatagcatggggtgggcagtatgctctgagcataacctgtaaaatttgcatcctgtctcttatattttgttggtagactattttgcctttctggatgtaaacatcagcctttcctgaagatgggagaacttatgcagaagttgagaaataggagaggcccattaggagggacagcccacggtgggtctgacatgccatgtgaagggccagggctttgtcctgtaggcagcgcgaaggcactgtagagttttagcagtggatttgcgttttagcagtggattttcattttagcttactctggccactgcatacttttgagtaggcaaagactgaaattcagccagaagataatagagtttaaaccaagacagttgaaatagtgttggaaaagaggagaaggattcagaaaatgtttggaaataaagttggcaggagttgttgaagtttgggtatatgagagaaaaagaggtagaagtgcagtttgggtgagtaggagaattcatccattaattctacaggaatttattgagctcctactttgctgggtgtattagggttctctagagggacagaactaataggatatatgtgtatatgaacaagagtttattaaggagaattgactcacacgatcacaaggtaaagtcccatgataggcaatctgcaagttgaggaacaaggaagccagcagtggatcatcccgagtcccaaaacctcaaaagtagggaagctgacagtgcagccttcagtctgtggccaaaggcccgagagcccttggcaaaccactactctgagtccaagggtccaaaagctgaagaacatggagtctgatattcgagggcaggaagcatccagtacagaagaaaggtggaggtcagaagacttagcaagtctgctttatcctagcctcactggccattgcttagatggtgcccacccagattgagggtgggtctgcctcttcccgtccactgactcaaatgttaatctcctttggcaacaccctcaaagacacatccaagaataatactttgcatccttcaatccaatcaagttgacacttaatattaaccatgacaagttcaccccttgtcaacttgaacccatacacatctcctgaaatcgtatataatctccaaataaagacaataattatgcctaatataatacagctatctcttgtgcaacccggagcacactaattgttaacctaaatgctattacataaagttaacaatacttaaatactgatatgaagtcaataactcttacgtcacatgacaaaggaaaaagaaaatgaagatattttcttagtgcaagtgtatacatctacatattcttaacaaaattaggaggaaatattcacaacaattacagtcctctttctgtagctggtcacgtggttgtagctggtattgatgactacctttttctactacctattctgtattccctttgccttcagcaagcacctcagtgggtcgtagttttttacttggtgtagtgacccaaaccttcactcctgaagggtctgggccatttgtagtcatgcctggattgggttgttgtagtttcccattgaccataatcacaaggcatggtaatactaagagatgccgtaaggatctcctgtattccatgcatactcttccttacctccattatgggataatagactaattttatcttgataatccggatcagttgccccggccaacactgtaactcccttcttagcctgttgacttagaggtaggcagagcccaaagtgtccagatggcaaccttaacttccaatttaatagaatcattgttgtgcctcctggcaacattcctccctctggaactaagacttctaagccagcagaatataatgtagcaggaacagaaaacaagaattttgctagtgggtcactaggggtgatggtgagtgatgccacttccatttccaccccttgttttttggacctgtgaatcctggctatgggagaaacagtaccatgtattggatgctgattcagatcatacacagccttctggagaacttcactcgagccctgcaaagccctgcaaagtattgtcgcctagttggcattgtaattgtgacttcaaaagtcattccaccattctatcaatccagctgcttcaggatgatgggtaacatagtaagaccagtgaattccatgagcatgcacacattgccacacttttttagccatagagtgagtgtcttggtcagaggcaatgctgtgtggaataccatgacggtggataagacattccatgaatccatggatggtagtcttggcagaagcattgcgtgcagaatgggcaaacccatatgtctattccggtgcagacaaactgctgccctttccatgatggaaaaggtccaatataatcgacctgccaccaagtagctggctgatctccctgaggaatggtgccatatcgagggctcagtgttggtcccggctgctggcaaattaggcactcagcagtggctgtagccgggtcagcttggtgagtggaagcccatgttgctgagcccatgtgtaacctccatctctgccaccatggccactttgttcatgggcccattgagcaatgacaggggtggctggggaaagaggctgagtggtgtccatagaatgagttatcctgtccacttgattattaaaatccccctctgctgaggtcaccctttggtgagcactcacattggatacaaatattttcacagtttttgaccactcagaggtccatccttaaaattttgtatatacatattatcccattatcaaatattgtcaaattgccctcatagcaccatagctgcatggtaagatgggcaattaaacaagcaacagtgatagaaggtggtaagtgccacagtatggcagctacatgcttctataggggctcatttgagggcaaccgtcctggtctaggaagccaaggatggctttctggagagattcagtttattcctactaaaaagaagattaactgcatgctagagattataaggatggggttgggatgaggtatattacaagctgaggaagtacatgtgaaagcctgaagagtagtgttactcttttttttaagaaacgtgatgtgacttcctttaacttctgaattcatttgctaatgaatcctgtttttatggagttatcctgtaaaataacccaaagacaaagacatggcttttttaatgtatatgtgtttttagaaataaatcattgaaaagctcagtaatccctttggagaacagctttagcattgatgctgtcaagacccttgtcaaaagaataaaccaaacctgattggcctggtggataaactcattccatacataactgaatagttagagactgtacagaaatgcagttttgcctttcatcttaatatgtagtctgatgatttgtaaaaaccttcttagtgggaacagcaggttattctgcctgggtgggagcctttttactagcttaagcagctgtttaaactttcataagcaaagtaattattaaatgtttcatgaacatattggttggaacgtttgttcacattttaaccttgagttggaaagtttcaggggggtggggttaaagagttttaagctggcaaattcattctttttttctttcttattataaactttttatggcttagaaccagccaacctaaatcatggaaggaaaaatacatgtgtggcaagcatgagacatttcattgtttatttttcaaatttctgaaatgtgctcatagctgtgcatgcctctgggctcataaagacagcaaatggaaatagctgaagccagacagactgttttagatagatagccacccaggtaggcaaggaaaaccttgtaggttactctttcctccaatcaagtcatattaatttgccaaaatgggattttcaagcaggaggatgtgatctttcataggtctgaacaccttgcctttttcaatgatggagccatttaataataatcataatcagaagatgaggaataatatacatttatagaatacttagtacatggcaagtgtatatgacacatagtagtctacgtgtttctcatacattatctcctttaatgttcaccacaaccttgtcaaacaagcaatgctgttatatccatataacagatgaagaaacgaaggcttagagaggtcacagaatttgcaaagcttctgagtggctgagctgggatttaaattcatctgtcctatccaagaacaattcattatcctgtacttcttagtgcctttttattctagtttgtgaagtgctgctacctaaagagtttcccattttactctaaatgaaaaagaaaaccaggacaaccatcagcatcaacagcaactaatgcttgttgaacaactactatgtgcaggacgctatgttataagcttgggaaatattctgggatgagaataaagaagataaaagggtccttgcccgtggctggtgaggaaaataggcagtaagttctagagctcacactgtgcagcactagtgcagggcctgcagcactgtgtccttgctggcccagtactaatgtctgcatatagtactttacaatttgtaatgtgccctcactgatattgtcccacataatcccaacaataggactgataataatgattcccactttaaagatgaggaagctgagattcagagggacaaaataattggactaaggtcaggcacacaccaaaataagtggaaaatacgattcaaaatgtggttctctataacttgctgtagtcattacctagagccctgcaattttatatagcataaaataaatgctttaaggattacctgaaacacaaccttaaaaaatgaaagcctttaaataataataattacaatatagtgaagtaatgagagcaattttagtagttttaaaatatgtccacatttttttttaaaatttctgtttaaaaggtggagccgaattctcttcccctgcatgtgtactgtacttagtgtctgacttctagtgaacagaatattgcagaagtgctgggttatggcagccaagattagaacataaaatgcagtgtagcttcctccttgctctttctcttgcatcacttgctctgggagaagccagctgccacgctgggaggagcacttggagaggtccaggtggtaagacactgacttcttctgctattaaccagtacaaactagctaacaagtaaatccaacaggtccagtctaggcttcagatgacttcaaccctggccaatattttgaccacaaccttatcagagaccctaagccagaaccacccagctatgccactcccagattcttgactcacaagaacagtgtgagataataactgtttattgttttaagccactaagttttggggtaaactaatacagcaattaaagggcacaagatacacagaaaggaataactgtgtctaagctgtcacaaaagatgggtactaaaatgtgacaaatatgagtaggaacttataggtggacaaggaatttattgggaggtgttctgggcaaagaggcaagtgtatgcaaaaaagtgtggaagtgtgccacagcaaggtacatttatgaaactgcacagtacagcacaagataaaaatcacaccaagaaatgtaatatatcataatataacaacaaatgttcttaagagtgactttgagtctgcaagaaatttagttctatatggactattttaaaagataggaaagcaattaaaacattgtttgaaatatttacttcaaaatttttttaaagtactgtataaatttttagttagagtctaagctatccagaaaagccacttccctgttttcttacttcactagaactgtctggttccatgttttgaaaactttagtttaaatgtagagccaagaattaactaatgaagaacacctggattttctgcaggatttcactgcaccaattctgttacaacaatcaggtagaaattaacattttataaccaattatatgttttacttggcatcatgctaaccaactgaatttttacaaaagagaattggccaaattgactcattattctccaccatacctcactcattgactgactatttattgagtgccgtccgtgtgttacccactgtgataggcccataaaacaaccctttatggttgcaaaaatcactttgcatcccagttgcagctctactgttttctagagttaatagaagttcctggtgaaaaaaactatgcttagtttttttctaagcatgtttaacttgggtttttaattaaaattaatacctactcatttgaaataaagagaaaagtgaaaagaagttttacttggaaatacattaattgaaagacagttgctgttagcatcttgctgcacttctttcactctattttcttctatgagtatctttataaagttataatattttatagatactgtcaaatctagttgttgtttaacatcaggcaaaatatcccttgaaacagaatttttaatgtatttaagttattctaacaaatggatatcctgcaatttacttaacctggtattagatgttttgattatacatgaatctttcaggaaaaatgatgtcatagttaaataaatatgtagctagtgaattttgaatgtgtcttttgaactgtttatgggctttgtgataattgggtaattttaaatgataatcagtaggaagcttaggaagaggttaacatggtttctctcccttccaagagaactgcctttgtaagattctgagatgaccactgtggccatgtgcccaagtgtgctgtcacagttatactgtcagttaaattaagcatgaatgattggatggagaacattattattctctgcacattcttgattcttaatttaaggttaaactaatttaatgtcatgtgaatttttagcagcaattatggacagttaatgcatgttcttccttagttatgcctcatctctttgcaaaattacaatatttcattccaaatttcttctgaccagatttggaagtagctctctcttctcttttccctcaatgtttatatcagaagggttttgagtttatactgtaaatctccatttgtgtattttcataataagactctaagaaccttgactggttatgagggcactggaatcaaagcaaatgagggcactggaatcaaagcactggacccagtgctttctccatccttcaggggatattgtacagacaatagagatgctatcttaacatctctgtttgagtttttccctctccacctgtcttgcataccaccctaaccaatactccttaagtatggctctatattactatgcccctatcaacactctattttaaaaaggcatggcttcacacttcctgtaagataatagccagtagtccttgaatctggcattcaaagctttaaatctacaagatgatatactggtcataccttttcctgcctattttctagagtcttttcccagaagactctgttccatgtatttggtgtcactttcctgtctctgtgccttcctcatactgacccccttttctaacctgactgttgaaatcttacctactcagtcttttttcatttatttgttgattgtttcaataaaattaatttacttaataagtatttactgagcactgattgctcatcagacaacattcaagagcctactgaaatggcaccttccctgagaagcctctcttaattacacacccatatacaatgtttctctcttcagaacttccataggtctcttttttatgctttccataaaatttgtcacaaatcccataccttatttatgtgcatataggagcatctaatgggaactcaaaattgctttaaagaacataaatgaatgaatgaacatgaatgagctaatgaatgaaagaaaagttatgccttctgcaccagcagaagctaatgactaaaataaaatggttaaactggactagaaatttaagattgttatgggtttctagtctaggaaacaccctcaatgtggtttccatattggattatcccaacagagaaagatatggaatccccatcttctgattcccacaccattactctttctgcaccatgttatcacatgctactctattaaaattgaggcagtattatcatactttgttattgcttttcattattagacatagtgttttaaggacagtattgaataggaagattgttttttcagagtgctgtaacctattttagcattcaaaggggcaaatgtataaacctgagtggtgagaaaaacgtagcagattaactaattttgaaagataatttattttgaacttgagtaggggctagggaccttcattagttcctaagaaaagtagaccacaaactcaacctctatgctcttttttatctagtcatgatattagagtatgtgtggactttgacagtgacacctaaatggtttttacttgcctcattgtttccttactaactgtatgaaagaagaacacgtgttgagcccctccaatctaaaaatacaaactctggaatgctccaaaatttgaaactttttgagtaccaacatgactccacaagtggaaaatcctgacctcacatgttgggtcacagtcaaaaggtagtaaaacaattgtttcatgtacaaaataattaaaaatttgtatgaaattatcttcagactatgtgtataaggtgtataagaaacataaattaattttgtgtttacacttggtcccatcctcatgatatctcattatgtatatgcaaatattccaaaatctgaaaattccaaaatccaaacatttctggtcccaagcatttcagacaaggaatactcaacatgtgagactctggaggtgaatttttgtttgtttgtttggttggttggtttttgcagtaaattgttgaagtcttagaaggggcgcattcagcagttagagcttcccttttaatttgcataccatgccgaagaagaggaggtgtgattctccttctggagatgatcattctttcaaaaagaattatggtgaattgtgttttttaaaaatagacttctagggcagagtaggggaaaaacatagggaaccgttaattaaggtatcagggcttgagaacgttgtttttgtctgcccaagacccttcctttggaaacagcacctctcccaacatttgtgctcctagtggactggtaacttgcactcctaagaactggaatcttgaggaagacacagagcgatagatgagattggggctgagtcatccatgatggtatcctgggcagttcagaatctctgagcctcagtttttcttccccccaaaatgggattctatgtctcactgagttatttgaggattcagtgagatgatgtctctgcaagctttggcacagagttgttattcaagtgaatattagctaccactctttgaggttagtagtcctggggacaattcttttctccccctaaagaaggaaagggaaaggaaactttctactgaggaggtagcaaatgcagaatcactgaaagtgcttgcgaagaatatccaactattcaaattatgaattagcaaaagataatcaggtgattgtgaactgtgggttgctgctgctttgttgtaatactgctgttaaaacccacgttagagatcacatggacacaggaaggggaatatcacactctggggactgtggtggggtcgggggaggggggagggatagcattgggagatatacctaatgctagatgacacattagtgggtgcagcacaccagcatggcacatgtatatatatgtaactaacctgcacaatgtgcacatgtaccctaaaacttagggtataataaaaaaaaaaaaaaaaagtcaatagtactgcagaaactcaggcttcttgttgggtcggggagtggcgaaatgtaaagggagtaaaaagggtggtagtctataaaggaactagccatccagccacccagaaaccaagtccctcttttaattaatagagttatggagaggctccagcatattaataaatgtccccctatgggtggtgagaacgtcaaatgtgaaacagagcatattggattttgtaataaaaatacagagaattataaatgagatgtccaggaggcatctaagttaaggacacctaagatcaagaatttatattctagttgataaaaagttgtggataaaattagggtgctgagatggaaaaagaaaggctcctgttggcaggaggaacactgatatgaagtgatgggagagttttgatcaagcctgtatctttggtatttaatatggggatgcgtagagagtattagaagccataggtacagccacatacattgttaaaatgtgactttttgtatattatttcacgtttgagcaattaccaacttactagcagttgtacaaaaagtaagccattgtgaatttgggatgcattttcacatatacattgtattagaccattcttgcattgctattaagaaatacatcagactgtgtaatttataaagaagaggtttaattggctcatgactctggaggctttataggaagcatggtgctgacatctgctcggcttctggggaggacttaggaagcttacaatcatggtgaaggtgaaggagaagcaggcaactcacgtggcgggagtgggagcaagagagagagagtgggaggagaggtgccacacacttttaaacaaccagatctcatgaaaactcactcactattgcaaaggcagcaccaagccatgaggaatcttcccccatgatccaaacacctcccaccaggccccacctccagcactagggattacaattcaaaaggagatttgactggggataaatatcgaaactatattagacatgaagctgcaaattattatttaattcatattctagcattaggtataccagaacaaggtatctgggtaagagaaagtcgatatgaagggcacaagataatggaggaagacagtttcttctatcgtctagggactttgagccaattcttgggaaaaaaaatagatgatgttgtctttgatggtccttttgttgttgttttgatcctcttcttcaaattcctggtaccttttctttctgactaacagaactctcttgttgtaaaacagcccagtgaaataggtattatcccaatgttacagttgagaaaagggggctcagaaaggttttgttaacttgctcatgccagtataataaataggaaaagccagtttcataatcaagtatgtctggctctaaagctcaccaagtccaacatttttgccttggaatgtgtaagttaacaatgcccccactaacaacatgaagcaatacagaaggaatgggttgagatggggtttgggcaaagaaaagatgagcttggttttaggtatgttgattttgagctaccttggaaagccattttctgttttgtggttgcaagagaaatcgtggtttgttgccctgtgttagacatgggtaaacttagagtgttccatttgctgtagaattagtggaggatagatagatgggatatataggcagagatcgatagatagttgtttgtacattggttgtttgaaagttgagcaatgtctgcagtcactagtcagtatttctattgcttagcaactctatttcctcatgtagccataacaaatggaacttttatatttattttttatgcttaagggtacatagtgctgcttataaatgatgcataagtgacaattttatactgtgagcattactctgactcttggaatcatagaatctcaaggttggacgggaacttaatagttggatttgttctatattcagactgctttacacctccatgaggtcctgactgacacatactactcatttagatagtgctccctatctgaaaagtcttggttttcagataacattttctttcctttaggcaaattattcctgttttacccatgaaggacaaatccaaatatcttgtcttcatgagaactcattgcacatttagaaataggccccatgtctctgccaattttctctttcctgggctgagcttcttctccatcttttcagtggctccttggagagatatattccttgagcgcaggactctttagcccaggttctgggaatgcacctcacagaaggctccagtgtcatcccctgcaggcattgtctcactggcagagagccactcatccatggccatagccttttccggtgtagtccccatctaatgatcaattcagatggggtataaaagctcagttatttcagtccaatatgtgacaactctgacaagccattttagtctcagagctgctcatggggtcagctgagtctattgttgggctgcattgcaacttgatttgttttctgttccttcttgagtccttcccctccctttctcaggtgttcattcccagggcataaacattctgcctgccaactctgatgcagagtctgcctcctggggaaccaagcctgcaatgtatgacttcaagtcttcttatgaaaccattccaatttgtttatggacttagacttctggagtggatagatacctctaggtgtaatctcctgtgtaatcagaatacattttgctttgaagaatattttaaattaagtaagattccacaaatctaatgtgtaaagctcatgcagtagaaagttttcagtgtggatgtcttagcttaggttccccctcaaaagcagagtgtgaaacaaggacttacatgtgagtagtttatttgaggaaattatcccaaggaacagaagtgggagactggaaatgattgttcacaataatctctgtcatttcatagccatagtttttcatcaacactttcctaatgagctcatctttgggatgccaagtgacattgctgtgtgctttcttcaagagatctgagcaatgtagtcagacagccaattaacatttttatttactttgggaaagctttgagtcctgagacctgcatgagatttttctggtagtatttccaactgtctaacaaaacatgtcaaaaatttcatatttgtcgttccaggaattcagcttaataagactacacagaccaggactgagaggttggtggcaaaggaaggagctactgagagccacacatcaataaaatgagatatccaaagcatggaaggagggtcagtcaaggcaatgagggatagactgggatcagttcaggaggctcctcccagaaccaggaatctaattaggagactgaaaagaaaggaagtgaaggggccccaagccagagagccctatgtataaaattatacatgattttatatatgtaagtcgtaatttaattctcacagaaatattgtgaagaatgtgccaatattattatcaaaactatttagcagatgaagtaactgaggcacaaagaggccaaataaattgtccgatgttgcataggtagtaagtggctgagcctgacttcaaacctcgatagacttttcccaaagttcatgctcttctgaatattacttatttctcatgtacctgtttctgaggcagaggttctcatgtattataaatttccttgatgaaagaccaggactggttcagaatgtgtgtgttggagaagaggggtgtaacagatacacattttatagacctccttccatcccatccatctgggcccactgcatcttgcactgcaccactcagggaacttcccccttgcccttgtctgctactatgtatctcggtcagcaagttccaacttggagtttctggctcttcttgccacttcaggacttggatgagatactaagccatggggcacgcaatgtggccccacatgtgttggaagaagccagatgatacaccctggacatgaaggagagttaactccttgtagggtgaaatttgaccagaggagggcaatggacaggagggaagtggctaaattccctcatcttgcactgtccaatcgacttctctgaggcatgagtttttcttctagctcattctttcccttgtcaagtggacacaccagcaaaggacctgttgcgtctctttgtggcttagtgtgaagtgataggcaggatagtgatccttcagttggcattgcttggcatcttttcttgcctcaatttccttctagctcattctttcccttgtcaagtggatgcaccagcaaaggacctgttgcgtccctttgtggcttagtgtgaagtgataggcagcatagtgatacttcagttggcgttgcttggcatcttttcttgcctcactttccttctttctaatccttgtaccctgggtttacccctttcaaagaaagcattaaaggccaagctaagaaaatgggtctggactaaaaagtggaaacaaatagagtagtaggcatagttcttaacagcacttcactgttcagagacaagaaaggacatagattctttgaaaaataagtgtagaacaagttagatgttgatattatgactaatgtgtaagttccagtacttaacaagaagttgttgtaaggtgagtatttatgaagaagggggagaagggaagaactccctgatcaggctgattttaagtcagatctatttactgcctgttatgcctgtctcctcttcctcttcatgttgctaatagcaaaaatagccgctattttctgaacacttaaatatatgtctgagaccatgctaagtgctttatgtatattttctcatttattcctttgaggtagaaaattgagactcagagaagagaagtagctgtcaagcagctaatgagtgctagcaccagatttcaaacccagggctgactaactctgaagcccatactaaaaatggatttgttctgctgtcttctgcaaagttccttatcaaaggaagttatctagagcagaggaaagccatatggagaaaaaaatatggcatgagagcatcttattcattttgttcttatttgctccgaaagcaacttctggtggagccagctgctggtgtttggagtgtctttgccttctaggaggaaatactctttcctaggtgccacactgttgatacttctcaagaccaaaataccacaggcctccagctccttgataaagctttaatgtgttgaattggcataaatcaattccctaagtctgcctagcagaaccaaactctgaatatggtgacctcacagggtcacctagctcaaggcagccagcaggcttcctacttgatactttctttgatagatgtctttaggggagccaacttttctttaacatctttcctttgactctaaagctctcctctcccaacatttcctctcctcagtttaacccgagttatgtgttcatgacataaatagggccacgtttgccgctgaatgatgtcacagtgcaggtgatccacagatagagaatacaaatagcatttgacatttgcctttgggatgccttatactactttttatcctcccagtaatgtttacattgttgttttgtttttgttttttgttatttaaatgataatggcaaaagacccttgttaagagtcatgagatctgggatctgattgcagctctgacttatcatctggatgtgactttgatctgtcacctggtcctctgacgactcagttcattcacctgcaaaatgggagagttgggagagattatttattcttaaaccatgctgatcatcagaatcaccacagatgctttttaaaaagggcccatctcagagtcctgaatcacacttcaggtgaagggaggagaaaggagattggggagaggagcaaaggtccagaatccataattgcaacaagctgcctgggtcattctgatgcacagtttaggacaactttatgcaatactgccagttgcacaactccaaggggtgccacttgcattctacagactccatgggcacagttcacatgaaatagaatctgaacagcccctcttggtattgtgtaatacagcagccctgtatgagctgattactgtatagggtcatttgtaagcatggatattctttgattggatgacagtagagtgctttgaggtcctcagtagacagtagccctgtattagttcattttcactctgctataaagaactacctgagactgggtaatttatagagaaaagaagtttaatggactcttagttctgcatggctagggaggcctcaggaaacatacaatcatggcacaaggccaaggggaagcaaggcacatcttacatggtgacaggagaaagagagagagagagtgaggggggaagtgccacactttaaaaccatcagatcttgtgagacctcactcactatcatgagaataacaagggagaaatccacccccatgatccaatcacctcccaccaggcccttcctctaacatgtggggattacagtttgagatgagatttgaatggggacacagagccacaccatatcagacccataagcatgtggttacagatgaaggcacagtagctgtgaccaataggataggaaagtggatggcttaagaacagctgatgaacactgccccatacaaagctgactctcagattgtctcccacattatagcattacagctggtgcccatctgacaagagggagaggtgtgtgaagaaagcaggatgttgagagcagcgtgagccaaacagcaggacctcgggtcatggtttccccaatagggttgaattgaggaaaagaaacaaggctttctcccagctaagaaaagcttttagttgcctactaatttctgtgctttggggtttctttgactttgttttccctttacacatggtgaaattccttttgaaaataaattcagccctgtcttaaccaaaaaaaaaaaaaaaaaaaaaaagactggtaaacctgtatggagatattacttgagttcctagaagccaggttttgttagtaaaaaattggataagtttgggtacttgggcagacagaaagttgaaaatctggggaaagactgttagcatgcagttgtgattacattaaatgttataaatgaatttttatcagaagctattgagatgctgctgagctgacttgaggtattccattgtctagaataatactctgcttaatttgcatgagaatcagttgaggcatttgtcaaaaatgcagattcctgccacagccccaggcaattctgagtcaccgggtatggagggggcatctgggctgtgcattttacatgagcatccaaaaatcatgctttgagaatgctgccctagacaactgatggaaagacagggaactttgttccagaatacatcctgtgttccttggaaattatattaactcctctcagccttagttttccctcatgtaatgtggataaggatacttaccctttccaaaatcagaggtcttagaaaagtattttaaaaaataaactggataaaagaggtaatgctagttacttagaataggaatttatgtgaataaaagtctatgtcttgggcttctgtaaactcacctctcaaccccagcatacagcacaagaatatggaaatagaaggaagtatgtatgcatatatgtgtataaatatgattgagattgtgtaggagcctgtcttagtccatttgtgctgctataacaaaattataataaaataccaccaactacatagcttatatacaacagaaacttatttctcacagttttggtggctgggaggcccaagaccaaggagctagctgactcagtgtctgatgaaggctcactttctcatagatggggcttttttgctatgtgtcctcctgtggtggaaggggcaaggcagctctctggggcctcttttataaggacactaattccattcatgaggactctgccctcatgacctaatcaccttccaaacaccctgcttcctgtcacatcacatatgaattttgggaggacacaaatgctcagaccataggagaaccttggaaagatttctagaaagtcaaacaatagatttttaagaagtctattttctaataagctattagttagtgcttattagaaaatagaatctgccaaagtaatgtaggaggagcatttatcaaggcagattgatagagacagctcagtagataaggcaaacaaatgttgaccagtgaattatattcataatatattttgtatttgtaatatattttgttcttatttagagaatgtactaattagggtaaagtatagctgctgtaacagagaaccaacaatctagtggctcaaataacaaagaagtttatttactgctcatgtagcaatcctggtatgagtagtcattgcctgatgagtaactttgctctgcatggtcattcggtgagaggttccttctatcttgttgccctgctgtcacgtaggacactgccatcatttactttgcagaagctggcttgtcacctggaaaagggacagagaacatggatcatcataaagctcagacctggaaatggcacatagaacttccattcacaaaccactagtgagcttaaaaacaccaggatgcctaagtgaaggggaggctggggaatgtagcctatcaaaatagccatacccaaccataactctattgttactgctgttgaagaacgggagaatggggttggtgactaactagcagtctctgccatgggaaggtatacagaactttgaaaatggagccaattactactttttatggcttcactaattggccagagctactactgtgctgtggagtatcagtgtttcctttgatgtgttgttcctagcctctctatgggcttatatctagcatcccaggtaaacctgagagttatcctgggcaatgtggatgctggtattccattttctcaattttagggttctcctcctgtatcctgtacaggtcatgagaaaagacttgttgagtcctatcctactgttaataaatgtgctgttgataggaaaatgttggcagaagtgccaatatgaatagtcttctagttgcttttctgatggttgtgacataatgaatctcaaatgtgacttttgtcatataattggaggctctgaacattaagaacattttcttaaggatcatccaggcagaaaatgagttcacaggtttttaacatttttactgatggttcccaaggctccacctgtcccttcattctattctatactgcctctttattggatttctcccccactgcaacgtgtgtgtgtgtgtgtgtgtgtgtgtgtgtgtgtgtctgtgtgtgtgaggagagagagacgagagagagaggagagagggagaagagagagagaagagagagacagaaagagaaaagattgacaatatatttcagaattcttaaggtttgctcctcattattctgtgatgtgcagtactattcataacagaaaggtctgataattagctgccttgggatgttctaaaggtgaagccactctcctgcaatgcatcttgcaagagagattagtgatgtagactggaggttggcatgtgacagagactgttaaggacaaaagcagattgataacagtgaaagctgctgcttggacaggttcatggatttagagagcgacctccccgccatgggaactggatccctatgaaactgtggcatgaactacaatgagatgaaattacctcagagaaaaatctgaaggcacatttgagggttgggacattgcttaggaagctgattaccaaagacaaaaacattcatgtgtatagtgggagaatgggagataggttactctttaaatagctagttggcattgtcattgaagtttgccttactggaaaaattatgcagctatttctcttttcagttttatacacatgcgcacacacacacacacacacacacacacacaccatatattctggggaagaggtgttttattttccttttgtgtcatgatttcatagacccttatattctctaagagatctgggctttcagccacattcccataggattctggaatttttccctctaccctcagcctgccccatcacccaagtgtgatttttgtgattcttgtgtttctctagtgtctcaccaactgtatttctaaagcttggtcagtgttccatcttggatttcttgttttgccacttgtgatggcaatttataataaaaccaagatatgacctgttttgtatccagcaatgaaacaagttggaatctgcctgtgatgtgcaatgtgccttcaatgaaggggcagctgtgatgtgaatggatcttgggggagagaaaggaccttaatttctcttctcttttcccatggatataaaactttgttatggtaaactaaacctctgatatcatatgcaaccgctggcattctagattgttttaatggccactccttattgcttcatgctaagcgttaccatctgtttctttcttaattataaatgcagcaggaattcacaattacatcagtaacggtggaaataaaatggagttagaggctttctacttaacacaaggcagccttcctctaatatttttcttctgttacaggcattggtcagagaggagactttttcagtggttttcttttccctctcttcagtatacttaccatgagaatgtcatgctataaattcagcaatttccttttaatgagagggagagctgtgtttattttctgtccatggagctggggatgtgtgggcagctctttctcacagtattggaaaccagtggtgtgactgtcctgctgttattggcctctgtttttgtgaaaacagatgagttataatagcccaatgacatgagtcatgtcatcccccagaggagagctgggagtggacatctaagaaactctggtagccagcctgcctgtctgtgaatatatgggaacatttatacagggaggtgatataaaagctgaagacatgtttaacccagattacttaggcttttatttttcattaagtggaaaaactaatcaaatttcagactcatgaaattttagtgctaaaagaaacccttataaatcaccttgatcaaagctgtagtgactgccctttcctttgtgtagtgctcgaccaggttgagcacgggatttggagtcagcagaacaggtttgattctgaagccaccaccatggactttgagtcctcttcactgagtttttagtgtcagttctctttatccatgacaggagacatgatgcttcttatgaagcctatgtttggattaaatgagagggaacaagtaaatcctagccattgtgtggccggtctgtggggtttttttccccttctttccattcacatttatgatagatgaagagatattggtccagagaggttaaatgccttgcccaatatgatacatctagttcagggtggacctgaagtagaagtagttttaaaactctatttcaaggcttttgcttactatgtcatatctagaccctttgctacctttctccatccttgtcaccattgtacaaggatatgtacttttgcacaatgaataaccacaatggttatcatgtgtatgatactttttaaatctgtaaagtaccttttaaaatgtatattcccatttaacatgaagtaggtgaaatagtgttataatcttttttttctctctctctttgagacggagtctcactctgtcgcccaggctggagtacagtggtgtgatgtcagctcactgcaagctccgcctcctgggttcatgccattctcctgcctcagcctcctgagtagctgggactacaggggcctgccaccacgcctggctaattttttgtatatttagtagagacggggtttcaccgtgttagccaggatggtcttgatctcctgacctcatgatctgcctgccttggcctcccaaagtgctgggattacaggcgtgagccaccgcgcccggctgaagtagtgttataatcttatccttcctcttattttaagttggaaattctgaaaggtcaagtatcttgttgaagtcacacagaaggctgagtcaggacttgaaccaggtttttaagactttccatatatgggcttcactctatactagatggactcttactgttacaccagtacatgtaggagaggactgaaagatgcagtaaaaagaaatcgatattattatctataatttaatagttgtagttaggactttttatgatgtgaatactataagaccaaaaccattttcttgaattatattaatattttagcgatccacgtgctttttacccaccagaaggttcccctgggtaagtaaagaggtggagcaggagagagcaggtttgcaccgaaagtagttacaaaacaaaacaaaacatataagacatcaaccacaagaagcccttgctccaaaatgcaaatgacttatttgctacttcaaaaatgcacctcatcaatgaagggatcatttgatcatttgttcctgccaagtttatgtttagtccaggaagggtcaggctggtgcatattctcacccaggggtctgagagcacagtggcaggtgtgaaaagagtctttgggccttgcacttgccttttcatgccaatgccctcatccaaataagaagtcccctttgcactttcccagcttctaggccatatgttatgtctgtttcttagagggtgattcaatgattcctggtgataatgacatcacactgagttttacttacatcctgtttctcttgtataatgcccatgctcctcttgtcatgcggtcctgagccatcagggcccactctataaagcttcctgaaaatcaggccttcctggcaacaaaactaaatcttttaatctcagaaaccctactactgaccatgtatagaaaaccatgcaaatttaaagaatgtaaatattgacattctcaggttttcccatgtaacctgatttagtctgatttccctattatttctgccatttctgtgggcattttactgaagccaggttttataaagcagcccagaagcagcatcgttcataaggtaagggcacaggctgtagtatcggccagacctttggtcgagttctggctgtgcagcttgactgtgtgatgtcaagtaagttctcagagcctccctttccccatctgtaaagtgatgataacggtgcccacccattagctggtgctgtgaggatcggatgagctaccgcatgcaaagtgcttaattacaggacaatgttttgcctttctgaccccccagaaccagatgaatgattcatttgtgatgtttttctcttattaggaagctttagctggacaaaggtcattcaggattattttaacatatgaaatgcatttgttttattgaaagagattagaaatgttattttgaaagttttataccttactttagaagtcaagtcttataacattagtaggttttcacttcaggttactttcatgttctgtcttttcactgtgagcaaggtggtaagaaagccattctttctattgtcttgtatgcgaatgtgaatatatcctctatgtgccaaatacaacttcgtgagcatattgtttgttttaatgtagccttttaatgtcagaaaaaaagtctcaaagttctagtataataataatgattaaaatgcttattaaagagcacattaaaagataaggctattttgaggactcaggggcatataaacaggttattattttttcatagatgtattaaatcagacatgtgctagccaaatgtctgaccttatataggttttcttcagagttttacagaaataatgctaaaataaaggaatgtgaattcctttgccagttctttgaaggaaatggtagagtctgacctacctcgaaggagtattaagagaaacaacctggttatattgctggaggcttagagtctttaaatagtctcagagatcaaatctccctcggctacatagaatgattccatacgctttcttctgaaacttcctctctatctctaaatggggccattttgagcccctcatgaggaggcgcagtggaagaaaaatgttctgctgagcagaatctgcaagccatgccacatgcagacatctcatctgataatgacattctcactctgtagaggccaggaccaactgtgttatcctctttctcctgctcctctcctcccacctcacacatgcacaagcacctgtcaaccaacatcctcataccccttcttctcttagaaaggaggggcttcaaataatattctagggggaaaggtcccatgactctctgataagaagaggaatcctttaattctactaaacatgcaaaagcattgagcaagcaattaggcaaccatgtatatagctccagatgtcccatacatatggacaattgtccacactgctggtggggctggcagcattttaaaaactggttacaacacatatggtcctttgctttttgctctggcatctgaagtcttgctaatccaaacacatcatcgctgtggtacttccagcacagtaaatacctatctgctctcaagttacaaatgcggtgtgcttccctagctcaaggttgtgggtaaattaattcttaaatgaaagtgagaggcagggagctttgcaaagagaagaagcatgttaggtgtaggaagaggaaattaaatggattggactctcctctatcttttcagtgttttggccctccacccattaaaagctttcaagctttattggatgatagtttctaattccccttctagccaaggctccaaggtatgatttcaggatggagagtaaattctttgtgtttcccatctctcagaaaaattgcttatcagctaaagttttcgaagagtcagtttatgggaagctattttggttgtctagctacttatgttatcattattcagtctaaagtcttgcctattgctgaaaactttatgcaaaacaagatattgtggttatttatttcttagccattgctttgttgtttacacacccacataattaccttgaacaccacaggaaaaaaattgcaaaataatatttcctaaacacactttgggtttacaaagtgattataaatggcttttaaagaaagtaattcttgttcatttcattgtattcaagcttctctacttaattgtgctgtgtgtgttggaggattgtggtggtaagttgagatatgtagacaaaacagattttgtcatttttttcagtagacaaaattataatagtgtggagatactgtcattttaaaattaatctgaaaaacatttattgagtactttcaatatgtcatcagacaacttcacctgtctttgcgtatgaagtttttgtttgtgttttgcttcgattagttttgtaaaaggagacagcaacccaaggactttatagctataaaaaggcaagggtggttactacaagctaaatatgagaaaaaaacagttttgattcattccttgaatgcctccatcacagagcagtttttagcaatggaagtaagattgtgaaaggaaaagaacagggccctttacagagctccaggaatccttttgtggtactttcagcaagtattggtggtagaaaattaatagatataataaacactgtgaggttggctggcattttatctatcccttgaacaggtttaggaaatataattgacttgtgtccacaaatctgaaatacaatttttttgtgtgtaatagtaattttccctgcagctttggcattcttttttccattaaacgtctcagttttcagtgaggggaatacatccttggtcctactttgtcattttgggatgatttattttaaaattacagtaagggactttgttcggaattccactaggctaatttcaaacccagtttgctgactccaactcgccataatgttccccacctccagcacaccgaacaggaagtggcatactcagatgccaggaacaaggcgattgctcagatggaataacacttggcagtttggaaaaatttgttgatgtaagctgaaattgtaggttagatactgacttgtgggatacatttctgccaattatggtccattgtacagtcaaaaatgggaaaaattacttactgcagctggctttttggcattgaaatcactgatggaataatcagagggaaatcttctaagttatcataaaagatggattgtgacacaggatgtcagtttccagggttatccgttttacctgcctcacatgactggaaagctttttgtttaaggaaagaatcaaagagccagagaactgttgagcactccttgacactgacttgcccaatgataactgattcctacaactagccttcctgtcctgctacttcaggggcctatgtttttaagagctgcagccttgggaagattttttttccgtgcctctcctgtgtccaaagctcctgaagcatctgtaacttcctattccaggagtgtacacattctgtaactagaagcctacagctgtaatgctgaacaccaaaataactacagttgatcactggaaacatgcctaaggctgaacataatttttcattttcattcatggatttgtacatattctaaaaaaaagttcactctgaaaataatatttgcataaaaggaaataagagaaaacatactacccacccatgtagagcaaatgagctacatctctttattgatgaattttaagtcatttgggtttttccatacttatttctcattgaatgctccttttccagaagacctcacagttgtctgactgtgtcctccatcacagtcctcccagtattcaggacagatcttaggattcctctcttgagggtcacgtatccctgctttgtaattcacctcctctgtcctctatttcaggatgctcggctctaaatacactgcttgcctcaaccttccctttggattgtaagttccttaaaggaacttaggcagccgatgtttcagcctccccagaatctgcctcctctttttctggaaatagtaccttaattactcaagagaacctcctctcccactttgcatacaggccaagtggcatcccaattaagattttcttctcgtttctgcctggaggtgatcacatgattcagttgaggctatccagattatctctgccctgagaatttgagctttgagtagaatccctgtaagaatggaaaagagagagatctgattcctcttaggagagttttctgaagagaaggcaggatatcctgctgcttgccttgacttgcctacttcccttcctttataagccccggttgagtagcttcactttagagtatgcgagttgacgcatatcttgccaatacatcttttaattttgtcccagttggcccaaattggttggtttttgttgacaaagtatcctaatacagcctccatcttccagttcctatttatgtgtcatgatgatctgaagcatttcaaaagaatagtgaaggttattgcataagattcagaaagttccagtattcaatgggatcatagatatgaattaaaccaaaaaatattctttattatacaactttatttcttcccagagttttagaaatgtgtgagtttaaaatggagagttcgagcaggaaataactggaaattcatgaccattatctttaaaaatgattttttaaaaattttagaatagttttaaatttactgaatttttgtaaaatagtacagagtttccatatagcccacacccagttctcccactattaacattttacatcagtatggtagatttgtcacaattaatgaacaaatattgaatatttttaactgaagtccatagcttatttagattcctctgtttttccttaatatccttttcctgttccaggatcttatacagggtaccacactacatttgaagtcacatcctttaggctccttttggtgtgatagtttcttagaattttcttgtttttgatggcctttacagtttggaagagcatggtcagatattttgtaccatgcttccgattgagatttgtcatatgtttttcaaaagtttagactggggtaatgtgttttagggaggaagaccacagaggtaaattgccattctcatcatcacatcaagggtgcaaactatcaaaatgcttattgctgttgatggtaactttgatcacctggctgaggtagtgttcatcagggttctctttcttttttttcctccttttacacattgcactctttggaaggaaatcactacactgtgtgtagcccacactaaagagttgtaaggtgagagacagacaggtacaaagaaagaggcagttattaattccaggatttaaaaaaacaagatggcattatactccacctctttaagggtgtagtttgtatatatatattatccataattcttccacacaggagatttatctattttccttttttattttatagcttatttatattaatgtagatacatgaatacttattctataagtactggttataatctagtactagtttatttattatgttgctcaaattgttacagccttggccatggccattgggaactctttcagtggctcttgtgtccctttggcatactcccattgttgtggggttttttggtttttggtcttttttagcccttccttactttctggcaacacaaaatgctcttggcttatctctcatacttcctgctccagtcctagaatcagccatttctccaaggaaccctggttctttttagtggagaatggcattaaaaatatgtatctggtgttagttatgctcattacacctagagtgtcattgcttctaggtcttctcagctgaaagaacaagaagatgtatgtgtgtatactaacccatctgtatacacatatctataagtatttctctgtgtaatcatttgtatctattaagataaacatgaacacatactgatatctccaactctaatctttcaccacattctaactttgtcctcttgcttttctgtaagatcccaatagtgaaaatctggttcccttcacccaccattcattgtccagttccagcatagatgtattgtttcagaattgttaactcatactcctgtggagaacagctgtatcaactagagtacagtgcttatagtgcagttactgttacctttagccgtatagagtgtactcttagtgtaccttattccaaccccctgcagtgacgttgtttcatactgttctctttaaaattatgttttaaatttatccaggggataatgcatagctaaagatgacaattcgtgctgataggcttataataaaaactagcagcccctttctctcactccttgtgcacctttacctgttccccaagaacaacactttcaactcttttagctgttcacatcaatttgtctaaaatctaaataatgtactttacagcttgagatatcaattttaaacattatacattgatttcctattattgtaggtaaggatttagctttattgtacctcctttccctgacctatttctttacaacatagttatttcacattttttattaaatcaacatttagtgtttacattgctttcctgtttgtttttttaaatcctgggaccaataattgactctttctttgtacccatttctcaccctataagacttttcccacatgatcaaacttaccagacagtatccagtttcttcttactcctagttcttacttcccaggaccctctgtttactcaggctgcttcattgagtgtatttatgcatagctaggaatagggctgctggtgtctgggaactgaatggggaaggagactaggtgggtggggggttctcattgtcttctatgtaggctttcatttcacctccttgttcttagattgatgtctcacctcacctcaccttccactgtgcccaggtcactaagtcacaagcctttctgagtcacttacagtgagactgatactactatctcctggcattggaaggatgtgggtttcagttgcctcattgggcatgaagggcttagggacctaagggtgtatatgcttttcatactgctttctaaaaaactttctgctttcaaccctatgacttaccctgctttagtggtatgtggtacctctaattcctgcaccttcctaaggttcttcgcagtaatgcatttgtttctctcaggtataccctaagattgccccatgggtacataagttactctagctttactgtgctgagtcagtaagaattcctgtatctgcttgacatcttcattttgtgtggttcagtgttacagatgtctttcgcctttttttttgtgctgttggttgttgtgagaggtgattgtggaaagaaaagggtgtgccaagttaaacctgaagtcccatacctggtctacattttgtatgaccacactaaactcagctcatgcgacctctttggagaaggtactcctgaatcttccaaagtaagtttctttgtctttggcttccacgtcattctgtctgtggcacatgccatactcttgtcattttccccactagacaataaacacatctagggcaggaatcatatctaactaactaacgtatgtgtactgtgaactctgtgctgctgactctactagatatcctcaatgtgtacttacttaaatctaagaatttgctacattaattgtaaactaaaacctctgagatatattatgttgctcaggtaccatctgagaagttatgtgtcaatgttgggctgaaactagaatttcacgttttaaagccttaaactggttttatgtcccacaactatgcggcccctggaaggtattcttgtgtgacctagaaaagattggaagaaattgaggatacttcaattagggaggttccccaaataacttgatttttctaattagatagagatatctttcatatttaaaattttatttctgtgcagatttgctgtgactttggtgtggcctaatctttagcagtaatcactttatcagtgaaatttaacttagaagtccagttagggttaagataaaaaggccacatgaggtaacaaatgagaatatgtactctggagttatacagatctgagtttgaactttagctccttcacttaccaaataaataagtcatcaacttctttcagcctcaattcatctatgttaaaattgggataatagcaatacaaacattattggtctgtatgaagattaaacaatataaaatatgtaaaacagcataatgcctggtatgtggtaagctttcaataagtgttaccttcatttgttatatatatcatgacagttaatacaatgctgagcgaatatttgatgattgtctgaaataacttgaaaaagtttagtgaaaaaattgggggatggaggggttgggaactgggcacagacaattcagccatctaaggaagcagtggcactttcttcactgagccctattaaattgaaagattgtgttctagcaccagggaagagtagctatatgaatcatttcttatgatctaaagtccattagctactccatttagctgttaatgttgcgaggccattggcggaaataaatatgttatttggtaatggacttgttttcttaacaattataatatattctttccaaatgctgtaatttaattctgccattgtgctaattagtcagccgatcagccttcagcattgtttcaatatcccacccaccacatttttatattaaagctcatttaattggtgttgtgggttgaattctgttcctccccaaattcacacataccctaacccctagtacctcagaaggtgatcgtatttagagatatttcatcttgaaaagattaaaattaggccattaagctattagggtggggtctgcttcaatgtgacttatcagaagaagaaatttggacacacaaagggacactaggggcatgcagagggggaccaccttgtgaagagacagagaacaggcggccatctgcaagccacagaaagagacctcagaagaaatcagccctgccaacagtttgatcttcaacttgaagcctccaaactgtgagaaatacatttctgttgtttaagccaccctgtctgtgggattttgttacagcagctaagcaaactaatgtggttggcattgaggagcaaaatttagactggaatttctgatttattttattctgtatagcttataaagcacttatcacacacgccatttgaacttcacccaatcctataaagtaagtgttattattaactcccgttttacagatgaagccattgaggctctgagagtctacacaaacacatagctgctcagggggcaggtggaaattgaacctgggctatttgatttcaatccccctttctttttatgtttctcatttctctccccctttactgtgaatgtagagcatgcacctgttcttttctattgcagttcattcatttgtgcaactgacaggttaccactggtgactgtggattgctgcctaatgctgggctgaagaaaacaacaaatttgccaatctcaaaagagagcatttttatttattgctcagcttccagaacctaatgcctttcaattttctgtcattgttccactgaaagtgaagaatgtaatgttgatatacctcttgttttttctgcttttatgccactccatgtggttagaccaccttttaggtgttcattcattccacaaatatatactgagcacctgttttgagccccgagtttggatgtcatgtttttgaggcaggagttaatgtgctcagcatgaagagctgggtctgcacagaaaactgctgcttcttgagccagggaggtcttcccatgatactatattgcagcttctttgctgtaatgaaaatacagtacacctttccccaactcccaaattaagctttcagtgttcttcattctctgaaaaacttttatagaaattctaagaagtgtgcctcaaaataatatagtaagcaacctgatattactggttttatataatcttagtgcactatcttattcataattaaagttacaacggtgactatgtggaagtatcttggaggagaaagtgaatagatgaggtggggggacatttgagtaataactttgattttggatgtcttctctactatttttagattataatttaaataagttcatgtgtattatattatttcaccaaaaattttactttaagatatggagaatgctccatttttccccgtaagagtagcaataatttttaaaattgtcttttaaaattagattaaattacttaattccagagacctgtgttgttcttgtgtgacaacacagagtatgcaactttaagttactggccgtctaattaaaaagatgtttccaaagtatgaccagcattggaatttgttcagacccatatttataaacagtaactatgacaactcattcctcccaaccatgctcaacccctcatactttcccaactgtctgttttacaagatgacataagtagagggtttggaaaaaagaaaaaaaaatctttggatgataaacgctttttgcaaacagagcctataaagctgtttgttcagcagcatgtgaatcggacagtgggagttcatcagacagcaaggattaaccccctaatttgtttctctcttttggaagagaacagactgctgtgaattccgtgtactcagcctgagctgccaaacatgattgaaaactatttgactgactggtggccaaaacatgaggcagggaccattcatcattttcctgctcttcactaccccatataataagttttgttttgtttgaaaggagtaaatgtatgttacagttttcaaaccaatgtctccgacaacctaaaagcatttcaatattgtacccttttccaatagaatggaaagatgctacatatctgtagcaattttaaccaaattccttctagttacctccatttccaatgcagaaactcctctcaagtgaatacatacacaggttataatatacttgatgagccagtttctttaggatgagtacatacatgactggttttgatttgaccattgtggtgtgcagtgggcttactgtgtccataccagtgtcagaatagtcagtcctctggtgcttgattgggtggcatagcccataagattagctgacttttaaaatcaaagtaataggaggactatgcaatggagacaactcctcaacattgacccatcccctcagtccagttccatatgttccattgggaattaatttcctgcaggcatagaggagtcgtaagagttgcctctgccagagaagccccatctttccttgagccaggagtcagtagaagatagtaggctacaaaccatttgactatacctctatgatctcttgccactgaatatagaaaaggagtataaagaagcagtataaaatatgaaattgaattgtcagtggctagatagttagacatatagtctgggtattcaaagggagtgccttttaaaaatgtgctcaacccccattagcccatgaaatgcctcctttccgttcctacactggcatatctttcaccagaagcatttaaccagattctagaacctgtccattgggaataatttagtcaccttcttcaacttatttttctctttttcccctctcaaatgtcattttttttcacatggctccagtctcaattctcctcttattttatccattgtccccagtaacacactcttctttgtccatctagtcatacatcaatccacctatctattcatccaatcaactattattgagccccaattacatgcatgtgaagcatattctcaaagcaccatttccctggccaagctaggatgataatgagagataagatgctctgtttcagtttggttattcaaagcagaccctataataaggaattgggagcaagtagtttatttgttaggtaattccaggaagcaacagtgaggtaaagaaggagaggaaagggggaaaaaaaacaacaaaataataaaggtgcattaagatgtgagaaactgcttataggcaactgggtttagtcctgctgggaattttttgagaaactttgtagaacgtgcctcagaattgtgcccctgaaggatgagaaagctgagatgtttatccatttacttcagtcctcactggctaagagttatcttgggggcattaaatccctggcattttcaggatgccctcccagtaggctttgcaagccttagtactggagagagccttcaggcagaaaagcagaagacaagggcatgcatagtttctgttcacctaggctgcaggtgaactcaaaagtggatgcagaggttttggttggggtgggggtaggggtgatggtggtgattccatagcatctgcttcaacctctgtgttaccacccccaactgccttaaatggaagcatatcagagtttttcattttctggtaaagagtaccagggtgggcatttactctatgtaatgtgcagaaacacagcactgtgtttagaattggacttactcatttcctgagtatatgtatagcttccctttctctacaacctcttttcagcagatttatgcagacaagaaaaatattgtaacccaaagcgccactgcaaatttccctgtgctgacattaatcatgcccatttgatttattatctatcatttgaaaagaatattttgcaactcttgtgcattgatttttttttaccaagaatgattacatccatgcagcataactcttctaaaggctaatgcagtttgcttttatcacccattcactccctaattatggtgttttcgaaagcagacactatacctggaaagttgggagagaaatatttgattcacccatctttcagagaagaggagatggatttaaaccaggctagatactgtaactgattattgagtatttggcttggggggcttaatttaccagctaccattgaattaattgaaatataaacttctgtggatattaatactttcaagagtcaaagtttaaatgccatctactttggatccgttcaaaatattttcactaaccctttataatttaattgactttttaacttttttgttctgttttgttttaacacagcgatctacccttttatgtaaccccttctgctccacatatcactgggctggggccaaaagtaactgagtgactaatatctgggaaatatttattgaatgagtgaaagaaatccacttgggatttatacccaagaacaaatgctcattaactgtaaattctccttcttttgaggttcatatatagatgctctatatgtgtttatcaaacacctatcaggttatgaaaagaatgcaagaatgcctctcttttctctccatttatccaaatctatcatttaaggccctggcataatttctccttctttaatgaagctgcttcaatttcttccaattcagtgcttcatatacttggctgcagttggggagctgtaaaaaatcctgttgactaggctacaccctagaaccctagatgatttaaaccagagcctttgggtgtggaattcaggcctctgctttttttttttttttgagacagagtctcactccatcccccaggctggagtgcattggtgtgatcttggctcactgcaaccccgtctcctaggctcaagcgattctcgtgtctcagcctcctgagtagttgggattataggtgcctgtcaccacacccagctaatatttgtatttttagtagaaacagggttttgccaggttagccaggctggtctcgacctcctgacctcaagtgatctgcccgccttggcctcccaaagtgctgggattacaggcatgagccaccgtgcctggcaaggcctctgcacttttttttttttttgagacggagtcttgctctgtcgccaggctggagtgcagtggcgcgatctcagctcactgcaacctctgcttcttgggttcaagtgattcccctgcttcagcctcctgagtagctgggactacaggtgtgcaccacaacgcccagctaattttttgtattttagtagagatggggtttcaacatgttagccaggatggtctcaatctcctgacctcgtgatctgcccgccttggcctcccaaagtgctgatattacaggcatgagccaccgcgcccggctggcatctgcatttttaaaagctcaagttattacaatgtgcagccaaggttgagaacaccactgtacctggatgtgattgctctcttctctgaaaacctaggaaacctcgatattaaaagccacctcttaaggacagttgtaattggcctagtattctggcttaagttactctgaagatcaactagcctaaccacccttccaattccaagatacctctgacagccttctggttgtccagttcaaatccttaatactgacatggaacttattcccagtgcagccttgcccatctttgggcagctctgaccagtccagatataagtctgtctctttgtagcttcaagctattcttcctgtctctatcactttggggtggggctgggagtgagggaatctttctaacaagtgttttaaatgtctgaataatctatttattcaataaacgtttatggaatgcctcctatgtattggacactgggctacctcattgaaaagcgatgtacaaattcctaggaggatttgcaagccagtcctcctttcttctttttcttcttcttcctcttcctcttcctcttcctcttcctcttcctcttcttcttcttcttcttcttcttcttcttcttcttcttcttcttctcctccttctccttcttcttcttctccttctccttctccctattcttcttcttcttcttctctttttattgtactttaagttctggggtacatgtgcagaacgtccaggtttattacataggtatacacgtgccatggtggtttgctgcacccatcaacctgtcatctacattaggtatttctcctaatgctatccctcctctagcccccaagccccggagaggccccagtgtgtgatgttcccctccctgtgtccatgtgttctcattgttcaactcccactcatgagtgagaacttgcattctgtttgttgttattttgttattaagctgccacatttctgacataaaagaatatctttggctgcaatagtgaaagagaaaatgggcgtaagctgcaacatgagaaatttaggtagcagagcgatgactattaaactttgagaagttttctgtttaacgttgtgaaatctttccttgaagctttaaatatgacatactttcatgtgattctatttatatactgccttgagggcagagggcaatgccctgtgttccttctgagggttccttctgagtgactctaagtctctagatgaggtagccctgaggaagcaagaatgaatgattaagatacttcctgatgatgtttttaggggaaagataaacaaggttgcttcccctgctggctggtgttccccatcgtgcatgcatccagatgaggtctccaaggaaaatcttggtccagcaatgcttgactgtgccagttccctgatgctgatggctttgctgggaaacaaagcacattaagggtggatctaggtcactctggacttcatacctttccaaggcaaggaaaggccaagccccaggggctccattcacattattgtgctcctgaggggttgcgctcctagacttcatcagtgtcactggaaatgatacctcccacagtcatttaatgaggtagtcctgggcatatagcacagtggagataggcaccttgtcaaacaactggtgctgcagaagtgctgaaaaccctatgctgtctcattggagggaaggtaaggggtctcagagactctctcctaggaattagaacatggttccacttactccaacctagaaacacatcagagaggaattttatactccaggaaccaagctaactaagatgtttccaccacctttttttgcctgcttagatttcagatccttctttctttctaatacaccaagccctgagatgacatgggttccttctaatctcagagtgtgaaattttctctctggaatttaattctggtttattcctccaccttgccctgctttatcctgtggcatatgtgatgccacaatgcagttgtgacttccctggatgcatcagcgttaaagcagacacaagcactgaaaatatgcagggccagaccagcaggtcccgtacagctgaagttcatcatggtgttttacaaccaaccaattactcaattcattttatgggttgactgtgcccatcttttactctcatgaagcattttctatcgtaagacagaaagcgagggaaaagtgctctttcagttccaaaccctggggcatttatgcactaataaccttcctcctttgtgcttttccaaagaatgtaaaccaaagcaattaaattaaatggagttaacattggcatggtagcataaatcaaacgtcaggaaattcattattaaggggttatcgttcctttcttatgagctatctagtatctgccttctctgaggtaaaaataagccaaaaatttggtcctgatataaatgaggggactgcatgagagagagacagacagggagagagagaccttgtgtttagcagcagataggcagacttgtgatttgtgggcgaaacatgtttatcagatgcttgtctctttgcctcttaatcaggttcttcttcccatggcatgctaagcaggcaaacacagttaagcagtttacctctgtactcaacagttccagaactgaaagtaaacagccttgtgtgtttaggctgcagccaccgggctgtgctctgtagagctgccagatttctccacatcactgattctcccagtgaaaagcaaaggcttcctcttcattgtgttcacagactgaaagttgcttgcaggattggcttccgaagttcagaccctgatgaaggaaaatgatactccgagtctgagggtggcaaatcagaagaaataatttgtttggattcgggtctgattttaatttcaggagtctggggcctgaaagctttctgctgagtctgaacacaaaccccaaacttctcaactcaggttgcttttaaggaattgtaaactatttaaaacctatatatttaaaaaattataatttattcccaatgagaggatcctctccccagccaacgtctattttgcacatgactttctaatgaactgttaacaagcatttatattaagagcttgctcgggcttttgaatgatggaagataattctgatttacatgagtgatagtttaaaattccaggtgctttatttctgtttattggggtgggacaggggaaggactaaaactgcctacaaagaccctttcaaaggcaaaggaatagaatgtataacattccattttgtcagcatgaggaaggtcttatttaagactctctgaacagatgtgaccaattgtattggtgaggaggaatgttggaagataagatgttctgctctgtttgaatgtgtatttttagcagtgtcctattgtaaagaagttatgcccattatcttttgacttgctttatcagattaaacaaagatgctcatctttctaggctttctaatatgctccctcaatgcaagtctctcagctccaatgctgtgtgttagagtgtgataccccctcctgttactcctatttggctgaatttcagaaatccatttagatactctcacggttttgttcagcattgctcaaaacatggcttctcaccaattctgactgtctctctgaaacatgattaattttttctatgtctatctttacactgtagagtttaggttgaaaatatacttttactgtagtctcttattttcaggaatgtgtacgtaagcacccaaatgaattctactctgagatacaattacccatgtatgcttccaactgaaagcatccactgaaaaaatatagatagagaattcagtagctctgactgttagagcatctcagtaggcaaaagtttccttacagtaattgctatgctttggaaacagcattttctgtgtactaagaactcaagggagagctgtgttcaggtcaaagcttgggtgaggtataataagaaagaaccccagctggagcagtgaaaaaaccaagaggcgagaattttgtcctctctgaacttctcggttagaagattaagagggagatataggttccctgagacatattcagaaactataggggtttctatggcaacagaaatgaaaaatgaaaatacagtctcatcttctcttgttaagatccctcagtttcacatgagcccaagatcaaggagtcaaatacagagaaagtcacagagcaaagagggagccatgtttcttttcgtccagcagatggctagcaacaagaactgcttagaagaccttcacttgttgaggaattgagagaactgttgaatttccttttttccaggtgatttttgggaaagattgaaaagttaatccaaagagttggttgagatagagcatttatctcacttggtagctcccccagtggaattgaagtccacagaattgctgtctcagaagtttcattctttggttagctgtttccaaagtgtaagtgagtccttcacaaacatgattaccaaaagtaataaataaatacatatctggcagtgaggatgattttttttggagatttttagttttaaaccacgtattttactggaagtataatgcacccatttcccagtggttacatggaaagacttcgttcctcttctggttctcccagcaatgacttttcagtcactgaagaattcagaggacaatgacaactcccttcacaggatcatacagacacctgtcatttgaatgcctgggaaaaggataggaatggagatgtatctggttggactccaagataaggaaaaacttttgatgggcaattggaatgtcagcagatttatatctccttgaacttgggtctgtcaacactgccatgagaaggaagatgtttttcccacagagagacatttatggggcaaagacagacatcagtgtgctaaatcttataaaattcctttgcatcatccaccttgacagatggtcttcaggaatgtgctgaacctccaaaacagagggttgggaggaaactcaagagtgttcttcccctgtcttctgtcaatgactacgacacactgaaggccacattgaccttccatcaaacatacatgcaggcttcaagccacccttccttcttccccgtaagggacaggttgaagcaaagatcatgctattaggtattaggtaacaagcctccacttacagagtatcctagggatgaaaacctttttgccttatagccatgctagcttcaaacatgagataggtaaaatcgttttgttttcaactttctttccatttacttccctttaacttttctattatgccacaaaggacaagtatgtgttttccttataaaaagaagttttggcaaaaaatgaagttttggtcctatagttcatagtggccccagaaaaaattgccttactatttccacaacaccattgcttgttttttgtttttgtttttttatatagtcccacactttcttttgctcctgtttcatttactaacttggaatgctcacgctcctgggcctgatacactcctaggatcacctaggctgggtgaagcttggccttcagaggagtagacagagcaggaaggatgaccactatggtcttagcttcctttagtatgacttccctttcttcagctggagtcccttccctaaacacctgcagccatcctgtggctttgcatagtggagcccagggactaacacgacagtggtctgagtgtctcagacttcgagactattgctttctcctctgttccaatctccaaaaagagttctatgagaataattgcccaaagagaaggtacttcatttggtagggctgggaaaagaggcatcagatagcatcttgatatggtgaaagatttgaacagacaaagatctatctggtgctagtttagttgccttgaatcatcattacagatccctctggactatttccctttagccaatcagcaacttccccagggagaaacttgagatcttttattctagatttctggatccctaacttgttccaatgttcctttctttttaaaattatttttagttttcaatttaaaattttttcaaacatattttttaaaaatgcagaaaatcagagaaagggcagcatgtatatattcactacccagattgaacggttgttaacactttgctatgttttcatcagataacttgggaagaaaggaaggaaggaaggaaggaaggaaatagtgcaaatatagttgaagttttactcagtatttcctgctctcttccctttcttccctatataatttacttaaaagtttgtatatattattcctatgtgcattttgattatttttattacatatacatgttctcataaaccacatagttattgatttttaatattataactttaaacaagcagcatcataaagtatgtatcctttttcaacttgatttttattcaacattattattacatttttaaagactcatccacattgatatatctagctctagttcatccattttaattatacgaactagagttcgttaaatggtatagttgctctaaatgccactttactatacaaagctgattatgtttcttgcctactcataacaacccagccccaaactgcctttccagtcatcgtgaattacatgttcttggaccctttccccttggtcctcctgtctttcaaaagatgtgctacattatgtgatgaattaattgtctgtgctttgaccccagtgagtacaaacagctttgtgagcagcctctttcaggtaagagagttcatttgagatatgagattttgtttgttcaccattatctttccagcatctaggagagtgcttgattcttaataggtgtgcaatagatatttgttggacaaatgtctgcatgagtgagtagacggctgtggaattgggtttaatgctgtgattccaatgcatataataaggaattaagttctttcctaaaatactcacatcacactctagcaaccattggcttcttgctagttgatttattctctaagaattgccacaatagattaaagagatgatgtttgtcaactctttcagatggtagaatccttgcttgcctcagagaggaccactgaatgtttgcaaagaactaccacaagccctcaccatggggaattggtgatttgaaaggcctggcagatgttacactcttttgccatctgtctcttggaagtagcttcaatttggctttcagtaggccccagcaaggtcatgaatatcagatttggtgagaaaacgccaagtgtgtagcttcagtcaaagggagacagcttttcccttatgctgctcttctcagcagcccaggcccatttgttcttcctctgtgtggaactggatgctccctcctgtagtaaatggttagagggtccagaatgaaatggaaagtggtcctgtatcatcagcagtagcttcttgtggactttgtcaccctcattcattcaacaattgtttactgaacaagtaattgacaagacattctaacaccgacaagttgtgtttaattcagaggaggagactgaacgctggtgtttccaaggcactaaataaatgctaaaacagggagaggaagcacacagggcagaggaacacttaggaggagcaccatactattctatggtgtggtggtcagcaaaagcttcctgggggaagtgaccttatctgtaaaatgaaatgggattaatacccatgttgcaagatggagccaatgtaaggtaatgtctttaagtttcctgctgcttgcttagtaatagcagtgatgaccatgtggtattgatggtgatgacagtgatagagaagaaaaaaaaatggcttcacaaccagatagtccggtttcaaatcctagctcttcttgtccttagctctgtggccttgagcaaatcacttggcttctctgtgcctcatctataaaatgcgaatagtgctacgtaccgctaccacaactgtaatgattgcagaaaatgttcacaaggaacctaacagtgcctagcacctggaaggcattcagtaagaggtgaaaatgcaacaggagcttgaagagaaggtagcagtaggagccatcagtggatatggagggaagagctctgcatgtggagtctagggacctagattctcatctgactatcactgagaagctgggtgcccttgggcatgtcatgtctggcattctctggagtctcccatcagtgcagagaggcccatccatgaatcaggtaatttttaagtgagagaaacacacaacaagcctaggattaaggatggtagagagattactgtgtgttgctatggcatgggaagactttgtggaggagaaagccctcgggctggatgctgaaggccaagtaggtgttagactgggggagctaagtgaagagggcattccaggcaggggcatgattgagcaaaaggggccaagtcacgcattaagtatgtcagccgcttccctcatctcctcacctctggggcagccttactcgtggagaagaatggataataggaaggtcttgacttcagctcagaagtttgtttctttgatagtcaggactggttctgggaaaattgtcaagtcattgaagttagtctgtgcgaccattcatcttaatgtgagcaacccacgttttttgcctgcacattgctgccacctgggctaaacaagccccccactcccaccccactttgcaagcctacaaaatatgccctgtagagcagctcctttttgattcttatttccaccctccaaagcatacccagaagcacagtatgtcaaagcttagagggagctcggagttcattattttaagcccccttattttattatgaagggccatacccaaagataagcacttacgggcagaaaaggaacagagacagatcatcacggtctcccagttgtgttctttcttccactatgcagcctacatttctctctaccatacattttgattacttaacctaggacatcaatacctatgtattaatcaggactcttgggattttaaacgtcaaacacctagagaaacttgtttgataagcagggaagttattggcttgtgtaactgaagagttttggtagggctgaatccaggtttccagaagatgtcaggtgtttgcctctccttcacaaggcttaacttttctcagtgtggcttcattctcaggcaagctgcctacaaatagtgtccaaaaggccttaatggcaacaggcttatatcctacaaatagtgtccaaaaggccttaatggcaacaggcgtatatcctaccatcttggcatcccaagaaacatagagaaatgtctctggcataggtcctagatagggttttcattaatttggcttgagacatgtgcctactttcattgtgatggggttatagaactgtgatagtcttaaactaggtcaggtacccaccactgaaaccaagactcaaggtcagtctcacccaaaccatggatgactgtggggaagaggaggttcccaagaggttaccaggtttctgtttccaaaagagagggaaatagatgttaagctagtatgtgttcactcacccacacatcaccctcacacaacccaccacaagctgataacagtttaaggtattgtattcctgatagcattagccttttgtgaaggactgtacgtgttttagttgagtataacatggaaatttggggtaccatggaaaggccagtgagggggttagagaaggtggagattttgtatttcagggttttttaggctccctcaaattatagcacaaaatatctactttgtggcatagcataaaatactttacttataaattctgtcctgatgatagccaggaactcagcctgagatgaaaaggtttccattagtgaaccacatgtagacaattgtaagttaatgctaattcattatcctcacacctgggctttccaaatttgtctacctcttttttttttcttaaccatgtattgcttatctttctcatgaacataaccaatgtcttatgagcccaagtcaagtagtgaacatcagataggaaattataattttgtgtatattctttccctcatttttgtggcctttttgtgtagttctcttgtgcctggagaaaactcagggtttgtgtgttaagaatgaagtgcttgcattccctcacccagatgcagtgcagcaatggggtacagtgggaccacattggaaggaggtaagattggtggcaggtagttaaaaggtagcattgtttactgtgggtctaatgcagtatttctggactgaatggaatggaagttttgcctaacatcttttagaaattgttttcaggtctgtttcaattcctaatgttcttttatataatttctgactcatttgcttaatggtttcatttgtgtttaaaaaagcaacatcaaaccttcattatttactttccgtgatgctttaaataccacagaattcagtaaggccatcaaagagacagagaggccaacattaaacattaatttttattactttggcaaagaattcttgagataattcagcacagaggaaccagtacaggtctctgatagctgtaccaagtgctgattaactcaacctcacaaaatctcttgcctgtcaacaattagtggaaacatacagaaatatctaaatatcccaaagatattggggagatatttggaaagtatatgaaaacatttagaaacatcagaagtttgaaaaacaaagttttccacatatatgaatgagactggggaagggagtatggtctgttttcttctcacaattttatcaccctggcagttattggtggagagaaggttctcagtaagcatatgacgtatctattactttatctttaccttgatttctccattcccatagctttaaaagtcattagaggagataaaacagggtcatttattttgtattgtcatatgtatggatttagcagcatgtgatatctttccttccttccttccttcctccctctctcctccctctctgggtattccctcctttccttcctccctttttctttccagtatttaatgactcctactctatgtcattgtctcttatgactgagagatgcataaggcttagtcttgccctcaaaaagcttacagttttttgagaggttacacacaagtaaatgggcaatttcaatatagtataataaatattatgatagaggaagtacacagtgcctttgggtcatttaaggagagcacttaaactcagggaatcaggaaagccttgtcaggggaagtgccatctaatctgagttttgaaggacaagttgagttagccagagctagttttctatggctgagtgggccagatgggaggagcctggacctgaatttaatctccctgctggggtaaggcaggtgtcggtggccacccccagcttcaggtgctcagatagagtccagtccagtagtcatagcatggtagccaaaggattttgccttgagttcataatcaagaaacgcctccaggccctggggagcaagagaggagatagtagtactggaagtctgccagaccttagaccttaggagagacacttgtatgaacatggtcaagtgaaattctagtgtctggagaccatgacacagctcagcctgcacagggcttgggacgtgagctttgtatgcacagtgcagtccaggatccagccgacagtccagttgttgcctatacccgcagtcaattgccatgttttttaggaagcctctgtcgagcgactctagaggtgtttctcccttccctcttattactaaaccttacagaagctaagcttgcttctaagatatcttttaggtttaatattcacaggattacagtgtctgcattccttagacgctcctatcatgctgtgctagtcgggcactgtgctaggcacagggaatgttgagataaaaggaagttggtttgttgtttaaactacccagattgtgcattgttaaaaattattatttttttggaactcttaaaattttgttttgcccaaaaaattacatgacactttcctcttagaaataagttagttatataatacagaaatgtaaaggccaaaacattaatattttccttctttaaattctagcttctttcaccagcgttaacaactgataaccttctcttgtgtatctttttagtccattttctatgcttgcatatccatatataattgtatcagttgagattccagtaggaaacagatggtacattcaaattagaataatttagaccgggtgtggtggcttatacctgtaattccagcactttggaaggccaaggtggaagaatcgcttgaggctaggagtttgaggctgcaatgaactagcatggtgccattacactccagtctaggtgacagagcaggaccctggtctctaaacaacaacagcaacaaaaccaaattaggataattgaggtttagtttaataaagggactatttatatgatgtagagagggtatagggaaagcacaggggatcatgattatcaaccctaaatctgaaggggcacagagaggaagtggtcatggaaacctggacacagaaagggtgctgcagaaaggaccctctaatgggcactgagacctgtgatggagggatgcagccagttcttagcaaccacaggaaaggggctgggaataaatgcactccttcctctctgcttctaagcgcccccattgactgaaccctatgggaagccaagggaacaagaaaacctattgatgtagtccatataggtcagcccccttagccagagagctgagtggagaaaggtggagagtggatcagaggggcaaacagaaggtctccagtacaaatacatacatagcatatagttttaggagcttttactttctgtgcttccttgttacagaaatgagattgtgctgtagtacgattctgggactttttgttaacacaatttgtcttgaagcctttttgcatcagtatgtatggatctaatttaattattttattcattggctgcttagtatttcgtcatacaaggtatctgaactttttaaaattatgtatatgtaatagttggtatatacaacagaatatgtaccacctatgtgagttatgaagcctagcaataaaacagtcatctgtaaatttatctctcaacctaagatcactaataccatcgaccttagtcaatcaaactacttgacctcagatcatcaggcaatcaggcattagttagaattacctaaggagcatgcatgtgcagttcacaatagggtttgggtttctatgagaatctaatgctgccactaatctaactgacaggaggcagagctcaggcagtaatgctcacttcctgttgtgcggccatattcctaacaggccacagactggtaccagtatgctagctgggggttggggacccctgctatacagtcttcctgtgtcccctcaccccgccaatgctagtctgaagttttttgtgttaattctcttatactttttaaaaatagtttttccatattatgagtatgttgaaacaatatattatatagttactttttaaaaagctttataaaattgccgttttagttgtacatagtcttttacaatttgcttttttaacatagcattcatattgcagtgtgcagctgtgcttcatttattttcatagcttataacactccattgtgtgaatatgccgcaattcacctctccattctactgttgatggacttttgggtcatttccagtttttgctgtttcaaacagtgctgcttatgaacatttttgtccgtgtctcctggcacatacatacaagagttgctctagggtatatacctaggagtggaatttctgggtcacgaggtttacacatacttggctttgctaggtaatgccaaattgttttcaatgggattatgccaatttacattcccattagaagtatgtaagaattctggttgttccttttcctccttagtgcatggtatttgcagaaggcttaactttttaccatcaatactcttttcagggataccaagcaaaaacttaatgagagtctgactctgttatcataataaatatttttctacttttctctgtaaaaatgattttctctttcttgccctattttttttgcctcattgttccctaagtttatgtcatctactaataaattatatttaaaaataattaatacattaaaacaaatctgccaaatgggcctttcaattctttccaactctaaaataaatgtaattctagtagaaatccatatacaaatcatggttcataaaactgaaggttaacattgctaccatatggagaagttagctcacatacaaaaagagaaaaccatcagttctccaaatatttctttttaccaaatttgactttaacagcaaactggattgtgtgtactcttgaaaggaatagtgctccatcttgctctccctctctttcttcatccttccttagttttgttctttctttctttgcttcttttatgtattcattcactgattcactaaaacccagtggagaagacaaatgaattattactgtgtagcctgcaaatgggatgatgaggaatggacagatgtcttttggagtgagagaaggaaacttgacttctgtatttcttgagttcacttcagttcttaagataaagtaggttctactgagtatttgctaaatgaatgaacaaatcaatactctaaaatgttttcagctttttactcattgtagtgtaggaagagctacatggagttgaatttctatcaactagcccatcttttattactggagttagtcttctttggtaatttaatactcagagtacctcatatgatctctttatcgatgccttcaggagacattaaacgttctatcaattaattatacttaaaaagaataccttttggattcattcaagcacttcatcttctttccccaaatcttgggaactggtgtcagctccttaaaatgagccagcatgctttttcaccctcccatataagtaagagcttgtaatcacccagtgtttctctgacctagaaaagctgagaaattcacataaatgaaaacacaggggcttacaaaattgctttcggccctctcccttagaagcatatctggcacttggtaactggctggatggaatgtgggtactacatggagtgccctggtgctgctgctgctgctgctgctgctaggcttatataactttgaaatcagaaagcagattcagtggggtaggggagaactgcttttaacaagctgctgggattggctgaacttgtgctggccttgcactcttactattataaacttgatgtctttctcatttgtaaactttatttgcatgccagagctcagctgaatttgcctgggttcctagtttctttaatcttttgtcctgactggcttgcatgtaaatcagcttcagactttcagctgcccatatattgccctagtttgcactctataaagagttctttctttgtaggctcctgtccaaagcatggcagtatgtcttaaaactgtacaatatggttactattagtagtaatgagttgttattgagtgtcagtatgaggttgagtagatggagcaaccaaggcagcttagaactgagggtttcccagctaacatgctgtggaaccctggaaaatttgccaagctcctccaggtctcctattccatcctgccagaggtgatgtttttctttcctgctaggtatgtcatgaatataactgagaaccatgattctaaaacaattagaatgaaactttgtgattttatttgatgagataagcactgttttcatatctttacatacatactgcgttgttaagtcctattgtcataaccatgaattaaatgtagtcatttttatatttttaaatatagcaatgcaagaaaactgaactgatagagtgataataaggcagataagtgaaagaggaaggtgtttagccattcaagctactgctgaaatagtgaatctctttaatggtaatatatgagctggaatgtttatccttatcctttcctctagagaagattaatttatttggcaatatctaaataactgagaatggtatattcctcattcataacttagagaaacaatttggctacttttgttggcagaacctgaaatagcattgcccttccaaagactgtttaacttgatttcacaagtaaaccacaaaatgcaattatttgatattttaccatatcccattcccttctttcatccccataatgcagggggctgagtttggatttgcaaaccttactccttagcctaagcccttacaattgtttgtatgtaatgccagatgcatgttaaggaaggaatcctatagaggcaggttacttggagcgaagttttcagggtggccagctctgcccagttgccttctttggtcccagcgagatttgtagttttggtttctctgtttgaggctgggttgggtgcagggaccaagcaaatgaaaaacagacccttggggtataaaagaggtgagacataggtcaaacaacctatggctcctctagctgatacagaagatccatcaccaacaacataggtttatggctcagtcccatgacctgggtggaatatccggagcagttctggaaatataccatccattataatcatctgagtgcttgattaaaatgtatattcctttaaacacaaacaacaaaaacaaaaacatgtagattcctgggacccatgctcagattctgattcactagatctggggcgggacccaggagtctgcactgatgcagatgtcacagacaattctgatgctggtgctctaagagccacacttggaaaaattcagtttagtgcctctttgtcattcttccctttggctccttgcctttatttcaggaaataactatgaatatgactttcaatgtcacctctaggagctgcagccagacattcctatgatgtacttatagctaatctagttgagctccatttgagaggattctagatatattacttactagagatctggctttctagaaggctcccactggatccaggtaatgtccagtggcttgaacgatagaaagctggagtcagcagctggccttccagacccatacaaatcctctttctttggaaagcctctagcacttcactgtaaaataacagataatcccaggccagaattttaattagaaaagctgaatgacctgtaagtaaattattaagaatttcaatatcagctaagatcaatggaacagaacagacagccctgaggtgcatctgtagatgcgtgtacacaataattaagtttgttataaagatcctatatactattttctctgtatgtaatggtgggacctattttcatacaatccatagatacaattgaaataatacaaataatacaaatcattgataactgactaccatgggtcaggccttgttctgcacgatttctatatattctgctaatactcataataagcagcactttaagtattattactcttctccttttatagttaagaaaccaaggcacagggaagctaagtaacttgcataatgttgcacagcaagaaagtagcaggctggtcctcttggtttatttaagttaaaatgaaataatggaggaaattaggaatctgaagaaacctccattttcaaaagagtagaaaaatagatacctgaagggcatcgtggggtcataacataacaactgtgagaagtgttgtagctttttgtatgtttgtgaaatttttcaaaaatgtgtctaggtacagtagttgaagcttctaatgcatattggggttaattccaggactcttatcgtcactcagggtttgacaaagtaatagttatttgtattactaaaccttttaggctggaaggttttgtacattaatagatgttaaagatcttactgcagaaattactgtcatgattttggaagccctagtttaacccacattgatcataatatgtctctggcatggtcaagaagttcttttttcctgattcaagtactttataaagcatatttaaaggctggcttcaatctctctggagttatacagcccttctgttagtcctggtacaatccctcttgagaattttttcttttttttagtgttatcaaaaacacagtaagacgattgatattgcttagtactgaatcccggagttctgtctatgatcaaaatatcctctggcccaccagccaagattccaaaagtggtctcattatggttcatacccagttttccatcctacagccttgggttgagagctgcagcctccctccaaagtcccctccaggcagttctgggagttctgaggtgtttctagtctgttcagtccatttgttcatgaccccctgcttctgtcgtctcgttagtatatcctgatataataaaagtttgaaaatataatcaatgctagtaaggaacagagtcctatgctgtaccatttctttctgaagtgtagctttgttattaaaaacaataataaaaaaaggactggtacaaaatttcctgttctggaggtgtggagtttttcatatgtcaaccagctttaaccttttgaaggtttaatgaaatcagcaaatataatccactgtacgagagtggatatgaatcaagtctatcattgttgaacaaacggcattaatttccagtgcacatgtggatctgagttttaaaatattggtttgaaaaatgtcaagctgctcattgttttagaatatttgagcagcttgctagtatactctttttaaacagttgtacttctaaaaggttacagtgtttgcatatttattcctttcaatttaaaaaattcttccagtggcctgggtagtagggaaatacctcgaattcctttttttatggattgtacttcctagagggtattaaaaaaaactccctttcacttttagcagtagctgaagctacaggactcactttacaccccagcgctcatcatcatgtctccgggtgaagttctcttcagtgtccccagaagctgtagaattagattgcttaaagctcgtggaaaagcttatatctcctatgtccagtgtcagccccctaggaagaaaagagctctgggggaactaatgcttgttgagtgctctaaggaaccagggattggatgatgagcaggacggccatgggccctgctctcctggagatcatggttgctgttcagccagggtcagtggggcagagagcacagtcgtctcaaaagtgggtgtggggagatccatgaggatgttggaagcaaatataaaactgagggttttctcattttgaatttccattgttgcagatgtttcataatgcagatagtatattggtattttggtgcatcttttacaacaaacttaattattttgtatacacatacacagatgtgcttcagggctgtctgttgtgttccattgatcttagctgatatctttaagaaggattgacaactatattttaaaaatctaatctatctaatcaggaaattgatttaaacaaagcactccatgccatacaagatttgattgagctgttttttcttttttcccaagatgaaagagtgcctaggagcgtggttatttttgcccctatatccaatttagcacctctttcaagttaggtttgaagttggaagaattacaacatatttctataaaataatctgtttaatgatatgatgtttcatttcttactaaaacaaaacccttcccattaacttgttcgcttgtccccattttatcatatatgcctagggagaagtctccattaactggtttcttcctgctcctaaactgtatcctctttcttaagcaagttctccacactattagtttgctttcaggttcccctgtgtttgctctctgttcaaaactggtgatgctgtgaattgtagtcagctcaagtgacttccaggtgacttgccttcagcagtggctgctcatttcatgcactgcagaatccctgggtcatgctgacctgttgatgataccagcatcacagactgcacatatcaggcctgctttctatgatgctggttttccaattaactttgtgaaaaggtatatccctgcttatgtcttcctggttatccagctcctcttgcatttgatttcatcttcagcactcgtctgtttgccagttttccatagtagaaagatagattttttttcaaaaacgactcttcccttttagttccattccataggacttctaaaacagatacttgcattgctttcatttccaaaacaaaattatttgataattacaaaaataattctagaaaataattgtcatgttagtttgctatattgaatattttttgggacttctagatttaatgtatcacatttcactaattgaaagaaaattattatcagcaagataaatctgtttgggagtgtttacttatttctttaattttctatttttttattatactttaagttttagggtacatgtgcacattgtgcaggttagttacatatgtatacatgtgccatgctggtgcgctgcacccactaactctagttatatctcccaatgctatccctccccctccccccaccccacaacagtccccataattttctaaattaacatgcccctccataattctgaaatccaaattaaactagtatttctggtacctcaagattccctaaatggagcttcctgggtcagtacgccacttaatctaacttgtgaagaaagacttcagcactcaaactcattctgaccctgtggactttgcttcagctgctccctttggctgtagttctctttctcagagcttcatgtggccagctcttatcactcaagtctcaactcaaaccttactttcttggaaagaccgttttctggccgctgaggtctctgccactatctgtcatagaatttgattttattttttcacatcatgtgtcagtccctggaattatttttgttaacttgtacatctactgtcctccaattagaatgtaagttgagaagaacagagccattgtctgtcaagttcattgctgtatccccagtacatagtatggtggccagcacacagtggtttgataaattcttggtgaatgcatggatataacatttgagaaatgctgcataaaatatcattcaatgggtttctctagagtgagatatattggtacagcattttccaaatatatttgactaagaacatgtatatatgccatgtgccacataatgcagttttgatcaatgactggccacatgtatgaaagtggtctcacaaaattataatggagtaggctatatcatctaggtttgttatgtacaccctatggtgcttgcacaacaaagaaattgcctaaatgacacatttttcaaatgtatccccattgtctcctactattggtctgtatgactgtcattatgtcagtaccatattgttttgattactgtagctttgtaatacatgttgaaatcaggaagtgtgatgtttccagctttgttgttttttcttataattgatttggctatttgtggccttttgtggttccatataaattttagaattgtgttttctatgcctgtaaaaaaacaaacaaacaaacaaacaaacaaaaaactgctattgggattttgatagggattgtagccaagcagcttggcttcaaaaatgcattttaaaactttttttctcctttctcttttctccttaatctcaagatgtaaccttgaagctaactgcagaagcatttccccttaaccttaaaataagacttcatgtccctctctttcccatcattatctaactgtatgctagtatctaattatgtgcttacttaaagttctgggacttaatcttgagacaggcagaccaaacccggaaaccctgcttcaaaatttcagataacctcaaggtagctagtcaacaacttggccattgttgagatgatgccagcccatgctccaggtggaccaagacccaatatagcaaccaaaacaagacacgcagatctagtacttagcgcgactcctgcttgccttccatatcaagtctcccctttttaaatacttagcttcttcctagaaattcaaagtggttactttggatagggaatctggccacttccccattactagttttggttaataaagtcactttctttctaccagatctctctcttgttaattggactctgtaagcagtgagtggccagacctgtgttcagttacaagatgacattgaatctttaggttgctttggatagtatgaacattttaacagtattaatttttccaatttgtgaactgcagcctgtaagttttgatatattgtgttttcatttgtttatattgaggtatttctaatttcctttttgatttcattttgacacaatggttgtttaaaagtgtgttctttaatttccatgtatctatagatttttcagtttttcttttgctattgatttctgtgtcattccattgtggtcagaaaaaatacttggtatgatttctaccttcttaagttggttaggactttttttgtaacctagcatgttacctaccttggagaaaaatttgggggcacttaagaaaaatgtgtattctgccactgctgggtgaaatgctccgtatgtatctgttaggtctgtttgatctataatattattcatgtcctctgtttccttacttatcttccgtattgatgtcctcttcattattgaaagtgtggtatcgaagtttcctactattactgtattgctatctatttcttccttcagttctgttaatgtttgctttacatatctaggtgctctgatgttggatgcatatatatttataattcttatatcttcctgatggattgacctttttaatcattgtatatgtccttctttgtctcttgtgatagtttttgacttagagtatgttttgtctaaggatagccacccatgcattcttttggttaccatttgcttagaatacctttttctagcccttcactttcaccctgtatgtctcactaagtctaaagtgagtttcctgtggagtgcatgtagttgggtattttgtttgttttccattcagctactctatgtctttggattgggaattaattcattaaaattcagtgtaataattgggaaggggaggatttaatattgcggtttcattagttgttttcttttagtcctatagtccttttgtcagtcttttcctttcttactgtcctcgtttatgttttcttgattttttttttttgtattcatatgctttaattcttgttgacatttttagtattataccttttcatgggttttggaattttcgtttgctgactcattttgagtgggatgtttttacattcactttttattacattttttccctttctctgggcttactcttgttttccttgaggttttgtgatcacttttatctggtctgaaagacttccagtccagacccaggttttattatgttctatcagccacccttgccaatggtgatattggggatatcacatactctgttatcaagcgagcaggtggtttgattctgtgcctgggtctgaatcacatctttgtcaacttttccctcacaggcttaaatttttataaaactgcttctcttagtgtgtcgtgttttttgttgttgtagttgtagttttgtttttagcttcttcttattagcccaacctccttgtttggctttacagttaacctggcttaggtctccttatctccagtgagccaattttagattctcttatcctgtaggagcagaatgcccagcagtcagtgctggcttctaaatctggagccttgcaggttccctgacttcagacttactcactgcttgtgattctaatgcgtttctagtccacagagatgtttatctggttcttggaaacaaactataaacatttttatgtttactttttatgtttcatctttaattatcacgtttggaataggaggagttttataatggtgtgaatttgctgaatcatgttgaccagaagtctcaccattacttctgaagcattttaaagcatatttctgtcctaatttcttgtccatagctctgtatgattctgacctttgaagactataataaaggttcatcattttttaatgtacttattgtttatactcatcactgagagaaaataagttacattacacagtagtcgagaataaacttctttaatgggtttatgtgactaaaattgtaaaggtcaggggaattaatgggaaatttgttttaattatgcattgatcacaaaacataatattgttttctttaaggaactgaacttgctggattctgaatcatattttattactaaacagaaacaaataaactcagattgatttattgaccctgctgtatgccaggccttgtgaggaatacatgggaaggaaataaaaaggtctctgtcattagaaaggctggtgtttctcagctgaaggctgaggttggagggtctcctcctcccctctccccagtagaaatctgtgagaatctgaaataggaggctttttaattttcaaactatgcaccctatctccatttcccagccccctaccaccaggggagtgtgtctgttgcccctcaactgcttcagaactactatcagagccacttttaccaagaacatacaccatagcaattggacattatgaaaacaataaaatatgtaattaaattctaaaatgaattaggatgctagatggattgagcatacactggatactaggcaatgcattaggaccttccttacaattgctgttacatcaactctgtggacagatgttaacatccatttttagatacacaaaagagggagcgcagagagctcaagcagcttgctgaggttcctagtaagtggcagaggtggacttcaaatcccggcctgcttgcctctgaaacccagatcttaattactgtgttgtaataagagggagaaagacaaggttaaaatatgtcctactgtattgtggtttactgaaggaatttatggagattaaaattcataaattgttatagagttaaaacagatgaaataatgcttctttgacagaccatttagttttttctttcatctttaaacaacgctgcactaaaatttgtctgtaatggcataaaaaaaaccctgatatttgccttttcttctccattccccatgcttgtcaatcgttacagagattatgctcaaatgtgatatcaggaaatacttttagtccccagcttaagcttctcatttctatgtgaaatatggcagacttttgatgctttctctaaggtcccgttctggatattctccctgtgttcaaggcccttttagggagagagccagtctatggccagtcttgccaactctgtaaatgcaatttacattcttaaaattcgctatcaccaggtcaaaactagcccctggtgcattttgggaagcttcagttcaaacacctgaattcattttcaccaatgctacctggttaccttgtaactccagagttttttagagaggttttgtatatgattgcttgagctatagctttttccctttttgtaagctattattgaaataaaaacgtaacttacctatttcacggtgtatggatgtttttaagtggaataagttcatgctgttttaacttaggttcaccaaacaacatttttagaatattttcacctttctaaataatgtgcttttgattgatactccctctaattcaaactggcagtgcatagtaccctaaaccagtgcccgcataagcagtctgtataaaacatgcttatgcttttcagcttcccaagtgaatctttcctagagagaattgttttttttttgaatgtttgaggtcatcttacaataattatgcataatcagtaatggaaacaatttaaagagtttacactatgtgcccggaatatgatcatgataaacaagtcatctcatttatttcttacaacacactttttaagggtaggttcgtattatcattcccactttacagagagagaaacaaaggttagagagattaagtaacttgctcatgtcaaggtggtagtgagaaattattgaaagcacccattatgccatgtgagtaagcaaaaactggcagattaatttttagcatactcaaataaaaggtcatgcattagaaaaaaagcagtcaaaagtagcttctgccccatctttagtgaagcatacagagggatatgattgaaatagtcctcagctctgggtcaaactctctggcttctattttcaggccctgccacttgggcaaacattccttctctgtggaaaagtagaatgttggccacaatctcctaaagtcattctagctttgatagggtgtgattgtaggagcctgcaaaggaatctagaatcattgtaggtttcctaatgtctgtagctctatgcaattaaaaagattgagtaaatcttgggagctgtcaagaaggttcttacagtttatatataacatacaaaaaaatgtataggatatatcatagttttgcttgctacatctccaaaatctagtggaattcaagaaagtttcagaaggaaccaccaaaatggcatgatgagactattataaggggtatagcaatctttagcctgcaaatagagaaaaaagtcttatttagaaatgtctacaaaattatgattgttatgtatttcatacttaagaaagtaattttagttgagataaaatgaagtactgttttacacagtggatgataattttgtggaactttccatctgtagaatcaaaacataaaaaataaatgtgaaaacaggcaaatgtagaaataacagtccatcatggattatcaaaggacactataaagtatggagttctcccctaaaagctggtattgatagggatcttagttattatgccttcctactgtatgtgccagggttccaatggaagttgtcaatacagcatagctccaattcaggaaggcaaattttaagtcataaaaggttctgtttaggatggcagatttccttaatcattaattttattagtagtataatataatgttaaatttttgttttggttccagttgaagagcagcatgatgataggaatttgcactagaaaacaatactaatatcacaggaaaacattaagagtttcttctctctgaatagtggtcataataagcccatccttccttttcatagaggttgatggtgtctttggagatgatctatctcacggcctcctcagggcaggtgtccattgtttacctggcaggtgttccttgcacctctgcttgaacactgcccatatttggcagcttatcctctggggagtactgttcccttgtgggactgctcaggtttattctttactgagctcaaatctatgtgcatatgctctttctcactggcctgattattccttcagggcaagtctactcttcttgcagatgaagcatctagccccttacagtcttctcttctccagtgtaatatattctgctgctcttcaagcagtgcatttctagacactggaaaatcctgtcagttcttttctgaccactgtctcttttccaaactctttcctcaggtgtcctggacggaaacaaaagggagtaaaaaagtgttggatttatttagaataaaaagggagtattacttcacataatcaacagcattattttatttttatcaatgaaccttaaaatctttaaaaacattttcccatgactgagatactgttagctcaatatgcttgtggccaccacctgagtttcctgattgttgccagacagaccgctatcaactcaccctctcaaagtgcagtgtgtgcttcagatttatccccactgaattatcttgtcagttttaagctattatttgtgcttcaggatattttacaatcttgattatttggtccaacatattaatgattcatcttatatttttatcatcttaaaattcataagaatatctccaaggtattgatggaaatgttaaacaagattgtatcaagggccgagttaagttaagcaatgctaacattcaaaacttaatgagaaatataatttagtaagaatggtactttgatgcttgtatttcctttaatcttgctctaatttatagcctattaaaatatactgtttatgctaataaatacaaattaaattttaaaatacatgtttttgtttgtattgttttttcaaaaaatgcacaattgagaaaaaaagtccacttttctttctttttttttaaggttttccacaggttgtgattattcaacacatggctacaatcgactaatgagatttaactgatttaatgtatgataatataatctaatgacaagtcaaaataattagggggacagggacaacctcatgagtgttgactttaaaaatctaaatccacaacatgacaataatgtcacagtgtccattgatgaagaaagtgaacagtctttttttaatgatgttcttttattttagttgattgcatttagagagaggacaactaaactattcattctcctttgtggtatctattaagttttaaaaattaccttgtctttctgttattttttttatttatttattatactttaagttttagggtacatgtgcacaacatgcaggtttgtcacatatgtatacctgtgccatgttggtgtgctgcacccattaactcgtcatttaacattaggtatatctcctaatgctatccctccccactcccccaaccccacaacaggccccggtgtgtgatgttccccttcctgtgtccaagtgttctcattgttcaattcccacctatgagtgagaacatgcggtgtttggtttttttgtccttgtgatagtttgctgagaatgatggtttccagcttcatccatgtccctacaaaggacatgaactcatcattttttatggctgcatagtattccatgatgtatatgtgccacattttcttaatccagtctatcattgttggacatttgggttggttccaagtctttgatattgtgaatagtgccacaataaacatacatctacatgtgtctttatagcagcatgatttataatcttttgggtatatactcagtaatgggatggctgggtcaaatggtatttctggttctagatccctgaggaatcgccacactgtcttccacaatggttgaactagtttacagtcccaccaacagtgtaaaagtgttcctctttctccacatcctctccagaacctgttgtttcctgactttttaatgatcaccattctaactggtgtgagatggtatctcattgtggttttgatttgcatttctctgatggccagtgatgatgagcattttttcatctgtcttttggctgcataaatgtcttcctttgagaagtgtctgttcatatccttctaccacttgtatggccatactgcccaaggtaatttacagattcaatgccatccccatcaagctaccaatgactttcttcacagaattggaaaaaactactttaaagttcatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagagaaatagaccaatggaacagaacagagccctcagaaacaatgccacatatctacagctatctggtctttgacaaacctgacaaaaacaagacatggggaaaggattccctatttaatgaatggtgctgggaaaactggctagccatgtgcagaaagctgaaactggatcccttccttacaccttatacaaaaattaattcaagatggatgaaagacttaaatgttagacccaaaaccataaaaaccctaggagaaaacctaggcaatactgttcaggacataggcatgggcaaggacttcatgtctaaaacaccaaaagcaatggcaacaaaagccaaaatcgacaaatgggatctaattaaactaaagagcttctgcacagcaaaagaaactaccatcagagtgaacaggcaacctacagaatgggagaaaatttttgcaatctacttatctgacaaagggctaatatccagaatctacaatgaattctgttatgtttttaaaataattattccttatggactttcagtctaagctaatttttatttgttctctccagcaggtctatctttataacattcaagctccccctactccttatccttggagttcacttttatggggacaaaagatgagttttctgtgctttggaaagcatgattatgcttcatgttagctttggaattagaagaaatcattttcggaccattttttttgagttgtgatacacaaacattataaggttaatcagcattttggcttattagtggcccttgattcttaggaaactaagataattctctttttcctgcagatgtgacatttgactatgaatattgaagttaaacttcaattcattgtattgtaaatggaaaagaagagtttttcattttaggtatatatacataatacatatattcttttccttggctctcatcatgtttatattagatacaaaactagttaacatgtctagtctggcatttttcctccaagatatataaattctaataaaaaataagacaagattggggaatggggataatagtattcttttaaacaaggatgcaagaaaatgaaatgtttaatttttgcaacatctcctttctaaaacaaaatatactgatggaaatttggcttgtttcctagagtctcaacacaggagttattaactgcgatgaccgggctaatactatgtgaggtggagtatgataaaaggattaaaagctagaggtactgtgcttggatagcaagctggatgcttgtgcaggcatggagcctttcaaagtaaagttggctccttgacactctgtcctgcagcttgcgctgatttttaagatcattgaaaatcaggtcattgagaagtcttcttttagggatgtctgtaacattctttgactgtcttatgtttaagctagaatttaagcatccaaataaaagttgttctcaggtgtcatcatcataggaagccattcagctaccctaaagttcactaaaaagtcctggaacttgaggtgattgacttctgactccccattgtcagtgtggtccagggacatggcaggcaggagccaactgcttaaggtagaaatgctttgagtaactttcatttaaactgcacagactatcatggctgggtatttttcaaagctacatagggttctggaattttagaaaccattaggggccaagaagaatctgtcagcttatagatctaaatgttcaaaatttaagttaaagcctgtttcttttggtaggaagcaccttgactcccattttttataatgaaagattgatgatatctctattagcctgtttaaactgagccataaaagagtctgtaggaggccaggtacagtggctcatgcctttaatctcagcactttgggaggctgaggcaggcagatcacttgaagtcaggagttccagaccaggccaacatggtgaaaaccggtatctactgagagtacaaaaattagccaggcctggtggcacgtgcctgtaatcccagctactcaggaggatgaggcatgagaatcacttgaacctgggagacagaggttgctgtgagccaagatcacacctctgcactccggcctgggtgactgagtgaaactgtgtctcaaaaaaacaaaaaaaaaaaagtctgtagggtaccaaatgcttttttttttttggagacaggatctggctctgtggtacatactggagtgtagtggtgtgttcatggctcactgtagccacagtcttctggactcaagtatcctcctacctcagtccaccttcccctctccagtagctgggactatagacgtgcaccactacacccggctatttttttttttcaatagagatgagttctcactacattgtacaggctggtcttgaactcctggcctcaattgatcctccctccttgacttcccaaagtgctcagattacatgtgtgagccaccatgctcggccttcttcttttctaaaatcccacccacttagcatgacaaaggcctgggacataatggtaagtgaatagttgtaaggaatgagaagttttagctgtgcactgtaccatgcttggatttgattatgggaaagatgatcaatattaacatagaagttacctaaactctctgtgtcttttcccttacctcaggaagttcaaatacaatgttgtaattcagctcttctactcttcctgtcctctcaaatgagacaacttatactgtggttgctgaggctaaatagaggaggaattcaaatacatggttcttctacttaagatcatctccagttgcatcaaatcatgacttctggatgcaacccagttgcctccatttcatgagaatggtttccttccatagacattctctgctgttcccctatcattgtcaaatcaatgtttaatcaattccagccatttcttgcaaatccactgcaatcacattttataaatctacctagtgcttggttttcatgcgccgcagataaattaggtccttcttgttttatcctgagctatcagtctagtaacatgctcacagcatgcaaccaggaataggcatgatctcctttttgtgagtctaatctgagtgtcctttacaagtaagaggggatagtctgagagtggaaacagctcttttcaggaccagctgggtgatccatgagcatttgaacagatggcccatttttgtgggaaaggattctgtatcctacaagctaacacccaacagcttcactgaaaaaaaaaaaaaaagcttgaagataagaaatcaattcaagaggaacccacatgtttgctgtgttgcctctgaacacaccctgtatgtcaagagcttagctttattctgtagaccacctagtcagaatcattggggaggaaaatatttgttcaaacatagtcccttttgtctgtgctgggcaatagcacaatacattcagcaaccaccctctgaaagccaaggctttgtctccagtggggattatgaaaacatggatttcttgagaagtgcctgcccacctgtgtttagattttaaattttaggaagatgcttgacagccagaaaagaggtgctcagggaaaagtctgttgagattatagagactttttgaaagaccattacctcctttaaaatgattagaatagaagaggaattcttgaaaactggcatggaatatcgtattagatggaaccttggaaggttttatttatcccttctcttttagctttctgtctaaggcctcagattgtagtctattttagaaaatctccaaggcaggaaatttttcataacctttcccctgttagtcattttttttaacttcaacaaaagcctgcatcagaagcttcttgctcgcttatatgaccctaacgctcactgctgcagtccaagcctggcttcctttgcactttcttttgctgttcatattcttcacagtgggacctgtcttagctgaagcccattattaggtcactccttggcctcttctctaaggctaaataatgagttatttttttttctccttttttggtacatcatattttttcaaccatttaatgatttttgttgttgaaaatttggggatttcctgtgtctggaaatgcattaggcctcaaactttgtacccctaagacttttcctgctaccttttaaaagacaccaagtaaaattaagactaggagaagacagctgctgcaatttttaaaaaatcacaaaagcaaaaaaaaaaaaaaaaaaaccaaaaacaccgagtagctgtctttctggtttttgattgagcaagatatttgtaaaatgaagcatactttattgtcagatgggcctgttgtttactgacaattgaccaacatgaatgtggtcaggtttagatgaatatctatacaactcacataatttttaatgaagggagttaaaagctaagcatgccaagaaaataagtatgactcaaaagtggccctttcttagtatattggatgtattatggcttctagttaccaagggcctttgaagatgactgggccattattttaatactttttaatatgcttctggattcaattattgcagatttttacaattatatttgatctctagttagtttataaggaggacactatctttgtcaggttttaatatcaagattgtgatagctttgtaagtaaatgtagatattttctatactttttctttgctttagaacagttgaaatagaacaagatcaatctgacatctaatgtttggttgaactcacttgtaaaactgtctgagccccttgacttccaaaggtaggtttttgataattcttgctatagtttaacatatcacacatatggaagactttatttatctatgttcaatctagagaatagtaatggaaggattacacatgttctcaccactgagttgcagaaacagaacactatcagtgtctttgaaggtcactgtgttcccgtacctgatcacctcctcctctctgccctaacccccatttgacataaacacaatgctaactttggtataccattgctttgcttttcttcatagttataccatctttgtatatattattactgaagattatattatttagtttagttgaaatttatattatagaatcataatcttctacttcttttgtcttttttgggtttttgttttttgttgcctatttttgttttgagattcatttatatttaataatgcatcactaggtcattttcagttcactttactactttgtaatagtccattgtatgactattccacaatgtatcgattctactgatgatggacatttgtgtgttttcagtttgagaacttctgaatgtgtctgtatgaccgttttggtccatgtctcctggtattagaattcctctaatgtttacaccaagagtggaattgttggattgtggaatgcccatatgttcaactttataaggatatgtccaattgttttcccttaattattttaacaattttctgcttctaccaggagtggataagaattcctattgctcagcctccttgccaagatctcatttgtgtgattttaaattttttgccagatagttgtaaagtggtatcttattaaggatttaatttacatttacatttccctgattggtaatgaaattggtcaccttttcaaatgcttgctgtcattcataatttcttttctgtgaaatgcctctttatgtgttttgcctatttgctttttgggttgcttggcttttttattgatttgtaagaattctttacccattttgaatataaatcattttgagttatatatattgtaaatgtcttcttctaatttctagcaactcctctcattctatgatttctcttgatgaacataaagccttcattttatgatagttaaatttatacatctactattcatgctttgaatttttattctatttttaaaatctccacactgaagatataaagatatttttctctgttgcacttaaaactatcattatattgtgtttatttattttccatcttcccaccagaatctaaattcaattaaggctagaatatttgcttgttttactcatttcggtatctctagcacatagtgggaactcaataaaaattgttgaaggaaaccatgactgaatgccagagagggtgaaatgttcttcagtatcttgcattagctcattttcctaagaatgcacatcctctgaggctatttcctctccctagtcctgccatatttttcatatgtctcattttcatctcataatcaggtggatccatttggactcagtgtcttcatatgcaccagtaacagaggggcttgtcctcaggctgctgtctgcacatctttgatttcgtccatctccactctcagacctacagctggcctgcaggtggatgtatgccgttgtcattctggttccttctcctagcaggctttcatccagtgcatttctgttcgactgcggtgtattcttcccctattcccaaggccctcattcccaaggtagtcagggctaatttagtctgcctcgcaaataacaaaccctacatttcaaagaactagagttcccattctgcctttctagttgttttgttacagctgctactgctgttgttgttttcagagtaactttttactctatactgcatttggaaaagatgatggtgaaaaggaagttgggggaaaggaattggtcagtgccttgagtgcctcaggatgcagaacacaaggggtagatgggcaggtgcccacttctctgttgattctaggccatgcttttgctcaaaggaatccagatctggcaacagaggcagtgaagggactgtgcattttcctagcatttatcaggtgatatttttcatgaaactgcagtttactgcatttctgggtagtctgtttttgtttgtttgtctaactcagatccaagtttattataactaatgttcttttatgcctgaccctgacataagggagattttcagtagccttgtgcattggtatatttttctgggttatcttttgtgaggtaacattaaggaatgctagccacattccattttgagtgaaacctcctgcactgctattttctaagtgtatgcagaagctcatatatttggaaaattcaagttcattcaaattgctactgaattagaagtatctttttgtcattacctagttttaaatcaatagatattaaaattactactactatttcattgttgccccagtttttttttctgatttaaaaaaatatactaaaacaagctctcataatccagagaatatgtaatcattcttctatagcactataccaaagaccttatcctatgggatatcgcttagtttcctatcattcaaaaaccatctttccaattttttaactaccagtttaagtaacagtaagtagattacagaatggagaaaacataaagaagtatgatcgtaaacaacttcaatttttctgaaagaaatctgaaggataaaataatagcttccttgacttagttgttcctatatattatctgagaaaaagtttattgaagcacatttttacacttttaatccactggaacgtcactgagaaaatgttctgagagtcataagaatgttgactaattgggctgtttgtcccacatgggattacaccactactttctgaatcagaagttcctgctattgcaacatgaattattctttattttttatttttccctcttagaaacaatccatttgggttcattacatagccatttgttagtttgggggattgtgcttgtttgtaactacaatgaagtcatactagactgggtccgtatgtaagtcagtgggagatcgtgcagctgctcagtgaatcattcagtgcaaagggtcaccctaatattttaaccccaaagtcctgctttcccaaagtcatgggtaatttttattttaatcatcaagaagattggttcaactttggtttacttagtacatgttgcacatacatatcaatctgtaaaacttctaaaaaaattatattgaagtataatattctcagagaaagtgcacgaatcctaagtgtatatggtgaacttttacaaactgagtacacctgtgtaactgctacccagatcagaaaacagaacatgaccagcaccccaaaaggtttcctctaccccctttttgtcacaaaccctcctcaccaagagtaatcactctcctgttttgcgtgtttttatactttatataaatggatttatacatcatgtgttattttgtatctggcttctttcattcttcattatgtttatgagactcatacaattttatcatgaattgtgttttttcattttccatttctatattattgctatggagtgtcctattgataaatacaacacagtttattcattctattgtcagcagacatttcatgagttttctttctttttttttttttagaagggttaggcctattatgaatactctgttatgaacattccagtacatcttttttggttaaagtatacacacacacacacacacacacacacacacacacacacacacacatcctgttggatatataacgaggagtagcattgctgggtcatagttttgtgtatgttcagatttaatagataagccagtttttccaggtggttgaatgtacttacactagcaatgtacaagagttccagttgctctacctcctcaccaatatttggcatattttgtctttttcattttagccatctggttcaatatgtattgaatgtggtttaatttatatttccctaatgataatgaagctgagtatcgtttttatgattattagtaatttgcatatctttctttgtgaattgtctgttcatatacatatatatatatgctgaatattttctgtttttccgtgggttaccttttcactctcttagtggggtcttttgatgactagctttcctagtttaaaaaaaaacactctcacatattaaagatcttagtaaatatttagaaaattgttaaccaatgtgtgaggatctcagtagtgacatgtttaactcaaaatgtaatttattatttttttcttttatggcttataatttttgtgtccagtttaagatatctttgcctactccaaattggtgaagttattctatgccttcctctaaaatctgtgtttagatatgtaattcatctgactacatatttgtatgttttataatgatcaagatacattttttttcaaaccaatattctatataccccagcatcactttacttggtttataacttgtttgaaatgtgtccacaaaatttagtttcagtgaatttttaaatattttcttataattactaatatttcctaagaagaattttaaacctgtgatgatttcaaatgtgtaatataatttctagatttatttaatactaatgtcagttgaaatttcccttaaaagttctcctgttcaattggatctagttttgaaatccagctatttatttattcaacatcaatctataatgcataaaacaattttttaaataaattattgttctcattttctcatttaaatcaattcaacacatgtttattacgtttcttctagaatttgggacagttacgaatgtggttgaagtttcaagcttcatttttatatcctttaggttttaagccatataataaatttatcaaatatctgtcagtaataagccaatttcttttctttttttttttttttttttgagatggagtcttgctctgccaccccggagtgcagtggcgcaatctcagctcactgcaagctccacctcccgagttcacaccattctcctgcctcagcctcccaagtagctgggactacaggcgcctgccaccacacccagctaattttttgtatttttagtagagacagggtttcaccgtgttaaccaggatggtcttgatctcctgacctcgtgatccacccgcctcggcctcccaaagtgctgggattagaggcgtgagccaccgcacccggccaagccaatttctttagtagtcaaaattatattaataaagaaaggtacaaagtgaggatttttattactattaggatagacttagaccccttatacaattcctcaataccaagttttccactaataatgacacatatctttaaagacataaaaataggaaagaaaatataaaagtttcatttttatattttgaatacctataaatgtttactctttgatgtcatttttgcttagttttattttttaactttttattatttgttctaggttgtactggtcagtggacatctggacagctgggatgttgggcagggtgccatggatgatggcggtggagcctttatatcatgggaagcactctcacttattaaagatcttggtaaatatttagaaaattgttaactaatgtgtgaggatctcagtgacatgtttaactcaaaacacaaaatacttaacagattagttactatggtatgttcaaagatcctcttgaggtcagttgattcccagaaaagaaacaacttatgctcttaaagaaatttttattcatgtgtacgccagacatctaaagtgtcaaatgttattatcagccactggggaaaatgaacaagcaaataaaactgaagcaaatgtaaccacaccagctaaagaatatgcaaggaaaatatgatgaaatgcaaagaaaaatcagcagcacctcctacttcctttcccttattcatcttaacacattatcagactattaggacaatggataaaggctggtcgtctttccatcatagaaataaaagagtaacctagatagaaagaatgatttccatagccacaataaggaatccaggcagataattctttgttgcaaggtctgtcccatgcatgataggatgttttgcagcatccctgacctcttcccactagaagccagtagcaccctcccctaacctcaagttatgataacaaaaatgtctccagacattgccagatgtcccctggggggccagggaagcagttgccccattttgagaaccactaatataaactaataaaaatatctaggtaacctgaatacagggtcattttgttaaagaaaacaaactaattggaaatcttacattgtatatacacttttaccataattaccatacatgacagaaaatattttgaccacctactttgctttttataaagcactttgtaaaagctgggcatataggtttaaaggatgtcccctgttcttaagactcttagaatggagtgggtaaccttcacacatacatacacacatagttatcaatatagacataatttcaacatctaattttagaattggggaaggtttgagagagaagttatccagcaaataaaactgaaaatcacacattccttcacagaaaatctgggagacgctatgttaattctctcctcctcttctcttaaaaatattcccttggctatctcttctttctgtttctcatatcattccagaaagaagtgggttctagaggaaagcaggaaaaagtcgaacatttttcctcttcaaaaatcaccgataatgattttggacattaattttatttcagtatgttcaatcagcttgattggaagcacagtggtggagtaaaaagagaaattttctttagacccatttgaattggactttaggtcactttactatattttggtccttaagcaagtcatttgaatgctctggacttcatttttctcatctctattaaactgtaagcttcagagtatttcatttgctctagattggaataaaaattgtatcttctttaagctttgaatcttacttcttcggtattcagcatgggaccctaaatcactgttaattgaattgaattcagttgcatggacaaatgttaaataccatgcaaaagtgaattgagtatcttttaccagttctcaaagtacatcgacttcagttgcttttgatagctagtgaccagtctctttaatttgggacttaaatctccaaaagatttctgaaagtctatgtaaagatatgaatagaactctaaaataaagagtaatatttcttttgagtaggcattatgaggcaccatagtatactgttaaaaacataggattctggagccagactgccagggttcaaatctcagctctgcagtctgctaggtgtgtggccttaggcaagttactttgcctctctgtgcctcaattttctcatctgtgaaatgggataataatagttcctatctcataaagttgctttgaaaattaaataagcagagtatacttagaacatgggctggcccaacccaagttatcaataaatgttaacttttataacttaacttaataagcatgattctgacagtaccatttttttaatataagagaagatgataatttagtttacctccatccccattagtgattgctttgcctcctaacttttagtatattagctatactaatgtaactttagggccagttgctatgtatccctaaaatatcctttccctttactacttaagtcaccatcccttgtatgatagaaacccagtgacccctccactttttttcatttcacactaaatttttagaagtcttaaatttctcctggttacttctatatcctgcttatgtttaatgcccagtatctactctgcacctcactttccatgattgcacccattgagtcttactctttaattttgaaattgtggatttctatttgtagattgcctatgtattttaacatgaagagctaggttcagcatgtgatgtgtatgaattctggatgaaaattgctgatatacttgaactagaaatatgcccttgggcttgaggccaagaaataggttcataattatattacttaattacatggaatccaatctgtttaattggtaaaatgtgaaagctctgtggcaatctctttttccaagaaaaatgagactccttttggatgctattccttggatgatgtgtcatgcagcatgtcagagtccctcagtggagcgtgttaacttgaagagctggtccagtggggatctctgatatttggaaatatttttctaagattcatccttctggtatcttcttctttgtcttcccctctcaccactcttatagattcacttttttgctcaagccttcagcttaaattatattcaattaatctaacagaagagttatttgtgctttgtaaatataatcagtctttcccgagtaactgtctacagaaggctgtttgctgtgaagcgtcgttgaatacttttctgtgtctgtggtttactggacttgaaactgtttatttgaaatgttattttctggaatgttctggtgtcagtggacaaagcctatggccaatgatgctccaaaatgctcatttggcacttagaaaataaactaccatccatcccaaattcttccaactgtatcattttctatgaagttagaattttgagtttccaggtctaaagaaatgaaagatatgagaattaacagtattacctggttgttggaatgtggaatatataagaaacatttttccagaaaaaatgtaaatgttgagcctcctgactgtgattactatagagcttgaaagtctatgtcttagaaaaatattttattggtatgtttcttcattcattcactcaacaaatacttgtgcattgactgctggttcatgtatcagatgccttgcactaaagaggaaagagaaatggccctttaagtccttgaagtaggagagacatttaattcaaaaattgcaatgaaattgtggtaagttctctgaatgtaggatgtacaaattactttgggcacctggtaaagaaacagaccaacatggcttggctgggtcagagcaacttcactaagatgttatttgaactttctttcataaagataaatagaaattcctgagatgaacagtgcagaatgaagtattcccagcagagtacagagcttccagttctgtgtgtcattaaaaatgagaagaaaattgttgacagtagcagtcttgggattatagggggagacaggagttgtggaattacaggagaggttcactttttacctgatatatttgtataatgttagatttttgtgtaataagtatgtgttacttcagtaatcaagaaaaagctatcaaatactcctctacccctactcccaaaaaagaaattaaaaagaaaagaaagagttttggtattgtcattatcataaacaccctgttaacagaaacaacacagcagaggtaaggagttggaagagttgtccaggagtcaccaagcctccctggcccagaatacaaccatgaagacagccaaaggcatgccagggctttgatgcaagttccactgtagctagagccttatgcagccatttccaatgcagtgggttctctcttagaaatggggacccatctgggaagaaggttttcttccctaaggctctggtcaagactgtcttggaaaagccccaggaaatgtaattcagagtaacagagaagaaaatgaacagcctccagtgaaatggaagcctaaagggtagagctagagatggctggtgtcctgaaacgaatctgggactagcccagacctacaaaagatatctcctttggaaaggacctccccactgggtttagccataccgctgggtataataaaaatattgagagctagcattgactgaagattactattgtaagcattgtgctaagcactccactgagtacatattctcctttattcctgaaaataaacccaagcagtaggtaactcgtgttatattcattttacagaagaggaaaccaaagcagagaaaagctaagtaccttgcccaagatcaccagctattatgtgaaaaatttaaatctaggcagcctgacgccatgcccaacactcttttttttttttttttgagacggagtctcgctctgtcgcccaggctggagtgcagtggtgcgatctcggctcactgcaagctccgcctcccgggttcacgccattctcctgcctcagcctcacgagtagctgggactacaggcgcccgctaccacgcccggctaattttttgtatttttagtagagacggggtttcaccgtgttagccaggatggtctctatctcctgacctcgtgatccgcccgcctcggcctcccaaagtgctgggattacaggcgtgagccaccgcgcccggccactcttaagtactttataatattgttttaatggaaaaacactgccagtctgtttctaggaacactcatcctcaggataaaaagagatattataaagaaaggggggaaaagtgtcctatggtcagataagtttgggaactccctcttggtaatttctttatttgtaaataacatttgttgggagagtattcactccgtgggtatagcgtactttggaacacaatgccctgcggcattttttgaggtggcagaactgagtaaggatacaagaatccttacacagatgcacttctggaagtgagtacaaatagccttggatttgttttcattctagattttctaggctacctttgggagcctgagattgccagaatattgacaagctagaaccatatgatgattccttaattggcatgatagagcctattgttgtgtctctccctgaagaacatttgtatccacccaagtgcaaactctagctgacaactaactttttatccacactatctgagtctattttttcaaaatgaacgtagtattattggaaatatttgaaatatgctaatgactctatcaggtttttcatggccccagatgaatcagaatttgtaagatttttattttctagaaggaatttttattttaaaacattccatgaactctccctattgccatgttggatacgctttctgcacaattatttgggaacaaaggaagggagactaatggccctgggaaaggtatcctattaaaatcactggtcctcaatatgtttagtgaataatacatctgcttgtgaagctgtccagtctgaagctgtgttttaagtcttaaatatttcccccaacattaaattttatttttattaatttaaatgttaatgcgtagatgctgcttgcttctttggttctgaattttggtcttgatgttttataattgcacttatcgatgaaagtacctaaaccagtagaagaattagaaacttgaagaaattgtgaagaaggattaaaatggcagataggaggcaggactagtttgcagctcccattcgaacagacagagcagtgtttggagactcacatagtgaacttttgctctaagaactacctcaagaacatatcaggaaagccaagagaatccacagaccctttgaaggaactggatcaccactgcaggcttcctgagatgccaaaaaaaactatgagtctgtttgctttctcaaaggagaggctcttggtctggggcaagttctcagccctagttacctgttgcctggaaatagattcagtgctgttatgggggcactgtgggagtgagaccggccttcaggattgcaggctgcatgggagcagggtaaggcctgtgactgccagctttcctccacctccctggcaacttgtatgactcagtagagacagccataatccccctgggaatataactccattggactgggatccacaccctcatagcccacagcagctgcagcaagccctgccaaaggagaggctgaactcagacatgcttaccccttcccccacctggtagtctttctctacctgccctggtagccaaagacaaaggtcataatcttttgggagctctatggccctacctatcacctgagaaaccacttaaccaagtgttcctagggcaactaggaacacagctgatacactcttgtcagtgccacctcctggctggaggccaaccaacacaaaaccaacactctaaacaaaaacacaaccaaggaccctcgcagagacgacttcactcccctgctaattccatcagagcaggtgctggcatccatggctgcaagacctgaagacagatcacatcacaggactctttgcagacactctccagtaccagcctgaagcccagtagctcctctgggtggctagacccagaagagcaaaaacaatcactacagttcagctctcaggaagccccattcctaggggaagggaaagaacatcacatcaagggagcatcccgtgggacaaaagaatctgattagcagccctgaatcccagaccttccctctgacctagtctacccaaatgagaaggaaccagaaaaacatctgggtaatatgagaaaacaagtttcttttacatcccccaaaagatgataccagttcaccagcaatggatccaaaccaagatgaaatctccaaattgccagaaatagaattcagaaagttgattattaagttaatcaaggaggcaccagagaaaggtgaagtccaactaaaagaaataaaaattatgggatatgaaacaaaaagtcttcagtgaaatagacagcataaatgtaaaacaatcacaacttctagaaggcaagaaatgcaaaatgcactggaaagtctcagcaatggaatggaacaagcagaagaaagaaattcagagttcaaagacaaggctttcaaattaacctaatctgtcaaagacaaagaaaaaagaatgaaaaaattgaacaaagcctccaagaagtttgggattatgttaaacatccaaacctaaaaataatcggcgttctcaaggaagaagagaaatctaaaagtctgaaaaacatatttgttagaatcatcaaggaaaacttccctggccttcctagagatctagacatccaaatacaagaaactcaaagaactcctgggaaattcattgccaaaagatcatcacctaggcacatagtcatcaggttaactaaagtcaagataaaggaaggaatcttaagagctctgaggcaaaagcatcaggtaacctataaagggaaaaccccatcagattaacagcagatttctcagcagaaaccctaccagctagatgggattggggtcctctttttagcctccttaaacaaaacaattatcagccaagaattttgtatccagcaaaactaagcttcataaatgaaggaaagatagtcttttccagacaaacaaatgctgagagaattcaccactaccgagccagtactacaaaaactgctaaaaggagctctaaatcttgaaacaaatccttgaaatataccaaaatagaatctccttaaagcataaatctcacagaaactacagaacaataacacagtggaaaaaaaggtaatcaggcaacaaatagcatgatgaataaaatagtacctcacatgtcaatactaacattgattgtaaatggcctaaattctccacttaaaagataacagaatgacagaatggataagaatgcaccaaccaagtttctgctgtcttcaggagactactctcacacataaggactcacgtaaacttaagatgaaggggtggaaaaagatactccatgcaaatggacaccaaaagcgagcaggtgtagctattcttataccagaaaaaacaaactttaaatcaacagcagtttaaaaagatgaagagagacattatataatgataaaaggactagtccaacaggaaaatatcacaattctaaatatatatgcacctaacactggagatcccaaatttatgaaacaattactattagacctaagtagtgagatagacagcaacacaataatatgggggactttaatacaccactgatagcactaaacaggtcatcaagacagaaagtcaacaaagaaaaactctacctaaatgataccctacaagtgaacttaacagatatttacatgacattctacccagcaactgcagaatatacattctattcatcagcacatggaacattctcctagaccatatgataggccacaaaacaagtctcagtaaatttaagaaaatcaaaattatatctagtactttctcagaccacagtggaataaaattcgaaatcaactccaagaggaacccttaaaaccatgtaaatacatggaaattaaataatctgttcttgaatgatcattgggtcaacaatgaaatcaagatggaaatttaaaaattttttgaactgaataataatagtgacgcagcctatcaaaacctctgggatacagcaaaactggtgctaagaggaaagttcatagcattaaatgcctaaaccaaaaatctgaaagagaaccaatagacaacctaaggtcatgcctcatggagctggagaaacaagaacaatcgaaacccaaacccagcagaagaaaatgacgaagatcagagcagaactaaatgaaatttaaaaagaaaaaagataaatgaaacaaaagctggttctttgaaaagataaatgaaacagatagaccaacgagattaaccaagaaaagaagagagaagatacaaatatgctcaattagaaatgaaatgggagatattacaactggtaccacagaaatacaaaagattattcaaggatactgtgaacacctttacacacataaactagaaaatctagaggagatggatatattgaaagtatacaatcctcctagattaaaccaagaagatacagaatctctgaacaggcagtgagattgaaatggtaattaaaaaaaattccaaacaaaaaaattccaggaccagatagattcatggctgaattctatcagatgttcaaaaaagaactggtaccaattctactatttcaaaggataaggaaatagagaatcatccctaactcattctatgaagccagtatcaccctaataccaaaaccaagggaggacataacaaaaaaaaaagagagagagagagaaaactacagaccaatatccctgatgaacgtagatgctaaaatcctcaacaaaatactagcaaactgaatccaacagcatatcaaaaagatacttcaccatgatcaagtgggtttcatactagggatgcagggttgatttaagagacataagtcaataaatatgatacatcacataaacagaattaaaaacaaaaatcacatgatcatcttaatagatgcagaagaagcatttgacaaaatccagcatcgctttatgattaaaaccctgagcaaaattggcatagaagggacataccttgaggtaataatagccatctacaacaaacagataacattatactgaatagggaaagttgaaagcattccccctgagaactggaacaagacaaggattcccattttcaccacttctattcaacatagaattggaagtcctagctagagtcatcagacaagaaaaagatatcaagtgcatcccaatcagtaaagaggaagtcaaactgtcactgtttgctgatgatatgattgtatatgtagaaaaccctaaagactcatccaaaaagctcctaaaactagcaaatgaattcagcaaaggttcaggatacaaaattaatgtacacaaatcactagctcttctatataccaacagcaaccaagctgagaatcaaattaagaactcaacccctttcacaatagctgacaaaaaaaaaaaaaaaaaaaaaaaaaccttaggattatacctaaccaaggacgtgaaagacctctacgagtaaaactaaaaagctctgctgaaagaaatcatagatgacacaagcaaatggaaacacatcccatgctcatggatgggtagcatcaatattatgaaaatgaccatactgccaaaagcaatctacaaattcattgcaattcccatcaaaataccaccatcattcttcaagaagtagaaaaaacatcctaaaattaatatggaaccaaaaaagagcccgcatagccaaagcaagaccaagcaaaaagaacaaatctggaagcatcacattaccctacttcaaactaaactataaggccttagacaccaaaacagcatggtactggtataaaaataggcatatagaccaatggaagagaagaaagaacccagaaataaagccaaatacttacagccaactgatctttgacaaagcaaacaaaaacataaagtggagaaaagacgcctattcaataaatggtgctgggataattggcaagccacatgtaggagaatgaaactggatcctcatctcttaccttacataaaaattaactcaagatggaacaaaaacttaaatctaagacctgaaaccacacagattctagaagataaaattggaaaaagtcttctagacattggcttaggcaaagacttcatgaccaggaacccaaaagcaaatgcaacaaaaacaaagatagacatatgggactcaattaaactaaaaagcttctgcacaacaaaagaaatcatcagcagagttaacagataaccacagagtgggagaaaatctttacaatctatacatcttacaaaggactaatatccagaatctaagaactcaaataagcaagagaataacaaataatcccatcaaaaaagggctaaggacatgaatagacaattctcaaaagaagatatacaaatggccaacaagcgtatggaagaatgctcaacatcactaataatgagggaaatgcaaatcaaaaacacaatgcaataccacctcacacctgcaagaatatccgtaatcaaaaaaaaaaaaaaatagatgttggcagggatgcagtaaaaagggaacacttttacactgatggtgggaatgtaaactggtacaagcactgcggaaaacagtgtggataatctttaaagaactgaaagcagatctacatttaatccagccatctcactactaggtatctacccagaggaaaagaagtcagtatatgaaaaagatgcttgcccactcatgtttatagcagcatgatttgcaattgcaaaaccatggaagcagcccaaatgaccatcaatcaatgatgggtatatatatatcatggaatattactcagccacaaaaaggaacaaaataatggcattcacagcaacctggatgtaattgcagaccatcattctaaatgaattaactcaggaatggaaaatcaaacatcgtatgttctcatccacatgtgggagctaagctatgaggatgcaaatgcataagaatgatacattggactttggggactcaagggaaaggatgggggacagcaaaggataaaagactgcacattgggtgcagtgtatacttctcagttgatgagtgcaccagaatctcagaaattaccactaaataacttactcatgtaaccaaacaccacctgttccccaaaaacctattgaaataaaaaaaaattttttaaaagaatttgttcctttcctttttttaattacatgtaaaactaggtttatggccatggggcatctgtgactcctcctctttttctttagagatgatcttctcattttttattctgatatgttatttcctctagcggcaacttatgttagtgaatggcttttctgtaagacccatggcagatacatatttttttttctgctgggaattgctgagagcttttcctaaggtttgaacacatttagaagcttcactaacacactcaacaaccttatgtctcatcagtttacatagacatttctactaggatgtgtaaaaagacaaattgtgtgtaaattgatttgcaaaatacatctgtgagataaagcaagatttgtttacaatgagtcacttagaatgtggtctaccttttagtctggatttggtatgagagattccatagtcattttagagccttaggctacatgaatattgctgttgttattgtatcatttagttagaatatacaatttctgtgcaaaagtagacaccacccagggtatacagcataataatgaccagttcttttctatctgacagtctggaagggtggcagatgaatgctatgagagggcccccttttctacagcatgcttagcttcctccccgatgtatgctttgatttggccttagaaagtgaaggcatgtggttgtaaaggaagcggaagcttaagaaattggtatcatttatcctggagaataagggccatagaaaatcttactaatggtatccttagtgccccagtggatttcctcccacccaagaatggaatacatacaaatccatggtagggctgtctggaaaacctaggctaccttattgcaatggtatcatcactgtatcacacacttggctcacaaggagacgtcttatttcaataagaagctttgactgcccacttcatgtcaggcaaataatatggacaggacacagttccttgcgtcaaggagctcatagtcaggcaacaatggcttcacatggatagaggcatttaaaccaggccttgaaaagttaggaagtggtaaaaaaaaaaaagaacaaattagaactcatgaaagtacatagtttgaggagtagaagatgtcttcataaatctagagtaatgggtgagtgaggagggggtgggaaacgagtaaagtgaaggatgagagtttgtgaagggtactggatgcaaagctaaaggttggagttggtgctataggcagcaggcaccactgaggattttaagcatgataggacttctttctaaaatagggatatcacattgactattttaactgctaaagtactatgataaatagaatagagatacagaaaaacagagtagggagatcccagttatactgagcctagagaactacagctttggagttgcttagcaaattttatttgctgtggtggatgagccagcttctacttctctatgttaaatataccaaagaggaagtgatggggtttccagggatgctgtgttcttcgcctacacgcttctctgcatcatgctaatgctgcattttgcaaaagctgtggtttacccagcttccaatgaattttgttccagtaaacttgcctaaaaacagaagtctgcaaaaaataagaaaatatgctatgaacatctgatcggacctttatggttaactgggtttttttaattgccgtggaacgtaagggtttagttagtctattcttaggctcctcgactcctgcaaacattctcaaaaataagcactaggaaaagaacgtttctactgggtatgtgacaggataaagaaagtattgagggaagttgattattataagagtacttatttataatcctgctcgtgccctcctcatattagataatcattatcgatgagctgatgcttggcccatgtgcttgcctgacactagcattttcagactacatgtgacccagatctcactgatttttcaacctttaagtcctcctttcttaatccttaaataattcaaaatctctaggtaagtgagaggcagcatggatagtagaataagcatgtgctctatgttagaacatcttggattccaatccttctgtgctatctagtagttgtattttcctggacaaattatttaacattctatcattatatatagattttgaaacagagtctcgctctgttgcccaggctggagtgcagtggcacaatcttggctcactgcaacctccgcctcctgggttcaagtgattcttgtacctcagcctccagagtagctgggatttcaggcacacaccactatgcccaactaatttttgtatttttggtagagacggggtttcaccctgttggccaggctggtctcaaactcctggtctcaagtgatctgcccacctcggcctcccaaagtgctgggattacaggcattagccaccgtgcccagcctaaattatttaacattttaaatctcagttttctctttttacaatgggaacaatttatcttcagttcttgataggataatttgaaataatatacacagtaactggcccctgctaagccatcaataatagtaactattattatcagattctaattgccaaaacagcaggttggatgttccaggagaggttataatcccagtatcaactctcagctctcgagtcttcatgtctgtatcccattgcaaagttcagcttggtcaggggaatcctcacagtgaggaggccctcataataaagcccacatgtgagtttggcctggataagttaactcacaaaccttcaccccagtgtagccaccatccatgagtatacatgaggctagtgtataaggctaattctctcctcactgttgtagtgaagagcacttaatagatgtgtcataaatgttatgcagacttaacactctgaggacatggggatgcacagatcatttttcccatcccttttgctctctctgtgatgtccttaacctaaataacagtgtgtagagaaaaatttataatattcctgaggaaaagaatagtagaaacagtaaatagctgttaaggtcaatataatttactacaaaataagttgtttgagatacagaaaaaaatcaaggcagagaaaacacaaccaaatctagtgcttactatttacaatttaccctggggcctgaattttcaagaaatctttctgttttttaatatagtcacaacaccacaatttttaagcattttcagaagatcctcatgcataaaaaaccaaggatggtgaccactgatgcttgtattattttcctttctctgaaataatggcatcttttaaaaggaatatatttaaaatgtaattgaaattattgagttgttgctctgattaatgtatgtgggaaaatagaagtcaggaaatgtttcaaaagctatatttctgttctcatcgccaatcaccatagaccctagatccatttagccatcccatattcacttgttttaggcaggatgttagaataaagaaatattttatgaagtgcttcatactggaatttactccttttctgaaagagggaagtgtgaatttatcttttatagtgaaataattttacctgaagtcatttcaatgtcatttttggtcataaatgaagagtttggtagaggaatctttgaactaattacctttctgaaaccttacagtattttgttgcaaaaaacaatggttaaacttataaagcagaggtttttggtaaagatgcaaaacatctacctaagaaagccccatgtcctatattttcatttttataatctataaacattaattgaacacctgggagaatggaggagagaaccaatatttacctcctatgtgacagttacttaccatgatctttttaaatcctcaaagccgccctgtaaggcatgtattattaccactggcaggtcattgggcctgtctgggactcagttccttatcagtaaactagatggtaacatgcttgcaggactgttatatggatcaaacataatctaggaaaaacacatgtctattagagttgcaaagatggaaaatacatggcacatgatgttaaagaaaactgtagtggcagtgctgctactaatggtgatcatctcatggcttgaattgaaacagagcactttggtggagcagtgatgtgggatatagagtgacaaggcaatgttcatagtggttgtgataaggaagaacttcaataatgtcctacagcgttttataacagaagcatcattttactaatcacaaatatataacatttcccgatttttttaaataaaagaattggcagtgaatactcttgctttaggacttaaatgaagtagagtcaaataagatttctcatccaggtcttttattttttttctttgatatggagtcttgtctcccaggctacagtgcaatggcacatcagctcactgctgcctcaaattccctggctcaaatgatcctcccacctcggcctcctgagtagctgggactacaggcatgcaccaccatacccggctaattattaaaattcttttttatagagacagggtctcactgtgttgcccaggctggcctcaaactcctggactcaagcaaccttcctgccttgacctcccaaagtgctgggattacaggtgtgagctactgtacctggcctcatcccagtcttcttaaattgatgtgaagatggtagtagattatttcagattttaggatgaactaataatagcagttagcatgcttgaacagactgtatctagttctgagctaaatgctggatatgtgattctcattgagtccaggaggtaggaaccactattactcctttgacagatgaagggactaagactgataatctcacaacttgcaaaactagaaaatctcatatttcttttttgtaaggttgttttttattctttgcccttttttaaactaagaaatatttcaaatattgaaaaataacattgaatatcctccacctagatttcataaatgttaacgaatctggatatttgtttcagatccttagttcagaagaaattaaaagttaccaatacagttgaaacctgttttctacctctccacaatccatttccttctccctctgcagatgtaaccagtgttctgagattgttttaaactcactctagaatatgtatataaaaaatggtatcatatagtttttgtgattttgaatttacataactggtattttcttccatattcaggtttatccttttgtttatttcttctatctttttgaggtaaatatttagtctattaattttcagtctttcttattttctaatgtatacacttaaggccatgcattaccctctaagtactagtttagctgcattttgcaagtttgaaatagtgccttaaagtttccaaaatagagagttattactgcgttactgagctccaattttgttgcatatgagttgtagtgtggtctatagaataccaactttttgttatttattgagagttaactttggctcattactggtcaatatttttttaaatgattatattgacttgaaaagaagatatagcctccctttgctgggaatagagttctacatagttcattagagcaaacttactaactattcaaaagtactgtgtcatttgaaagaagtatattaaaaggccccattaggattgtgattttataaatttctcctttaatttctatcagcttagctctatgtagtttggggttttattgctttatacagtttagccaaaagaccttctttatccttaatgatgaattttctctgcaagtctattttatcaaatattaatatcatagaaccaattcttttttggttacttttttttttttttactattccttttctgacttacctcggttgttgtgttttagttgattctggtatattttaaaatatccaatctgacaatagcagttaacagggaagtttgtcatgtttattgtgattacttacattttgtgattttctaacattttctattaaagttgctattttgctcctttttttctccttgtttgctttctattggattcagtggtttttcttaccctctctcctcattttctctccactatttagaaacttatacattccctttcttttttttagtggttactattaaatatcacatgtatatttgtcttaattaaataatatagtaaccacagattgcttcaatatatccccttccatcatatatattattgttgattagtgttttagttatgccttgtttataaactgtccccagatttgttataacatggtcattattatctgctgtggtctgaatgtgtctcccaagtttcctatgttggaaatgttggaaatcctcaatgcaacagtgtggggaggtgaagtctctgggagctgtttaggtcatgagggatctgcccacatgaatggattgatgccattataaaagggctggaaggagggagttcaccccatttttcccttctgtcttctatgtgaggacagtttctcccctctggaagatgaattgttcaatgtgccattttggaagcagagactggatcttaacctacagtgccttgatcttgaacttgtcaggctttagaactgtgagaaaataaattcctgttctttataaattactcagtctcaggaattatgttgtggtagcacaaaatggactaagacattatttgtttggctttgccacttactggctgtattactttgcaagttttttagatgtgtgatgcctagtttcctcatggatatactggggatcataatagtatctaattataggtttattgtgataattagatgagcttcatcagttcctggcacataactgctcagtgaatttcagctgttatgatttagttagtacttattagattgtcaacatgttcactgatatgtttatgaactattatttctttctcctggttcagttaccttcttcctgaagtaggactcatagtagttcctttaatagagttctgtgagtaataaactatcagttttatttgaaaacacgtttactttgttccatctttgaatgatgttagttgaatgtgaaattgtagatagcagttatttttttcccagaatttggaagatattattttattttttctggctcttatagttgttcttgaggaatctagttgtatcagtgatgatctgcattttcaccatgatttgtttagggacactttaaaaaaatatttccttgctcttacttttttttcttcttcaatctgagaactgggagctcttatgtttttttttttaattcagtaatgtcataagctattattgcctcaaatattgccttcctgcattctattctgtccttctgtaatccatacagaataaatctatcattttgtctcccatgtctctcaatctcactctcaggttttccatctcttcaacttgctttacaactttctgtgtgattttctcaggattcatcctttcaatttatttctctttggttgtgtttttaattctatttaatccttccatttagttttttagcctgatgcttggcatctggagaagacaagaacaggaaaatcaggacaatgacctgactgtgtcacccattggcatgaaataatgaggaaggggtgaggagaactatgaaaagcatgaatggcatgttcagtgatcctcaatcagtttaccaacaagttttcttggtattttaaccttttgtgtgtgttttcaaaggcgttgtaaaaaacaaaacaacatataaatttgttaaataataataatgtatctccagattttgcttatcacaaaaatttataacaaccatactttaatttaaatgaccagtgttactgtatcaaattggtattctttcaactaagagaaaagaaattaaatttgccaatttagtttatttggggtaccatctcacccataaagatataatttttctatgttttttagaatacttgaaactggttcatagagtccctttcgtgatcataggtttgtaaacactggcataacattactgattggagctctagaaagcgggaagtcattcttgcctaccatcttttattcagcatttagctactggctgatctagaaactgcatctacagccactgctcattaccttcttgacccaagttgcagcatctacagaagatggagatgcagtttgtaagtggtccaggaatgagtgttggttagcttttagaggatgttgcttggactagcacaaggagtatcatacaaaactctcttgttgccacccttgacaaatgaccctaattttcatatcggattagaaaattcgattggaccatcaaagcaaatgtgttcttttatggtttattagtgattcttcccagctttggtaagtgcaatttatataatcagctctcaaagattttcactatgggtttttatttattcttgcagaatagtgccttagaaaattttatacggatttttttttgcaactattaagcagttttcccttattcccactctctcaaaccccaatgcccagcatgaagaagaaacaaatctctattttcaaatctaagccactcatgacacacccagctgggcttactctgaaattggatttccattgaaggacagtgggcagaacactaatcacttgggggcctggggaaacagtgggagggtgaatcaggaagccatcaggagatgcagccctcttgctgctttatgtagttagagagagagcatatttttagaatggactttgctaggaggataaataatacagttctattatttggacgtttgaatcacacacgtctagccctttaactcatctgatatacccctatgtactattatttttccatagggagaaaaaggcattaagtgagggataggtatattaatgaatatacttagagttactatattgaaatctggggaatatagatacagagaccaaaatggggagtggtgttgatcattgttggctagtggccctgaatggagcagggagtaggttcctgaatgggcacaggtaggaatcatgtgggaaatgggcacgtgtgcatctttcaaatccctccatagggctgctgcctactgcttgtattaaaaggcattttatgttgcatctacttgaagatgcctaaatatgctatactttcacctctcctcattcaacatatgtccatatgttatgtatacttccattgtcagatttgagctcttgaagcatgatttttaatctgtgcatgcccacatccagtgcaaagtaaaaaccaatagtgtctttcaggtttagaactgaccacagtcaagtactttaggacaggaaagtgagagggccagagggaagcttcgctttggggagtaaaagaaccaatctacagaggcccttggtctcccacagaaacacagaaatgataaggaagtataactatgactaaagagaaaggaaagaagagagagagaaagtgaagaaacacagccaagtagaagcagagcctgctcagggaagcatagatgggttagaggagggacatttgggatgcacatcagaaaatcagatgagaagtccgcgtttgtctgttttgtctggtcaccataattgtgctggctctgagtttcaacctttgttaatcatacagccttgtttaaatatggaatcatttttcttttgtccttccttgactccatcttaaacatcacattactgataactcagagaacttttaacctaggcaatcttcatgtgagttccattcagttccttttgatatacacatatttaaagtgacagttatttcctcttatggaagatagattttatttaataattttttcaagcggagagattagttgtggtcacagtagaaaatttttcataattctccaagtactataaaaagtaacttgatggcataaagtgaattcccatgatgagagtcatcctgtcactgtgaattgctgtgatcatctttaaagtgatatatctttccacactgtctgtcagcaactatgtagggtttgttttagattcaaaaatgtgtgagattagttgatctatatccaaagaattcagacactttttgttgtttttggatctagtcactgttcactagttcagttgtggggtagttttcttatgtttatctgtcctgaagttttatattcagaggcagtttttacatgctctttttttcttacccttcacttaatgaagcagggttataggagaaaaataaccttttatctttcctcagtgatattaacttcattgcatttaactttttaataaatcgtatgcctactaatttacagaagccttatttctaaaaaatgtaatatatatgacttaagactgatcaacatcttcccctttctactacatacatattcggagtttttattttgttttctttctgtatatttcagactgggaaaaaatgtactatttgtaagcagatgatttaatttcagtaaatgtttttttatttctctctccctttgatttattgcttggaaaccatgagaaacatccaagtgcagatgctgttttcccactctgacaaaacattgcttgttgacctcgcaaacttagaaagatttatctcctgtgattcaatggtggaagtaataatattagcagttaaaattttctaagacacgatcaggaaaaggagacttcggtcgttctgcttcttgttaagaacagctggcaatttaaaaagcagagacttgctaagggggaaggaggtaaagaagatcaaacagaaatgcctccccctttagtgaagtatgaactgagggtgctgcatagtagcaataaaatcagattcttaaatgctttcccttgtttagtgtgtatatgtgcttatttttatttagtcttcaaagatgactttccttatatatttattctcttcgcaggaaatacatcttgaccaaatattttttgccaaatacttgttgtatattaaagccagcttaaaatgtcatatttgctgtggctatgttgagactctgacaagattatctgcagtgtgagtgatgtctgcaagagtggcctctcaccatgccttctgcacattgattccactaatctgccaggaggcagaggtgattcctatcattctgagagcttcctatagaaggcagggcctctgcagtctctagaactgaggaactaaatgaaggccaccaaagtgaccattaagttccttaattgtgaggaagcatctttaagaggaaatgattctacagccagaaatatgcgtgaccagttctacaggatgtgatgtcatgtgactggtggagcttgtctttctatcaaaggcttgtacagaaaagggaaaagaaatgggcatgtttcaggtcagttctgaataatggaagaaagaatgaaaggaaggagaggggaggggaggggacaggagcggagggaaggggaggggaggggaggggacaggagcagagcggaggggaggggaggagaggggagtggaggagaggagaggagaggagcggagaggagaggagagaggagaggggcatgtgagctggatttcttcaaaccccaccaacctggacagtgagtcctggaatcaaaataatggtgagcctcagcatctaacatcaaacacccagacttccttctggtttaagaaattccaaaggctctcagctgtgataaaattaaaaggacatattcctatttgttctttttgttattggttctctgtctccccctgaacctttagccagaaatagagatgcaccctttcttcttcagtagctttgaggatcaaagaatcttagttgccagagctgggaggggaatctcaaagattgcctagtggaacaatatgattgttcatgtgaataaactgaaactcagagagaatgtggtctatgcaagacatggcccatagtctgtgtcaaaagccaggttttctgacttgtggcccagggctctctgtagtattctgggccagcaaaatcccgtgtctctccagacacatcttctcttgcaccaaatgggcctccttgctgtgtcctcctcaaaccaccctcactcccacctctgaacctttgctgatgttcacaccctgcacagagtgcccttctcctccaactcctctgctcagcacatcacatcccctaatgctcagcccgatctcatttccaaagttaaggctctgctactcttccagcccaaattgatgtctcctctccctagaccccttcaggtcttttttcattccctgtttcatgtttgattttaacttctcaaccagatgatactttcccaagcctatgtttttgtcttttccacagcagtcctcccagcacctactgccaggccaagtgcttttctctacttcagtcttcttctctgttaaatgtgaataataacacctgctctaaatctaagcctagtggactcccagcttgttgaagggcatgttgaatagtcttatgtactggaagtttgagcttttgggagggtaaaagaagggacagggatgcctaggcacacagaactcaaatgcagttatttgggttttcctctaacttagcctccactggtcaaatgtttttagcacctgcaccagcagccatttccatgtatcccttctccctggagacagtacaaacaagagataattcctatcattgttgggacagaagtctctcaaagcccttaccaatattatagttttgagattcacagtttcctctgaaacttcccctttaggagggatggaaaccacaggatgggcattctggtaaatgctcaacatagatacctatggactgggtagcaggtgacccctaggaaaacctcaaatatcctataaggtcctaataagggccagttattctaagcaaaggagcttctgtgagtcatagtgcaatccatagatatgcttgttagctccttatttaaacccttcctgaaacaacagccaagaaaggaaaggactcaaggtcacctctggaatcagaatctactcagtcttttcccatcctagtttgtattcaccatattcagccctcagccaacttgaggcagagtgccttggtagaaagtggttcttagagacaggcatccaggcaatgtagcaaagtagaaagagccctagactagaagtataaagacccaggtttgaggcctgactctgccacctgctgtctcaaaaactgcaataatataaagtctcttaccaattctagcttcagtcttctcctttgttaaatgtgaataacaataatgccttccctgccagtcatggtggctcacacctctaatcccccctactttgggagaccgaggtgggccaatcactcgaggccaggagttcaagactagtgtggccaacatggcaaaaccccatcctactaaacatacacaaattagctgggcgtggtggcaggtgcctcttgtcctggctactctagaggctgaggcacaagaatcacttgaacctgggaggcagagcttgcagtgagccaaaattgcaccactgcactccagcctgggagacagaacaagagtctgtcataataataataataataataataataataataataataataataataatgctttccctacatctagctataattatttctttaacatttccttccctgctacattgtcagctgcataagagcagggtctatgtgtatcttgtttaacactgtatccccagaaccctagtaggacatgtactgtattaactggttggttgactgagcaatagggagaagtttagagcaagtgcaagctattattatgatccttattatgtttgatgttgttgttatgtctccctagagtttggtggattttggtttggatttccattccactctccatcattgagaaggaactgagtcaaaagacccatagtggatcagcagagaccaaccactcaccatggtcataagtaatttcagagcccatagtatctctctgtagattcttccctagtctcagtacttggccacagagtggatggctttgatcttacacagattgattctatatcccttgatgggtgtgtggcagcaatcatcaacagcaaggtgaccttctctgcttatcatgactggccccttttcttctataattttcttctttggtttttgatgtatgagtatttttagtgacaaagataattaggtactttagtgacaaagataattccaatggtactgtactaaatgtggcttctgcctgaggatgcacttgtgtctgaggaggatctagactgtccaagtgagctcttattttaaagcccctcttacaggttggctcttaaggactgaggagaaagcagggcctttagcatcagacaggtctacttttggaagcccatgtagttgacaatctagctacatgggacaatgtagctacagggaaggaaatgttaaagaaataattatatgtgtgaagaatacctagatgtagggcagatattattattatcatttaacatgaggaaaacttagtctgagagaagcaagaagctttgctccaagtttttgagacagtgacacagataaggtgtctctccttattgtataatagggacaataataaagccatcttcaagggatgttgtgatgaatcagtcagaaaatgtatgtgaagttaatgagcaaagagtctggccatagtattaattagtattaatactattaataagtattcaataaaggagagtctcccactttctttccttccactctgttttccataaattaaccagagataaaagtggtggaattagacttcagtcctgtaatggtgcacctgaagtgcttcctctcaattcatatccatcttccagattgcttgttgtacccatattttctgttaacacaaattggagggagtatcatgactttcatttgttgacagatacacaaatgggcagaacacaatgatgaatgtctcaattcagacaggaattgaatgttgcctgtggggtaggctggctctgccacctgcactgacaatacatcatccctggaaattaacccatcttcaccatagccattgaaatggaaagaagtgcttgttcattaaaaacaccttcaaatggaaaggatgaaggtctagcgtagtatatatggtgcattaatatctataatcatgtttaatttgcattagtctaactctgccacttggaaactgtttttaagatattgtgttgcctgaatgggtttgtgtatgcattatttgcttcttgaataagagctgaacagaagctaatagctttatataaaatatagtgattaccaaattcaagagtcaatgtcctgtttcacattcattcttgctcacttttagtacaagcttatgcatcatcaggcatgttgtatacaaaaataatgatgtgggtcctggtctttataggtctaatgggtggtagttccatatttctgtaaattttaaaagcattattactcactaaatatggatcattttaaaataattagatatatgtatgaataggcttcatatcacaaagttttattttctttgttaaggatatgaatcctaatgtctttactattgaatctgctaattcaaataatatctatcagtaggtagatgagctaaacactaagcctgtatgtcaaattttatacacgatattatgcttagatgcatacatagcaaaaccaatatttacaatatattggtgtacaaacaatatattggtgtaaaaaaatgattagtgcttcatcaagttaatacattcaggtatcataattatgtattatttcatagtgtatcaacaaggagaagagaaactagttatttcaagcaggaagtgatttaatttagggaaatagattctataacagaaagaattaatgtttaccaaacactatattgttctcccgttctctcttgctgttaattgggaccctgtgatagtcctggctgaaggactgtgaaggggagggaagaattaatatcccagggcctaactggttaagagcttgtgtgcctctttcaaccctcactttccctggaataaaccttggagctatatgttgaaatagaaaataaaaatatggatgaatcttggtcgtctgagtcaccagatagaggagatctcttgccaatctgcacgggattttgcatgaacaaaaagtcaccttttactgggataagccacagaaatttcagagttttgtctattgagacagctagggttagttactgtaaaaatactagggcctggaaaaatgttggaaggattgagagagggaagatcaggttgcaactactagtatgcagaaaatcataaagcataggaactgcaggaaactgtcaccaatgatctcagctgtctacagcaccaaagtgagtggtcagtaggaagatacttggaagctgttagcaaaagctcacatctggggtctacccaagtccatgtgactgcctgtctcaaaagagtaataatagttctatttatcttttgtctttgaaaccttgcatgaatgagtctaattgtcttaatttaaaccataaccctgctggcagagattctaagaaatgtagttctcatgcttccaatccctataatactaaggagagcgtagaaggagaaaatggtgtcaaattgccaaaaaaaagaacctggcatatagaagtagcccaattattaggtgatgacatgccccagtttgtctgggacagtcccaatttattcctgttgacctagagtaatttttgatagtaccccgtttcaatctcaacatgttccctgcttggacactaaattatatggacatcgacctattaataacatgataaaaatactttatttcatcaaaaaacacttattcaggatatgctaagtgctaatcattgtgtgggacattggtcaacagaggcatttatgaccttggcattcatgaaacttagagtcgaatctagtgaatgatgggagcctaaacaaggcaatagctatgaggatggagcagaggaggcatactcgaaagaggttgaagaactaaatcatacaggtcttgataactagcatactggttaagacccttaggctcttacgtcagactatccaggtttgaacaccagctctatcacttgttgggtattttaacttgggaatttaccaactaatctctgcctcaacttacaactctgttaaatgggaattataataatacttataagattgttgtgaaaattaaatgagataaaaatttataaagtttataagagggcctaaaatatagtaaatgctcaagaaatatcattatagtgaagaaattgtggtggttgttgttttataatggctgaatatgagagaactgttaagaaaatcctaggtttctgacttgaatatcttgatggatggttatgtaaaataataaatgcagaagaagctgatttatgtgggggaaaatagtgcatatagtttgaatggattgctagaagagtaaacagaggaattggcattctaatttaagtgggggaagtaatgcatttggtttgattatgctgagtttgagggactggtgggaaatccaaatggcaaggtctgatagcagctgaatagttagaattggggctcagataaagatctgagctgaaatttagacttgtgaggtttttttttttttaaaaaaaaaacacttctattttaagtttaggtgtgcaagtacaggtttgttacacaggtaaacttgtgtcatgggggtttgttatacagattatttcatcacccaggtattaagcctagtacccattagttgtatttctggatcctctccctctttccaccatctcacaccagtcagaatggctgttattaaaaagtcaaaagatttgtgactttctagatggtagctgaagccaaggaaatttgggagatgaattagagaaggtattcagagtagaccagaactttaaagggcagaggaaaagaaacatatgagaaagacaagaaggaattgccagaaaaatagaagagaagcaggcaagtgatgtgaaggaaggcgaggaaggagagaaagccagaaagaacagggtggacgatggtgttaagtgtcaagcacaaatcaagaagatgagaacagaaatgatttccacagattcagcaattgagggcttttgctgattttagtaagaatagattcagtggagtagggaaggtggaagtcttctcaggtcaccaagggtagaggtaagaatgagaagagagaacatatagatcatgaaatattaatcttcagggtgcttggctgtgaaggaaaggaaagggtcaactggtggctagaggctttttaaaagcacagcctacaagatcctttggtcctagagttgcacaaaggatttgcagaccaggaaaggtttagataacatgaccaccaaagtcttccccatttcaaagtgtttattatttcatgattctctgcttaataagtaccaaggttcagcttttattttcacaggttgttacctgtaaagagggtacaaaatctgttttatcctaacaaatttaagttagaatttagtttgatcttacgagtctttagggaaatatattttaggagtcaaaatgtgtatctgtacatagtatatttatgaatattgttcttaatttttaattcagtacctttacaaattattttataattggttcctgttttcaaccagttgcttgtgcttatatatgcaatttgtctatttttttcatatctgttttcagcttctcccaaagaattatcattaggtcataacactgggggaggtttactgaatgatcattcttttcaaagactttaccatttcccccagagccttggttggtttattgactagagcaaagcagttagtttgctattagtggaataaggtaggcaaagcatctggaaatgttctaccaggaggagccagtggccttgttttcgaaaagtcccaggtctcccatcactccctccagtcttgctagggcatgaaagaatcagaatttataactgcatcataattctgtactacagcctttcatctgggatcttctgtttggaaagtctcttcaaatgttttcttagcctcaagggaaaaatttctcccagagatacctcaattttgatcaaaagcattcacaagtccacttttagttttttctctaccaattaaagtcctcttagcttggtagattaaagctcataaaactggttccactggtttattagaaaactcactttagctagaagagtcgaagttttgatatacacagaccctagagagctaggaaaatcttacttttctccaaaggattcaagtcctattatttaattttcatctgattttggccaagttcagatttttgctgactgtgtaacatagcctattcatttcagctacaaatagttctcttttgtttccatttacttagaaattaacaaaatattgccatcattttatgtgttttcataaatgtatttaaagccttttataattatgatatttaaatattctgtttttaaattccaaataacattagttgagagatgcatctttgacataaaaaaaaatttcaggagaaaaatttcttgtaaaagcttctcaatgagtgtatacattgatcataagaccattctaattctagaaacattaaatatgaaaaagtatacttttggaattgaaaagatatggcattaatggtcatttcacttgacttgaggcttcccatgtgtgggattcatcattacttcatatgcatctatctaatcttcatttatccattcagctcacagttattgagaacaatattaagtcttaagctcttttgctaagcaacggacaatgaacactccctggtgctagttagcatccgaatttgtaaagtgagccatttgttgtatgttttaaccttttaaaaaattcagcatttttctctaaatattttgaaatctaactcaagaaaaataaaaatcacccagtggctttttcacataattttaatcacctttattcttctgcttatcctgtctcctcagtcttacattcccctacactatgcagcaacctgagttgatagctatcataccacgccatgctactctcatcatcatacggtggcatgattaagacagagaagacttgaaaataagtatgcttaaaatcttcagaaaataaaatgtgaataacatccactaaaaaataaaaacaggagtttatgaaataacaattaagtggtaatcaaattagaacatgcagattcaaaagacaaccgattgaaatgattagaaataaaaatgtatagtcatttagaatttctagaaaaaaatctaaataaaaggaataaataaagagaatgctgtcaaagggagactttataaattggatcacggaaattagaaattaccaaactgtgcaaaacagagaaaagagaactgaaaatataaaagattttgtaatgcaagaagttctattatatataagtaaatagttccagtgggagaaaatagagaaaattgctgaacagtttctagaattaaggcaagatgtgagtattcatattccaaaaaggacaaatcatgccaagcaagatgaaaattttaaaacctctttctatatttacattataatgaagctaaagaacatcaagggcagaatatttgcttttctgaatggggagatatgaaatatcattgaagctttccttgattactagaggtttattcctgcattctgttgtgataacactttcttctatgttgatttagttatttgcctgctgtaacttctcatgcagtcattgtactggcctccagctcacttttgtttactgctgttctatgctatttgctggacaaaccaaaaaactgcctttgttaaaagacttacaataaacaacaatagcttattaaacgaagaattggctttaaagaaggtacatgatactagcgtagcaaaagctaacattaatcaggtgttttctatctactagacatttttacaagatttttctcacttaaccctcacaatgtccccatgaggctggtattactctatcacccccattttacagatgaggaacctgaggcttagttagagaaactgattcacttgcccaagatcatgtggctttagcaagtatgttaagtggtgcctcctagattttaacaaagtcaaattctaagcccaaaatttttaaatactcctttttcttatcctttttttttttttaacttttattttaaggtcagtggtacaggtgcaggtttgttacctaagtaaacctctgtcatggggtttgttgtacaggttatttcatcacccagctattaagcctagaacccattagttatttttccttgtcctctccctcttcccagccctcatcctccaaaaagccctagtgtattttgttcccctctacatgttcatgtgttctcatcatttagctcccacttataagtgagaagatgtagtatttgtttttctgtttctgtgttaatttgctaaggataatggcctccagctccttccatgtccctgcaaagaacatgatctcgttcttttttatggctgcctagtattccatggtgggtatgtaccacattttctttatcgagcctaacattgatgggcatttaagttgatcccatgtctttgctattgtgaatagtgctgcagtgaacatatgtgtatgtgtctttataatagaatgatttatattcttttgggtgtatacccagtaatgacattgcttggttgaatggcatttctgtctttaggtctttgagtaattgccatgctgtcttccacaatggctgaactaacttacactcccaccaaaagtgtataagtgttcctttttctccacaaccttatcagcatctgttatttttgactttttaataacagacattctgactggtgtgagatggtatctcattgcagttttgatttgcatttctctaatgatcagtgctgctgagcttttttttttttgtatgattgttggcttcatgtatgtcttcttttgagaagtgtctgttcatgtcctttgcccactttttaatagggttgtttgttttctttctgtaaatttaagttccttatagatgctggatattagacctttgtcagatgcaagtttgcaaaaattttctcccattctgcaggttgtctgtttactctgttgatagtttctttggctgtgcagaagctcttaagcttaattagatcccatttgtcaaattttgcttctgtggcagttgcttttcatgaatcttcatcatgaaatctttgcccttgcctctttccagaatagtattgcccaggttgtcttccagggtttttatagttttgggttttacattgaagtttttaatccatcttgagttaattttcatatacggtataaggaaggggtccagtttcagttttctgcatatggctagccagttattccagcaccatttattaaatagggaaacctttccccattgcttgtttttgtcagcttcgttgaagatcagatgattgtaggtgcatggccttatttctgggctctctattctgttccattgatctatgtgtctgtttttgtaccagtaccatgctgttttggttactgtagcctgtagcatagtttgaagtcaggtagcatgatgcctccagctttgttctttttgcttaggattgccttggctatttgggctcttttttggttccatgtgaattttaaaataaattgttttagttctgtgaagaatgtcaatggtagtttaataggcatagcattgaatctataaattactttgggcagtatggccattttaaagatattaattatttgtatccatgagcatggaatgtttttccatttgtttgtatcatctctgatctctttgaacagtggtttgtagttctccttgtagagatctttcagttccctagttagctgtattcctaggtattttattctttttgtggcaattgtgaatggaagtttatttatgatttggttctctgcttgcttattggtggtatataggaaggttagcgatttttacacattgattttgtatcctgagactttgctgaagttgcttatcagcttaagaagcttttgggctgagacaatggagttttctagatataggatcacgttatctgcaaataaagataatttgacttcctctctttctatttgaatacactttatttctttctactgcctgattgccctggcctgagcttccaatattatgttgaataggagtggtgagagagggaatccttgtctagtgaaatctgattttcaaggggaatgcttccagcttttacttattcagtatgatgttggctgtgggtttgccatatatggctcttattattttgagatatgttccttcaatacctagtttattgagattttttaacatgaatcgttgttgaattttatagaaagccctttctgcatctattgagattatcatgcggtttttgacgttagctctgtttatgtgatgaatcacatttcttgatttgcatatgttgaaccaaacttgcatcttggggttgaagcctacttgattgtggtggataaactttttgacgtgctactggattcagtttgatagtcttttgttgagaatttttgcatcaatgtttattaaggatactggcctgaagttttctttctttctttctttctttttttttttttttttttttttgtatttctgccaggctttgttatcaggataacactggcctatagaatgagttagtgagtagtccctcttcaattttttggaatagctccagtaagaatggtaccagctctttgtacatctggtagaattcagctgtgaatccatctggccttgagctttttttggttggtaggctatttattactacctcaatttcagaactcattattgttctattcagagatccagtttattcctggttcagtcttgggagggtgtatgtatccaggaatttattcatttcttctagattttttagtttatgcgcatagaaggttcataatattctctgatggttgtttgtatttctgtggagtcaggggtaatatcccccttatcgtttttgattatgtttatttgaaccttctctcttttctcctttgttagtctagctagcaatctattttattaatttcttcaaagaatcaactcttggacttgttgatctttttaatggctttttgtgtctctatctccttcaattcagctcagattttggttatttcttgtcttctgctacctttgggatttgcttgctcttggttctctagttcttgtagtggtgatgttaggttgttaacttgagatctttctatcttttggatgtgggcatttagtgctatagatctccctcttaacactgccttgtctgtgtcccagagattctggtacgttgcatctttgttcacattagtttcaaagaacttcttgatttctgccttaatttcattgtttacccaaaggtcattcaggagcaagttattcaatttccatgtaattgtatggttttgagtgaatttcttagtctttatttcaattttgattgtgttgtggtccaagagactgttaatatttccgttcttttacatttgctgaggagtgttttactttatgtgatttattttaaagaaagtgccatgtggcgatgagaagaatgtatattctgttatttttgggtggagagttctgtagatatctatttgatctaggtccatttgatccagggctgagttcagatcctgaatatctttgttaattttctgtcttagtgatctgtctaatattgtcagtggggtattaaactctccagctattattgtggtgcagtctaagtctccttgaagttctctaggaacttgctttatgaatctgggtactcctgtgttgggtgcatatatatttaggacagttagattttcttgttgtactgaacaatttactattatataatgcccttctgtgtctttttgtttatctttgttggtttaaagtctccttcgtcagaagttagaattgcaacccctgcttctttctgtttcctatttggtagattttcctccatccctttattttgagcctgtgtgtgtcattgcatgtgacattggtctcttaaagacagcataccaataggtcttggttctttatccatcttgtcactctgtgtcttctatttggggcatttaacccatttacatttaaggttagtatttatatctatggatttgatcctgtcatcatgttagctgattattttgcagacttgtttatgtggttgctttatagtgtcactggtctgtgtatttcagtgtgtttttgtagttctaaacccaaattcttaatgactactctatatcttttttagtggaaaaaaagactttatttcttaggaccccacacactataagcccctatatatttctcttgaagcctgaaagtcttgacttattcttcagctgtaatcagctgtggtgtactttggggacccatcactagatttgcactgtgaggttacctatgctccatttctccagtggcctggtgctatctgactcaatctggagtaatatgcatgctttgccaagtgaatttgatgactgaagggttccataagggtctaagataagcatagatgcatattggcatcatctgcttggaaggggcctttaaaatgtcaccattcctcactatgctacaccaaggaaggggggataattatcattgcttgtggtaggtgaggcaggatggtcagagcacgtactttgaacctcatcattctgctaagtactactatacgttatttttttgactatcattatcactgacatctaggatataagcacctgtctttactaatcagacttagtaagacattttggtatgtgttgagaaacagtaatattgaacatataaccttacagatggaattacattttggatttaactatcctgacatctttttctttaactctcctaattgatttccattatgttgaaatccaagtccatcctttgaaatgttagcgggaagactgaggattgaaatgtgtagatagaaaaatcacagaatttaacttaaagtacatgaaaaaattccaatgaaattataaccattaatatccttaatacataaaatattcatacaaatcaataataaagaatccccatgactgcaataaataaataagtaaaggtccaaaataaataatttgtaaaaaaaaaaaaaagtttaaaatgttaaatcccagtagcaatcaaatacatataattcaattcaaaacactgaaatgacacttgtagtcttttaaattagtgattttaaaaaaacaaaacaacaaaaaaacagaatattggtaagagagcaatgaaaaatgagttttcatacactgtgggaaaataatttggtaccaactatttaaaaagcaatttggcaatactgtatacatcaagagctacaaaattaccctttgactaattttacttctcataaattatcctgaaaaaaattcaaatatctggaaaagctttagttcaaagctaatcattacaatgttatttgtaatgttaaatatcagaaataaatgaaaattactaaaattgaaaaacagttaaagtttacttcatccttaaaaggaatatttcacagagaatacaaatagaaatacagagagactgtgaaatagcacagataaatgtctaagctttaatgtaaaatgaagaatatacatatgtaatggatcaactataagaaacttaaaaatatgattaagaaagaaagattaaacaaaaataccaaaatttcaacaaagattatctcttgttaatggggtttgactatttcttttctgtgtttcccaaatttttatgatgaatgtgatttattctattttaagagggaaagaaaatttttttatgaagaaaaattgaattaaaataaatttttatggggctgaagaaaaggcctctataaatgtgacttgattgggaagcttgtgaattttttctgtaggaactgagtatttatgatctttttttttttgagatggagtctcactctgttgcccaggctggagtgtggtggtgtgatctcggctcactgcaacctccgcctcccgggttcaagcggttcttctgcctcagcctcacaagtagctgggactacaggtgtgtgccaccacacctggctaatttttgtacttttagtagagacaggatttcaccatattggccaagatggtctcaatcgcctgacttcatgatctgcccacctcagcctcccaaaatgctgggattacaggcatgaggcaccgctcctggcctatgatcattttatatggactgatttaaaatctgttttgaagccaggtgcagtggctcacgcctgtaatcccagaactttgggaggctgaggtgggataattgcttgagcccaggagttcgagactacccaggacaacatagggaaattctgtctctataaaaaataaaaatacatttaaaaaatcaaataaaatctgttttgaatagccatcaaaaacaacttctcctacactaacatttaagagcgtgaaaggtggcaagaaaagttctatcatagcttagatcctaaactattctacgcaagtttttgatgggctctaacatgttaatagcatatatgtaacactaattacaaagaaacctcatttcttcattgaaaaggttatcagtttaatgcagtgaaatctgactatgtgagtgtgagtatatacagttgtgctaatatcagtttgtagtcgttcaaggctaatcttcccactccagaggaaatttttttatcatatatgcatacattgctgcactgaataatgggaacctaaaataaaaaagatcattgcctattttatatgctccataaaattcactgacagtaaccaccaacatcccaggtatcgtctgcagtttagaatcctgaatattttccccaaaaatgtccgataagggaagcaatttaagcaaggcagacagtgctgctaacagagaccatacagtttcagccagcgagtctgctgactgaaatgaagtccttggacctgtggtttttttgtggggttatttgctcttgtagaataaggctctcagaatttcaataaaagggtgaaaacagttttgaaactgagaagactgttacactgcctaagaggaatagaggtgtgattgagatgtggtgaaagaatctgaaagttgagttgtttttttttaagtctcttcccgtgtctatgtcctgccatttcttagatttatacaaacccgacccaaaaaagggtgtcaggggcttgaatccagcaggcactctcatacaggtctgttataccacttcaccttttatagtcagtcgacaggacagggggaattacttagtatacaaagaagtgcaagggaaataaaacctatgcaaatcacatttgtagccttctaaatatttgacctatatgaaaaattccagctttgatttcttagtccaaattgcaaatcagccaaacgtagctgattctgtcctatatgaattggttattactgtctttccctttcttagaacccctgggaacaaacaagaaaaagtaaggaaaacaaaatacttattaaaatgtaaatacagtggctggttccctgatatgttatgctgacaacccttgctggcaacccaggaggacccaggtgcaccaggaaccgacttatctggtcacagaacatcgggggctggaaattgacagcctctgaagggggccttttgttacttgacttctgtggcaggttgctggctcattctcctgcatggaagagttgaaactcgtctttcaactaaatggagtacatgagggcagagattcttttttggtttggcaacccaagtatattaggaaaaaataggcactgcaaaatagcaggaaagcatgaagaatgctttatgaagaaacataaaagaaaaccagaggaaagcatattcagcctcagtcattaaaaagcacactactgttcccagtcttgccttctccaaaagtttgtttgtttgaagtttcttctgcagaactctaagcaggtctccaatataccgacatctttaacagcattctggaatgagaggagtgtctattaagggagacatactcctctatttcatttggaattttacacaacagttttctgtgtggcttaatttttggcatcaaattgttttaacagaagctgtgcttttcagttagatctttatctttgagttctagtgtcctcccacgatgcccctaggagcctatcaaagcaggccaaccctgcagaaatgcctagaataaaataacatgcaaatgccactaagaacttgcttccctcctgactcatattttagtttctataaagtgtctgttttcaaaactgacagtgtctgtagcctgttaatggaagataatgatttgcacaccaaaatgggagtaatcacagggctatttgacactgtccttagaaaaattccttacttactcaaaagccaaagcaaagaactatttctaaaatgacaaatgtgtgtaaattttcaaagtggattgtgatttcacccaggaaaacacaggcagccagaacacagttatgctttagtgtatatggtgatctaattcttgaaataaaactttattctgggcaatagcatgcatttctagatgagaggagaaattgttattgctcataataaaggacgaaatgtttttcttatttgggaacttcagggggatgaagtaaggaagtgggctgcagaacactgggataaatcttatttatttaacatttaatgctatagtctgttaggaaacaaactcactgcggtataattatttaatactggacagtaaaatcatctgctaagattagattaagtagttgactcaaagtactccccaggttcaaggctcaaaaatgaataaatcaacatgcttactgtacagagcccttgaacattatgtgtgctgggatggtggcttcctgaactatcgcctcttgtttgggtctgttgtgaagtcaaggcttgaggacatgacctgacctctttatttaaaaaaaaaaatccatttaatatcagttatcacttgaagaatttaaagacagaattatttgctcagaaaaatttgatgctttgtgctattaaaccctcagtacacagaaatagatttaagcaacatggtggtgaatcaagccaaggagagctgggaagctggaattgatggctcagtattctctgtaataatgtgtcaatttatgcctggacattttaggatgtctgtttatacaaatgtgaacaaatgtacctttgacttgtagccagggtgaacccagtgccaaaagaatagctcttctcttagactgggtttctcatttttttcagttttgtgactggcctagggtgtattttccttattggagccttgtgttgttgtcaccttcatccatgccaggttctcataggactaatccccaaggaagtcatccccagtctactgggcacactgagggaatccacgtgtacaatggaggcttaagctgtgagctttgctatcaggagaacctggctttaagtcctgtttctgcccattattatatatgtgaccataagtgagttgcttaacctctctaagcctcagcttcctgatccatacaacaggaaaagtactagtacctgcatcctgtgttactgtgaggttcaaaaagtaaaggaactaatgcacataaagtgtttagcatattgcctggcacaggatagggactccataaatgccagctttctttatacaaagaaaaacgtctttgccctttagttaatgttctcctgtccatgtcaaggtcagcatgacaccatggtagtctgtctagcttgtatttgtgtctgctgctcacataattgtttcttcacttgctgacctggttggctgaagttttggccatgggccaccctgtctgtgccccctggctttggatcccatctcgtcctatccacaatgtcaggagcaaagccacttctttacatacgtggcagaatccagccagacactctgcatcagcaacgtctccacagccagttgcttggtcttcagcctgtcaggcgctgagcacttgttctccatctgaaccagctctgtgctggcctctagcaattataatgcacctgctgatgcctcagagagccaggccagactgacactttcctctcggtattctttaattctatgcttgaccagttccagcattctttcttcttggtcccagacactttccacctcatctcctacatgtcacatctgatttgtccttattgtagaaggtaggtgtaaggcctaaagagtgagtgtggtttgttgtcagctgctccaaatggggcagcattggcaggaggtgcaggaactgatagaataagatttctatatcttttcttgagtttgtgacagtgctgtttatggtcaccagtttttatttgaggaattatccatttatgcaaaaaatgttttttattctatatatcctttaaaaagacatacaggttgccctctggaaatgagtcttaagcatgtctatagtatagctatatcatccacatcttgagtcattttgctcagtggattttcttaattctcaattaatttgtattctgtcagacagtctagtgagggagtaacgagtggtaagttagaaggtgacaattttatccgaggtctgtgcatagggtacagtggaagaatggagacggtgatgcctcatggcctcagcttacagtgtgatttgtacattttctgtgatttctataagtaacaggctgacagtgttggatttgctgtgttgtgctttgtatctacctttgtactgcctcttttttcccctcccacgctgactttatctcattccttgttttccttgagaagattgcactggaaaacttgaagaggggttagaaggtggggccatagtagataccagtaggaagacttcagaacagaccctgtcccctgctgtgatgatgccttgtgacttaacactgatgaccttacatggaggatttagtgaaagttatattagaaagcaattcagttacttccagattgttattgaagtccagcctctgtggtctacctatgccattagtatttgtcctaggttatttttgctttcgtatgtcagagaatggtctcaacgtaagggggtctgagtcagggtggtctagttgaaaaggtatgggcattggagtaaaaatataaaaaatctggattcatatccagcctctagcactgaatagctctgtgacattgtgcaaattgcttacattcttttaacttttgtttccttatctgtaacttggggatccagatataataatactgtcaggtattatagaattattgtgaaaattaaatgagataatgtctggaaagaacttagcacagcgtctggcatagtgttaagtacccagtaaatcctgattctttctctcccccagcctcactgcctcaccagctgcccagctgtctctaaacacagcatcagtggaactgtaaatactttcacagttatgtaatcgctctccacaaattcactctttgatcacctttctgccctccctccagatctattcctaaactcaattttgactctccctctggtataatctccttctctctgcagagaacagtaagaccttaatgtttaaaaaaatcatttcttcttaaaacttaaaggccctaaaacatcattttgagtttttgtctccagcagggtttatttctgacaacaaaattaatatatttatatttaatatttggagcttttattttacaatcatcttgacagtaatatttttctgatatttgaaaagccccatgatttttctgtgcagagaatgcattttgttaatttatctaagtggctgctaggcttttaaggttttaggttcattttttatttttctggagctcagtcccctaaaatgcaaatgagtcttgagcagctcttccagaagataaattattcttcttttctgtctcctactgttcaaagttagtgataatttttagacccagcagttgaagattttgacattcctgttgatataaatgtggacattccaatgttgttcaacttctgactgtcttagggactgattgcttatctctatcagccaagaaaatgccctttgcattggtctcatctctcacccacaccaaccaaacacatatatgcaatctaatgtctataggtcacattcttgccactttatctctttaaaattggatagttttagatggaatttgcaggtgctaatatggaccactgggtaacagggatagatacagtagcattgttagattatattctctaagttgagatttttcacctaaaaagagacagaagaagatggaggttgcacagtactggtcagatcttcccatgcagtttatcttttggaagggcaacagtataaagcagttaagagcattaattggacattaggcagtcctaggtttgaatcctggctctgacacttattggctgtataatactggtcaagtgacttaatttctctacctctcagttttattatttgtgaaacaggatgacaatattacttgctttgcagaattaaatgaggtaatattttgaaaattatatgagctattatctaaaaacatttagcacagtgactggcacagcatagagtgcccagtcaatcttggtcccttctccccagttttgccctgaatgttggccagctttgctgcagatgctttctccactatgccattactctcatccaatcctttcctttattagctttcttccctagccctcacttcttctcttggacccagtgtgcgcgctctctctctccagaaaaataataattttaaaaaaatcagttcttcacatgaatgcaaaacacctactacaatgatgtgggtgatggtgatgatgataagaataatgtgggaactttttaccctttttgtcctctggattgtaagtttcatgagttcaaagataatgatttcttcagcaccaaatgccttggttcctggaccaggaatagttggtgaatggatgaatctgatattcagagttgcaatgattgcggcatttaatcttttttatttctgcacagttaatccaaatgagtatttattgatttgtatatatatttactacttctattgcaaaattttagtttcttcttttatgaaatagaattcttaaatgcatgcttgtgcatccaagaaggacagtgatgatgtgtttcaatgtattaaatgttgaaatttaaatgttggggcatgttcttgaaatggtgactacacaggggaaaaaaatttaatagattggttttaaggtttgaggacgggggtcctgggaaagtgctgagaatggaggcatagcattccttcccacactcagcacataactctgcatggatttggtttcatttcaaaaacggagtgttcacagactgaatacacctctgtacacttgaccctaggagggcagcagataaacttggggagtcttttttagacaatattcccctgaggttttaagtaaatttttacaagctcctagaaatacttttaagaatctatataaaatttctcccttaccttaacagcttttacttagaagatatatcaaaatgaccccaaaaagcaaaagctctataaggtcagctaatccattaccttagcaatgtgaggtgcataaaatgtgaaccactgaaatttcatgtaaacacctcgcagtttgctctaaattttcttttatctcaaggatgcaaatgtgtcttgtgcttcccataattgaagaatgaaaatgtttgagataaatagcccttcccctgagaggccaaatactttccttgaagaaatgccagtcctatgtccctgtgggtagggttcagtatttgtagagtcgccaattataatggcccagatctaataggaactcaaggattccagcctatttccacctaccccacctgcccaagaccagccttatttccaggctttactctcccttaggcatatgtggtggcaggcacctgtaaccccagctactcaagaggctgaggcaggagaatcgcttgaacctggggggcagaggttgcagaaagccgagaccatgccacagcactccaggctgggcaacagagcaagactccatctcaaaaaacaagtaataacaataataataataataatattaatgatttaatgttcaaaaatatcctatgtccaaaagttctttttataaatctgatccatatcgctattgttgcagcttaaaattctgttacacgtggtaatacatacattaacaaatacgtatagggctccttgatttaccaggggctgtgtgtgaaaactacattaatcataattaactgccaaatggttagaacagaaaataacagctttgaagtccagagaaaggagagagtggagcaggaggaattggagctggatcttgtaagatagttgagatatgcataagttgagagaaaaagaaaggacaaaccagatggcataaatggtgtgaggaaaatcacagaaatggaaagaaagtgaggaggccaatttacatggaaatgaggcttttggaaaagggagtagttggaggtaactcttggaggcagatcggaatctatctacatagggccttgaatgctatactaaagaggatggtctatcccatagaccagtggtgtccaaagttaggaagtgtgtaggaaaatacatttgtatatagaaaaagatgtattctttatatagaaaaagaaatatattttactaataatttcttgtattgacaatgttgtatatgtgtcatttatatgtaaatatgctatgtggtgatccacactcaaaattgttttattgatagagatacatgttcaaaagaggttggaggcagatgactgctataggtgataagggatgattaaaggttttcatgcagccagtgacatgttcaaagcagtattctaagaagatgaatctggcagcagttataccgagaggattggtggaagcagttagttggcgattgcaacaattcaaagggcttaaattatgatagccacagtaggaatgtaaaggagggggagagttccagggatgttcggataatcttattatttgcatggtgagattttcctttagcaagagtattcagcaatctctttgggggctgagaatagagcagtgctcaagaaggtgagtttttgtttgaaactgatttcaaaagtgggttagtggtcaggcgcagtggctcacacctgtaatcccagcaatttgggaggccgaggcgggcagatcacttgaggtcaggagttcaagacaagcctggcaaacatgacaaagccccatctctactaaaaatataaaactagctgggcatggtgacaaatgcctgtaatctctggaggcagaggcatgagaatcacttgaacccaggagtcggaggttgcagtgagctgagattgcgccactgtacaccaacctgggtgacagagggagactccatctcaaaaaaaaaaaaaaaaaaggattagtactaccccaaatgtactatggtctgaaaacctaaacttaaatgtgaccaataattaaaaattacattaattactggtcaaaaacaatataggattaatcctttaattgagtatagataacttcataactaattttatacacaaggaaaatctttgaaaatgtagataacatcttctccaccataatcataaaaaggagcatgataacagaagtagcttaataatggttcctgcattatattaaaaaaaacttatgcttcatatttgctgtttggtgttgaaaagggatcccagaaattttctcatctcagttgcttgttggagatgcattacttttttataatacatgattcaagtacaaacagttgtttttcctcacacagcttgatcttcacaaaaaataaaatttaaaaaaccattttggtaaatgtaaatttgtaaaaggaggttttggtacttgtacttgatttaccatcattttctttaaaattgtactgttgtttaacttctcaccagttgatgtttttgtaaggtagaactcttaacaaaagtgtgattcagagttcaaatctattattagccaggcttctcaatttctccttgcacataaaaacatggtaaataatgatagagaaaaagaaatagcatgtttgaaaatgccaactagatcaggcttgtgattcctacatgatactagcattatcttagacatgtgttgataaaagagccctactatcaggcaatttaaattaaaaaaaaaaacaaattcacatattttaactcttgccaggcatcggatataaacttaacaattatctcaatcaaggtaaaatagactatagattgtgtgtgcatatgtgtgaaaatgaacagaatatagtgtagaaaaatagatacaatatgacacataaaaaagaagataagattttaaagttctacattaagcaaaagtaacttttctcaggcattgctggtagaaatataaattggtaacctttctttagggcattggtggcatgtgtcaagagccttaagaatgtttatactgtttaaactcagttctatatttctatttttaagaacttgtcccaagaataaaatccttaaatgcccaataataagggagtagctaaaataagtgaagaaccatttttgaacattattgattataataaggaccatatgtgccctgactttaagtggaaagggcagtagaaaactactattgtttacatacatttataatttttgtacgtacatatttgtatacatacatttgtttacaaaaaatgtaaagaagtataacaatattcttacaagttgttttggtttctaattttttgtttctctcaattttaaattttaaaaaagatatgttgctatatattgtatttatattcagaaaaattatcaaaataattttaaaaataaaataattaaagagagctcccagagtttaaaatgtaaatacctatcatttaattcagttagctgatggaaaattttggtgaccattacatatttatttaatgacttagtcaacaagagctgttgatgtattaaattttgagtagacccagctgtgctacaaaagtaggtaatgtaatggcaactaaagcaaatgtcaaagctgaagcacatttaattatcttggctactggggtgttttaacctgtgttacttgtgctttggtctcacaaaaatggcatcttttaccaactttctaaactgagtaggcaatgcatgctttagattaaatgaaaaggtggtcccttttatttatatttatacaaatatattcattcagtcaatcaaataaacaaacatttattcagcaattgtcaaatgtcaggtattgggccagattatgaaaaagggaaatgagtatcagaaaattaatggtctaatgggaagatcaacatttaagggtggctgaaaatgaaaatagagttatgcatgcagttctagaggaacattgagaaaggggcagccaactctgcctttgagttaggggagccttcccagagaaagtattatagagataggctttgttcaatgaataggagtttcctagatggaaaaggtgaagaggtattctagataggaagaagagcatatacaaaatgtcaaaactctgagataacatggcctgttcagggactggtaggaaatatggtatagctagagcttaggatgagaagcagaagcagatcatgatggcagaccagaagcaagactagattgcagctgtcactcggatggacagaacagtgtgtggagacttgcattgtgaacttttactcaacaatgactgcaggaatacattaggaaagccaagagaacccatagaccctctgaaggaagcagattactcctgcaggacctgggagacaccccaaatactgtaagacaccccaaaaaactgtagaagtgggaaaaggagatcatctgcccctgaacatatatccccactggagagggaacctgaagttctagagtacgggagaagattccgaccttacatgcagctgagtcaatgtagagggccgagcaaaatatggggttagaggaagcaggagaaaagtccctgtgggctcgctggctcccctagcaagccacttctgcctcacctcacaggggtccttgaggaggggtgctagaggcactgggaaaaggccacagggagaaggaaacctccagctgaactttgtaacaatttgagctgatcaaaaagtctcctggccagaactggggggagggcatgaatccagtgtgcagactccacaggcaagggaagaaggaaagccctacttacttttgcagctgggaggcaagtagcctggggcaagttctcagccctgctcacccaccacctggaaacagacttggtgctgttgggaggggcacagtgagagtgagatcagccctttgggttgcctgggagctggatgaggcctgtgactgccggctttcccctacttccctgacaacctgcattacacagcagagagagccataatccttctaggaacataactccattgacctagaaacttcaaccccatcctccacagcagccatagcaagagtctgacatgcctagccctgcccccacctggtggtccttccctacataccctggtggctgaagacaaagggcatatactcttggcagttctagggacccacccaccacctgttcctccccatattaccacagatgatgctctcttgaatgtgccacctcccagcaggaggataaccagctcaaaaatagtgcactaatcaatcaaagctaaggtatcctcacagagtccatttcacctccttgccgcctccaccagagcagatgctaatatccatggctgagagacccatagacagttcatcacaggactctgtgcagatgaccccagtaccagcccagacctggtagacttgctgggaggctagatccagaagagagataacaatcactacagctcagctcttaggaagccacatccctaggaaaagggggagagtactacatcaaggaaacaccctgtgagacaaaaggaactgaacaccagcgttgagccttagaccttccctctgacagagctgacccaaatgagaaggaaccagaaaaccaactctggtaatataacaaaacagcgttctttaacatccccccaaaaaatcacactagctcaccaacaatggatccaaaccaagaagaaatccctgatctacctgaaaaagaattcagaaggttagttgttaagctaatcagggaggtaccagagagaaacaaagcccagtgtaaggaaatccaaaaaaatgatacaagaagtgaagggagaaatattcagtgaaatagatagcataaataaaaaacaatcaaaacttcaggaaacaatggacacacttatagaaatgcaaaatgctctggaaagtctcagcaatagaattgaacaagcaaaagaaagaacttcagagcttgaagacaaagttttcgaattaagcaaagacaaagaaaaaagaataagaaaatataaacaaagcctccaagaagtctgggattatgttaaactacaaaacctaagaataattggcattgctgaggaagaagagaaatctaaaagtttggaaaatatatttagaggaataattgaggaaaacttccccagccttggtaaagaactagtcatccaaatacaagaaactcaaagaacactgggaaattcatcacaaaaagatcaccacctaggcacattgtcctcaggttatctaaagttaagatgaaggaaagaatcttaacagctgtgaggcaaaaacaccaggtaaactataaaggaaaacctatcagattaacagcagatttctgagcagaaaccctgcaagctagaagggattggggccctatcttcagccccctcaaaacattttatcagccaagaattttgtacccggcgaaattaagcttcataaatgaaagaaagatacagcctttttcagacaaacaaatgctgagagaatttgccactaccaagccaccactacaagaaccgctaaaaggagctctaaatcttgaaacaaatcctggaaacacatcaaaacagaacctctttaaagcataaatcacacaaaaatacaatttaaaaacaaaaagcaaaaaaccaaagtatacaggcaacaaatagcatgatgaatggaatggtacctcacacctcaatactaatgatgaatgtaaatggcctaaatgctccacttaaaagatacagaaatgcagaatggataagaattcaccaaccatctgctgccttcagagacacacctaacacttaagtgctcacataaacttaaggtaaacggatagaaaaagagattccatgcaaatggacatgaaagtgagcaggagtagctattcttttatcagacaaaacaaactttaaggctctagcagttaaaaaagacagagggtcattatataatgataaaaggccttgtccaacaggaaaatatcacaattctaaatatatatgcacctaacactggagctcccaaatttataaaacaattagtaattgacctgagaagtaagatagacagcaccacagtaatagtgggggacttcagtactctactgacagcactagacagttcatcaacacagaaagtcaacaaagaaacaatggatttaaactacaccctggaataaatagacttaacagatatttacagaacattctacccaagaactgcagaatatacatattctattcatcagcacatggaactttctccaagatagaccatatgataggccacaaaacgagtcttgataaattcaagaaaattgaaattatatcaagtactctctcagaccacagtggaataaaactggaaatcaactccagaaggaaccttcaaaaccaggcaaatacatggaaattaaataaactgctcctgaatgatcattgggtcaaaattgaaatcaagatgaaaattaaaaaattctttgaactgagtgacagtagtgacataacctatcaaaacctctgggatacaacaaacgcggtgctaagaggaaagttcatagcattaaatgcctacatcaaaaagtctgaaagagcacaaattgagattctaaggtcacatctcaaggaactagagaaacaaaaacaaaccaaacccaaacccagcagaagaaaggaaataactaagatcagagcataactaaatgaaattgaaacaagaaaatacaaaagataaatgaaacaaaaagctggttttttggaaagatagataaaattgatagaccattagcaagattaaacaaggaaagaagagagaaaagcaacataagctcaattagaaatgaaagggacatattacaactgacaccacagaaatgcaaaaggtcattcaagggtactatgaacacctttatgtgcataaactagaaaacctacaggagatggatacattcctgaaaagatacaaccttcctagcttagatcggaaagaattagatattctgaacagaccaaaaacaagcagcaagattgaaatgataattaaaaaattaccaacaaaaaaagcccaacaccagatggattcacccagaattctaccagacattcaaagaagaattggtaccaattctattgacactattccacaagatagagaaaaagggaacagtccctaaatcattctataaagccagtaccaccctaataccaaaaccaggaaaggacataaccaaaaaagaaaactaaagaccaatatccctggtgaatatagatgctaaaatccttaataaaatactagctaaccaaatccaacaacgtatcaaaaagataatccaccatgatcaagtgggtttcataccagggacgcaggaatggtttaacatacacaagtcaataaatgtgatacaccacataagcagaatcaaaaacaaaaattacatgatcatctcaatagatgcagaaaaagcattccacaaaatctagcttccctttatgattaaaactctcagcaaaatcggcatataagggacatacctcaatgtaatgaaagccatctatgacaaacccacagccaacataatactgaatggggaaaagttgaaagcattccctctgagaactgggacaagacaaggatgcccactctcaccactcctcttcaacatagaactggaagtcctagccagagcagtcagacaagagaaagaaataaagggcatccaaattgggactcccgctgtctgctgatgatatgattgtttgcctagaaaaccctaaagactcctccagaaagctcctagaactgatacaagaattcagaaaagtttccggatacaaaattaacgtacagaaatcagtaggtcttctatataccaatagtgaccaaactgagaatcaaatcaagaactcaaccccttttaaaatagctgcaaaaagataatataataaaatacttaggaatatacctaaccaaggatgtgaaagacttgaacaaggatacaaaacactgctgaaagaaatcatagacaacgcaaacaaatggaaacacatcccatgcttgtgaataggtagaatcaatattgtgaaaatgaccatactgccaaaagcaatctataaattcagtgcaattcctatcaaaataccaccatcattcttcacagaatttaaaagcaaacaaacaaacaaacaaaaccagtcctaaaatacatacagaaccaaaaaaagagcccacatagctgaagcgagactaagcaagaagaataaatctggaggtgtcacattacctgattacaaaccatattataaggccatagtcaccaaaacagcatggtactgacatgaaattaggcacatagaccaatggaacagaatagagaacccagaaataaacccaaatacttacagccaactgatcttcaacaaagccaacaaaaacgtaaagttgggaaaggacaccctattcaacaaatggtgctgggataattggcaagccacatgtaggagaatgaaactggatcctcatctctcaccttatacaaaaatcaactcaagatggatcaaggatttaaatctaagacctgaaactataaaaattccagaagataacattggaaaaacccttctagacattggcttaggcaaggatttcatgatcaacaacccaaaagtaaatgcaataaaaacaaagataaatactgggatttaattaaacttaagagattttgcgtggcaaaaggaacagtcagcagagttaacagacaacccagagtgggagaacatcttcacaatctatacatctgacaaaggactaatatccagaatctacagtgaactcaaacaaatcagcaagaaaataaacaatcccatcaaaaagtgggctaaagacatgaatagacaattctcaaaagaagatatacaaatggccaacaaacatatgaaaaaatgctcaacatcactaatgatcagggaaatgcaaatcaaaaccacaatgcgatactaccttactcccgcaagaatgaccataatcaaaaaatcaaaaaataattgatgttggcagggatgcagtgaatagggaacacttctgcactgctggtgggaatgtaaactagtacaaccactatggaaaacagtggggagattccttaaagaactaaaagtagaactaccatttgatccagcaatcccaccactggctacgtacccagtggaaaagaagtcattaaatgaaaaagatacttgcacacacgtttatagcagcacaatttgcaattccaaaaacatatatatatactgtatatagtatatatatacagtatatatatactatatatagtatatatatacagtatatatacagtatatatactgtatatatagaaactgtagtgtatatatatacactatgtatatactatatatatacacactatatatatatactatatatgttactcaaccataaaaacgaatgaattaatggcattcgcagtgacctggatgagactggagactattattctaagtgaagtaattcaggaatggaaaaacaaacattgtatgttctcactcatatgtgggagccaagctatgaggatgcaaaggcataagaaagacacaatggactttggggactcagagggaaagggtgggaaggagttgagggataaaagaccacaaattgggtgcagtgtatactgctcaggtgatgggtgcaccaaaatctcacaaatcaccaccaaagaacttactcatgtaaccaaacaccacctgtaccccaataacctatggaaataaaaaaataaaaaatataataagcagaagcagaggatgagagtggaaaactgggctaggccagaaatggcctttatgcacttggagtcataatgtttctgcttcaccaatgattaacagtgattttcctggctaatagaatcttaatcattataatgaggtaggactgttgcctttgaattatggaaattatagctgttaagacctgttccacaaacacaggttatacatattatcacatctctttaatcttctttacagttaatcacccaagtctccacagggcttattagcaggaaggctattatctcctcttgagatccctcccactgcccctgaattgtccatgaatcctgactttactcaggccaaatgggtcagtcctcctgcagaagcccatagctggatctgtctgtgactgctgccctctctggtgtctgctatatggcaccatttgcacatccgtgtcacagggtacccattttgggtgacaaggttacaactctctttgtttacatttccatcctcagccattgttccctaaatcataaccactgtgccaggctggctggtctggaggcgcttctggagttggcctcatgctagtctgaaattagtccttctcctagaatctgaggccattttgttgagcccagatcaacagcccagattccgcccttctttaggatcactttatttccatggcttccaggaccttccctgctccgggaccttagtcagtgtcatcctgacccaatagatctctcatccccggcctccagttcgaggaaacggggatgaagacactagggcttccctccagaaggccctgggctcctttttccacacagattctcctcctgccaagtgtgcagattgtttctcggggtggctcaaaaggtagcagtttgcaagatggagtttaaaaaacagtttgttgccctgccctaatgctcccccaaaatgcctaattgctttatatttacataactaagaaagacaccaagggattcttccaaaaacaaagatcttcttcaaggtgatcttctgttctgcctttaaagagaagtagttgcagtttacttcactaaaataattaatttttgtctaaccatgtccctattttatcagtgataatgtgctcataaattatacgacagattatgtaatttgcccaaagcagaaagaggtctcagaccccaaacccatgcatttaaccactctgctttactacctcttgtcattcaattcacatgctaccatgtcattatttacttttatgtctcggatactgtactcttattagttaagtttattgcaggaatataaatctctttaagtgtaggcactctcttctgggctgttgctgaaagagagtgggacaacaggtgtatttgtgaactagtagaaaatgagtatatttactgcagaaggaagttgtgttttctctgcaaagttagatcacagaagggagaatgatacttatctatagttctggagggttgaaaccgaatagtaaatgggtgttaggatcaatacatattgttaagaaacagtgttctataaatttcatgatttaggaaagctgtctacaaagctggattaatctttttctgctgagggccaagtttactttgctctgcccctctctgtgcaagtgtaagacagtcaactgacctttcagattatcagcttaatgatagttctctctcagaattctttaaatttaagaataatgaaaaaaaagtccaaagagatctttttcatcatttctcttctccctattattattactctcctcaatgaaatgaaaatgaaatgcctgtgtatcctatttcataaaccaaaaccaagttctgacacattattggaagtttatgttgctttagaggaaaaccatgttggctataaactgttgcattatctggaaatcatactgtagattccaggaggtcaaggcgtctctggcaacttctatatatttataggagaaccgactgcctctcctctaacaaaacctcaatgagacctgactcctagccagctaagactcggcatggtcctccctgcgtcttcaaattctaggactttccctcatgtgcttgccttggactggagctgcaagctaccaagccagtgccagactgggggccaggcttacagcagagcttccacttaccccaaatctgccacagaattaattccctacgtttgacctcatattactttgttttgttactatcattgttactgctttagtattgttgttgtcgttgctttcctgtatatatttaagacttgtggcttttaaaactagtttggatttaagatacacaataagttctatcatttgaaaatgataaatatagatgtccttacatcaattgtcttcagatttcggatatatttagccttttgactttatccaaaaactaaacattctgattggccctcattttaaaagggaagaacctgtttctatttatttagatttgtatatgctctatattgggatgagggagctttttgtactgaaagaagttatgtattttcctacaggttagataaaatctgtgttttcccttggctaggtttatgcatgctgtataaacaaaggtgttctggggctcctaaggaagcggtctgaggaccatgtgtctcacctagttctcccacatgctctccctggtgactgttggcactgaccagaaaggtctagagtggtggagagagaagctaataaacaattcttgaaaacctactatgtgccaggactatgcttgatatacatttgctttgttttatttaactttcataacaatcccagcaggcaattaccattttccttattatatagatgaagagattaggtattataattaatctaatctcacagagccagaagtggcagagccaggagtaaaacacagctcagactccacagccaatgcctttctgtaccctacaccgtccatcatggatttaggtagcctggggacctgaactccccactaggtttaaggtctaattcttgaatgaaacctcacgcatttctcttaggttcagggacaatcagattgtcagagtagaaagagactttggattcaacatttgctaacccactggcttcctaacttcttcctaaggccttcactctgtgaagtaggtgctagggttccctgctaatgagtactaagcttctcaagggcttgagcaggcttgttagtctttttagggccagctgtgcaccaactatgctgttgttgtgttgaggccttagcattcctcacttcaaatcaattacttctttattaccttaatacatcactggccatgtggctgatttggaatgtaaaggagactaaccctgtaggataataactttcacttggcacacaaaatctatacggatattcagagcatttgcttttaaaaaatgaatattctgtagcctgtgctgcctgtttattcttatttagagaatttcgtcattttaataatttggtaatattttactggtaggtgcggagatatgtaaaaaaaagtgtatttttttcttttcttgtggatttaaaaaatgtttagaatttttatttgcagcctataaacaataatagtactttatcctttcttatttttgcctatattacaagcaagtaatttcatttaaattgactttaagcacattcctttgaaagaaaccgaagattgttatctttggcaatcctgattagatttcttcctcagacaacagtttattaagtttgtgctatgaatgtgggcaggtggtttgactcggtggagcaagtagtgggcactctagaattctttttctccaagtactcaaaggcctttggaagaatttcctctctgagcatttagatgttccttctactctgtgaggtgaaagtgtgttatgtggttttatttttcacttattgaatgccaattacatgccagccccagggttgtcttacatgtgttatcatatctcatttaatctgaaaaaggattatggcataggcacataatattatcttcatctttcagataaagaggcataagttcaggtaaatacatatcccagtagttacacagctagtgcctaatgatagcaggatttaccagatctgtctgcctttttcaaatataacaccttgcctgggaatgagctagcagaagacttttagaagatgagactggagaagtggcttcaaatttcattctaatcaagacactaagctttgcatttatttattccttcattaccatttattgggcacctaatgtgtgtcaaacaatctaggaattggcgacattacaatgaataaaaagcatagatccctgtcttccagaagtttacttctggttattggaggttttgagccaagaaatgacatgatctggcttagcttttacaaagaccctcctggctacagtgtgaagcatcacctgaagagaggtgagggcttcagcagcaagcccagttaggaggccactgcagcaatccagacaactgcggggcttggaccacagtagtggccaagatgagaatttggattttatatggacttagatggaaacaccaatgggattgctgaggaactgaatgtagaaattgcttgtccatgttttaactgcaactatggtcagcctgcatcctaaacctatgctttttaagttatgttaacatgctgaagtacaaagtgacttcacaactatattcaatttcatgaaaaactgtagctcctccttttcagctccttaggcttaggaaaggagagtgcctcttggagcctggaagaggcaggagagagctctgtgtcccagaagcatttgtcatccaggctgcagttagccagctggctccttcaaaagccacacacctgggtggcagcacatatgtggttatacctgagatatgtggtgtgtccatctcagagccactcaaagtccattttaacccttccctatggctccccatgaggaggtgggaaaacgaatcctcttaataagatttaagcacagcttcacatttttctgtctttgttatttctcagaaatgccattatcagtctgagtcagaacagatattaattcttggtcacaaagtagcacttttggcatactctcaccatttttttaacttcagaaacagcttccttgtaggtaactttcactgagctgacattgtcagccaaaaatggttctggagccacttcatctgccataaaatttaataagtccaggatacaaatttgtgtatcacaagtcaataaaattgccaccaagctgtttgtgtagtaataaggtcaataaatgtcatcctcattcaattaattttcattgaccttaaggaaatgaccttctatttccaagtaggagaagaaattggccatggagaagcataactgttgcatctgcttttcagttattacattactgaagatagcatgggcatctagctatgcttgtatattcagactaaaaagtaatctacatggcttatcctgaagtagacccaaatgatttaattacaattaagatcattgaaagaccccacaatatgcttggggtcatcctaactgcatcttccagatatgatctaatatctcactgatcttggccatccattgggttctgctgggcaggatatcaagttaaggatgtgatgagaggctctcactttctggcctgcaaactgcatttgtcacaacccctttctccattaacctggcctggagatcagccctgaagttgctcctttgctgtgctggccataccctgaaggagacaaccacaccagtgagagttgaatgcctctgatttcctccttcctccacaaggcagatgagggaccctgccatttttttataaaattcaaaatcaactaaagtatcacttttttattttattattttcccagggctgcgtccaaagaggactctgcggctggtgctctggactgcagaagaacaaggtggagttggtgccttccagtattatcagttacacaaggtaaaaacccagctgtggattgctaagcatttgtacatgtaatatacaaaaatccctctcattgtccatttaagacttcaataatactttctggtcaactggccctaggaaacacccttgtatgagccttctccctccagccctgtgaatgagaatgcactggtaaaccaatgatgctgtggtgtagagctgagggcttttcttcttctacaccacagtctgaggccaaagaaaaattccaattgccatgctgccatttttttcaagtctacctagttctgctgtattcatgtatgtcagagaaatagttataggcaaacattccctctccccaccgagcctatccccatacctcaatgcccgccatattcccagaagccttggcatttgagagccaggttccaagtcattgagtctgccaagagcattgccatgatggtggtggaaatggcagcagccacaggcctctgtcccaggaatgtggaggacagcttggtttgacaccagctgtcattacacaagtgtgaagcttgaagcaggaaggttattgtggatggtcatgattagaaatacaagaccacatggaagagaggggatagggagattaatatcaagagcaaattttgagacagcaaaatatacaagctgagaaatactctagatcaagtcaaatgttagttcaaagaggaactccaaaatcaacgcgcatatgctggcaagcagtgatggttgcccagagaggagcatttggtctgctgctgctgctggatggtttcccctgaatgtccagatgagaagaagcagatcttgcaagcttaaattatccaaatcggagaagggtttcttttgtgaattgtgtgtatgttatttttgaccttttttttttttcaaagtcagtctctattaccctatttcagtcagttagagtataatgagttcaaagtcatgaatttggtcactgaatacaattatttactgtacaaaggacaacttatgacctatgccctactctttcaccactttagttcttttggcctcaggtgatcctggggataacataattcaagacaagtgtcctttggttggtaggtcagtaacatcattttctatgtgttgtggtagaccacaacatcatataagggttgttctagattcagcaacattcaattaatattttctgaacatgtactatgttccatacactatgttatgcattaatgttagcatcaaaaagatctaccctgaccttacaaagcctacattctaaaggacactgacgattaacttgaattataaggtgttaagtctttctgggaaagaaattacatctaagctgagacctgaagactgagtggaagtaagctaaggaaaatggagagggagggaggaggtgggtactgcaccttggcagagggacctgtgtgtgcaaaggcaggagatgagacagaggaaagcacaccagagaaatggaaaggaattcagagtggctgctgcatagaatgcaagatgcacagtggtaggagggtggaacagagacgtaaacaagagcctgaacaagaagaacatatgaatcatatttagacgtgcggactttatcctcgaggcaagagagtaacttatttttaagaagaagctctaaaattctatacatattggactttatataaaaaaaagaatagttaaaagaactattcttttttttttttttttgagatggagtctcactttgttgcccaggctggagtggagtggcaccatcttggctcactgcaacctccgcctcctgggttcaagtgattctcctgcctcagcctcccaagtagctgggactccaggcgtgtgccaccacgcccagctaattttttgtacttttagtggagatggggtttcaccgtgttagccaggacagtctcgatctcctgaccttgtgatctgcccgcctcggcctcccaaagtgctgggattacaggtgtgagccaccgtgccctcttttattctcagtaatacactctactccaagaaaaatattggatttaaattgcaattgatctggctaaaaattttatcatcactgaaattcctagaatgtgaaaaaagaaggtttatttttctgtaatgtgagtttcactgtagcctatcaaagcacatggatgaaatcggaaatgcctaaaattctgaggttggcagaaatacacacactcaaaggacatgcaatcacataaacagaactactttatcttgacagcatccaggctgcctccatacaaatgtagcttcatgttggtggctagtctgcattgcattttcagagatagaaagaagaaattccagaaagggaaaacattggcattttgttttacagtaactctttacctcgcctttaaaaagacattgtgcatgctttacatgatacagccaatttcaaaggacttattctggattcttatgattagcatattgatattgacattactaagactataatcatttcaaaagtggctgagtttaacttaaaagttaatataataagcaagtcacaaaccacaagggtaaattagattgtctttagacttctctgtggcattactgaatgccagcagacagtccaacaatatccagttcactccagtcacaacagagagatcatctgttccaaataaggttatgctaactgctgaaacaaataataggtcaaatttcaatgacctaacataacccagaaatatattccttgctcacttaacatccaatctacagtagggctctgctttatacaggtattcagtgatccaagctgacataccctttaaaaacatggctttaatatgcctttgagtattgacatccagctggcaggcagggggatagtaggaggtttttatgggacagttctagaagtggctgacgtcatttctactcacactccattggcaagaactagtcatgtagtccaactgtgtgagaggctagggcatacaggcactggctgagcagccacttcccaacaacagctctatactgtaggctgggagcattctatagctatattctctatctttggcagaaagctgacccactctagggtcttcctttcacttcgttctggctttctaaacactttagctgcacaagaggccaactgccctgaggtctttacctcccatggtgctcaaagttgagatcagctctgtgagctgcctaaaagtactcatcttcaccactaccaggatgcctttgtctagcaacacacaaaaagaaaaggagtcacagtctttgaccagaaggaccttacattttacttcaaaaataactttaaatgcacacataagaaagttagtataacaaaccatatataatgaagttttaaataatgtactaaaagtattttatttttatggatgatgctatcattgacaaagtgccaaatggtgtaaaggctgaacagagtaaatggaaaggatttagaaaagggagaaatcactatggcatgttagtcgtgaggaaggaggcaacacctaatccttgcagagcaagtggatttcagccagtgatcaagaggggagagaagggacagcagctcccctttagatggatgataatggagtctcgaggtctgcctttggcattggtgtgggtgataccaaataagaacagaacttttatggcgggggtggggagatctattttagtgattgtagaaataaaaggtgtgaactttttaaatgactctgctaacatttttatgatacagttatggttattagtgatctatgtcaggaatcagaaaattatagctgatggaccaaatccagcctgccacttgtttatgtacagacttcaagctaagaagttttttcatatgtttagctgattatgctacagagattgtatgtggcccacaaaacttaaaatattaactatctgggtctttacagaaaaagcttacctacttctggtctataatgataaaagtcataaaatatcatcacattatttgtatacaatgatctctttctcgtttgtatgacctaaaatataattttgtaaattttgtttcgagcctaatattagcctatgtaagtatattgtaggaagatattattgtaatgataaaagcttgcatgcacaatctttttttttttttgcattcttatctggcagtctttaataataaagttggctaaacctacatggcactagctagggagaaaaacaatacgtagattattatttcttctttttgtttttctgaatgtaacattctttcttccccctcacaaagtcttttcaacagcgaaagttctacaaaggctattttaataataaatcagtttgtggaataatgaattattaatattcattatcctttccttagtaaatatatctttgtttacactgtactctaattaatatatgcagaaaatataaaatagttattttaaattgtgggtaaaatgtattgctgaactaattttcaaaattgtagttggattaaaagctacctttacttcataattatgctttcttatgacatatcagctcaattattataatacgtgctagaatttactaaatttactaaacaatttattaaattataaaggatgtgaggctatttatagcttgtgtatacattttgaaattcatatgcaactttattataatgtctaaaacacttcaaggaaacaaactttggcaaaaatggtctataagcattttagtagcagttactaagtaaataactcaaacaggaagtgttgaatatctcactgtagtactatacactagaatataaatcattcctgagatccattcagcatgcctctaacagttcatagcggaaagtcccataaaagatttctcttcttaagaaaatgcaagttcacatgtttcaataagttgttaaattttctctccttattttaaagtccttttcaccatgtctttgattgtcttggtattagcacataagcttgagaatgacttatatggacagtatattgtttgtgctttatttagaagcttcttttagaagcaactcatttttcttgctgttttattgaagtttaattagcatttggtaaatgcacatatcttaagtacacagcaaaataaatttggaaaatgtatacccctatgtaatcatcccccagatcaaggtatatagcattcctattaccctagtaagtttccttatgtccccttcaaatcaacttctgactctaccaaagacaactactatgctcctttgtaactccagattggttatgtctgttcttaaacttcatataaatggaaccatacagtacataatcctgagtctgacgtctttcactaaacagtatggttttgcagtttatccatgttgttgcattaacagtagtttgtccctttctattttttttttttttttcgagatggagtcgtgctctgtcccccaggctggaatgcagtgtggcacgatctcagctcactgcaacctccgcctcccgggttcaagcgattcttctgcctcagcctcccaagtagctgagactacaggcgtgtgccaccacacccggctaatttttgtatttttagtagagacagggtttcaccatgttggtcaagatggtctcgatctctcgacctcgtgatccacctgcctcggcctcctaaagtgctgggattacaggtgtgagccaccacgcccagccatccctttctattactgggtagttttctattgtgtgaatataccacagtctctttattctccagaacgaatgaagcaagaatattctgttgatggacatgtgagttgtttccagttttagctattataaatgaagttaccatgaacatttatgtacaaatctctgggtggacctatgcatttattttcttttctgggagtataattgctgggtcatatgataggtgatgtttaactttaccagaaactgctgaagaggtgggaagttgtaccattttacatttccaccaacaacatgtgggagtcctagttgctccctatctttcccagtatgtggtatcattagcctttttatttttagccattcttataggtgttatgtgtttatatttttcaaagtacagttctgaagagttacaagaaaaatcctgactcctctcctaatggccactattcttttgccctccctgcttcttcttgccttaagactttttgtttgtttgtttgtttgtattgttttgttttcttttgtatttgagacagagtctcgctctgtcgcccaggctggagtgcagtggcgcgatctcggctcactgcaacctccgcctccagggttcacgccattctcctgccttagcctcctgagtagctgggactacaggcgcccgccaccacacccggctaattttttgtatttttagtagagaccgggtttcaccgtgttagccaagatggtctctatctcctgacctcatgatccgcccaccacggcctcccaaagtgctgggattacaggcgtgagccaccatgcccggccgccttaagactatcttcatttcggtgttctgctttatgatttcagggagaccaaaggcctttttaccctgcatgaggtttgtggggctgttcatggttggagggaccttatttcaatttagagaaacatcttggcaagaggaggacatagaaatgccgtcctgctcataaccacggccgactcccaagaacacatgggggctgttgaaactcaactggagcccaaaggggaggacgattccctcaaagggcatgaggaggaagatttctcttttatgcccagaaaagaggttattctagggagaggggaaaagtccagaaaatgcctttatgttattctttattgataaattacattttttaaaaatatgaactctattggttaaatttaactggcattcacttaaaaggaaactttaccacatagagaagcatgttattgcactctagtgaataagagtttcattataggagtggaatttgactttgaaatttgaaaatatagatgagtttattgaattttcaaatcagtgaataaagtgagggttgtccaggtaccatttgcctaatctgcttttcatgggaataatgttgctgtcttctcttctcttctcttggaaggagaacaggatgtcatttctcatgtcctgaaatggacaaaggagaaaaaacatacctagcttcaactggatttctggcatttgttaatcttttccattttaaggaaaaatatgatctggcataattataatgagtaaggtaatctggccttgagaaagcctcattacacaaggtaatcaaataaaatagattgatatgtcttattctggcatgaaaaatattttaaccttttcctgatttattgcacaaacttctggcaattgaattacagggataatgaacactgttgtgttctggtagtcattaataagggcaatattttaaataggctttattaaatgagggatgggatgtatggtcattccaaatacacgaatttatctgaactctagccaactctaaaactgaaaaagcaaaattgaatattttgtcacaatttcctgttttgtcatactgaggaacaaaaattcctctttatgtatagaaatacactaaagtgttagcttcttttagcagtgaagttcttgccagcttcccaacctgcattaggtttcatgtttcactctaaaataaaagaatatgttagaaatgcttttgagacttcttcgtgctatctgggcaaatgtgtttctttggcatttttattttactaactctatttcctctatatgatgctaatttagatagagtgacactgctagagtaagggtattatactcatgttgagctctggttatacaaataatagagctgatgtactcattcagcataattgtgtccggactatgtctccagcacagcctttcttatatctttaatgttctgtgcagtatagacgtactaatcagaggtgattgtctcaatcattactgctgggcctttatgcatcctgtatttttctttcagtgcctagatattgcattagtctctcaagcacatcacaaaactggtttaaatttcatttgtctcagtgttttcttggtctggagcctttgtagttcctatattcacatgatttatactgcacacctgggagctcttaagggtcttattagaatttgtggattttatttttgtaaaaaaaggaaaggattgtcttttgagtttgctttctcctgtgtagaattccattatgactaggggacttctgaatcttatgtacatatggtaattatatatcaatgtatgccagtctaggcagagctatcaaaatatcccctttgatactaggagaatcatataccaccttgcgaataaacatgagtaggtttcaactcatctctttgctttatcgctctttagaagggatccttcttaactggcttttattatatttttctatataagagaaaacagtttaaagtaaaaagactatgacaactagaatggaattttttcatgtttctgggagagcaagaccttgcctaccattctgagataattttgtttaattcaatgccttatggtttcagattatagtgaagtttgacttgagtgttggttttagcccagtacctttaaagaaaagagaaatatcccaacttttctgctaccattactaacctaagtaaaacaattgccttttaaagttactcctaagaatgttgtgccaaaactttgaggtttcttgtcaattatttggctggcatttattctcccctcctgaaaccgtgaagaatggcttcagcttgtatctagtctgttttaccagcttacaggagagtgccttctggcacaaatagtttctgcctcagtgcctccctactcctaaccaggtcatgacctgacccagaaggacccataggatatctagtgcatgaacttcctgaggaaatcaagttggcacaccaggatgcacaaatctgaactgaggcatcatgccttgggctcacaagtgaactgcatgggtcagaggctttgggactaaattatctcattacatgtactggggccttactaagttacagagtcagcaaaccacttttcaatcaccagcactattttatttggcctgaagttgtcttctgcccttttgttttctaaatcaggggttggcaaactttttttttttaacagtccagataggaaagattttaggactgcaggtcatatggtttctctactcaactctcattgtaggcagtcatgggcaaaactagacaaatgagtatggctgtattccaaaaaaaccgtatttacaaaaaaaaaaaaaaaaaaaaaaaagaataaaggcaggtcagatagtttactgacgcctgttctaaactgttacaaggcagaagtttagaaaactttcttctgaagccttttcttatatcacggtcacagcttttagtgaaagagatttgtagcacatagtggaattctaacgtttagagattatgtcttggtaggctaataataggactgttggtaagcttagcatttacaaggttgcagttgtttccctgtaggtatttggccaacagaggccaacagaacacaccatcaccagatcagtctagtgccttacttatatcccactgagccacacaacaggcataattaccttgttggaggaagaagttaatgtacttcccgagtatttctaaaagcaagaacagaaccctttataaagatagctaaatgtgtactggaaaatatattttaaaggatatctattttaaatgtttacacatatagaagggtcttttagagaaatgaacattccaatacattttggcaatttcactgtttaaccacatcctagttttgtccattggtttgcttacactatttcttttttattttttttaatatttcctttcctttttaatattaaacaattgtgattcttttttttttgagtgacttcttttattattattattattatactttaagtttagggtacatgtgcacaatgtgcaggttagttacatatgtacacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtaagaacatgtggtgtttggttttttgtccttgcgatagtttactgagaatgatgatttccagcttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccactgatggtgagcattttttcatgtgtctgttttctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcctatttgtcaattttggcttttgttgccatcgcttttggtgttttagacatgaaggccttgcccatgcctatgtcctgaatggtaatgcctaggttttcttctagggttgttatggttttagttctaacgtttaagtctttaatccatcttgaattaatttttgtataaggtgtaaggaaaggatccagtttcagctttctacatatggctagccagttttcccagcaccatttattaaatagggaatcctttccccattgcttgtttttctcaggtttgtcaaagatcagatagttgaagatacgtggcattatttctgagggctctgttctgttccattgatctatatctctgttttggtaccagtaccatgctgtttgggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattgccttgggcagtatggacattttcatgatattgattcttcctacccatgagcatgggatgttcttccatttctttgtatcctcttttatttcattgagcaggggtttgtagttctccttgaagaggtccttcacatcccttgtaagttggattcctaggtattttattctctttaaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatatcacctgcaaacagggacaatttgacttcctcttttcctaattgaataccctttattttcttcccctgtctaattgccctggccagaacttccaacactatgctgaataggagtggtgagagagggcatccctgtcttgtgccagttttcaaagggaatgcttccagtttttgcccattcagtatgatattggctgtgggtttgtcatagattgctcttattattttgagttacgtcccctcaatacctaatttattgagagtttttagcatggagggttgttgaattttgtcaaaggccttttctgcgtctattgagataatcatgtggtttttgtctttggttctgtttatatgctggattacatttatagatttgcgtatattgaaccagccttgcatcccagggatgaagcccacttgatcatggtggataagctttttgatgtgctgctggattcagtttgccagtattttattgaggatttttgcatcaatgttcatcaaggatattagtctaaaattctcttttttggatgtgtctctgccaggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattactgccacaatttcagagcctgttattggtctattcagagattcaacttcttcctggtttagtcttgggagggtgtatgtgtcgaggaatttatccatttcttctagattttctagtttatttgcgtaaaggtgtttgtagtattctctgatggtagtttgtatttctgtgggatcggtggtgatatcccctttatcattttttattgtgtctatttgattcttctctcttttcttctttattagtcttgctagcagtctatcaattttgttgatcctttcaaaaaaccagctcctggattcattaattttttgaagggttttttgtgtctctatttccttcagttctcctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttggatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttccagtttgattgcactgtggtctgagagacagtttgttataatttctgttcttttacatttgctgaggagagctttacttccaactatgtggtcaatttttgaatcggtgtggtgtggtgctgaaaaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattaatgtgtgggagtctaagtctctttgtaagtcactcagggcttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagaatttagtccatttacatttaaagataatattgttatgtgtcaatttgatcctgtcattatgatgttagctggttattttgatcgttagttgatgcagtttcttcctagcctcgatggtctttacaatttggcatgattttgcagtggctgctaccggttgttcctttccatgtttagtgcttccttcaggagctcttttagggcaggcctggtggtgacaaaatctctcatttgcttgtctgtaaagtattttatttctccttaacttatgaagcttagtttggctggatatgaaattctggtttgaaaattctttcctttaagaatgttgaatattggcccccactctcttctggcttgtagagtttctgccgagagatccgctgttagtcttatgggcttccctttgtgggtaacccgacctttctctctggctgcccttaacattttttccttcatttcaactttggtgaatttgacaattatatgtcttggagttgctcttctcaaggagtatctttgtggcgttctctatatttcctgaatctgaatgttggcctgccttgctagattggggaagttctcctggataatatcctgcagagtgttttccaacttggttccattctgcctgtcactttcaggtacaccaatcagacgtagatttggtcttttcacatagtcccctatttcttggaggctttgtttgtttctttttattcttttttctctaaaaatcccttctcgcttcatttcattcatttcatcttccatcactgataccctttcttccagttgattgcatcggctcctgaggcttctgcattcttcacgtagttcttgagccttggctttcagctccatcagctcctttaagcacttctctgtattggtcattctagttatacattcgtctaaatttttttcaaagtttttagcttctttgcctttggtttgaatttcctcctgtagctcggagtagtttgattgtctgaagccttcttctctcaacttgtcaaagtcattctccatccagctttgttccgttgctggtgaggaactgccttcctttggaggacgagaggtgctttgctttttagagtttccagtttttctgctctgttttttccccatctttgtggttttatctacttttgttctttgatgatggtgatgtacagatgggtttttggtgtggatgtcctttctgtttgttagttttccttctaacagacaggaccctcagctgcaggtctgttggagtttgctagaggtccactcccgaccctgtttgcctgggtatcagcagcggtggctgcagaacagcggattttcgtgaactgcgaatgctgctgtctgatccttcctctggaatttttgtctcagaggagtacccggctgtgtgaggtgtcagtctgcccctactggggggtgcctcccagttaggctgctggggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcagggctccttgagctgtggtgggctccacccagttcgagcttcccggctgctttttttacctaagcaagcctgggcaatggtgggcgcccctcccccagcctcgctgccgccttgcagtttgatctcagactgctgtgctagcaatcagtgagactccgtgggcatagtaccttccaagccatgtgcgggatataatctcctggtgcgccattttttaagcccgtcggaaaagcgcagcattagagtgggagtgacccgattttccaggtgccgtctgtcacccctttctttgactaggaaagggaactccctgaccccttgtgcttcccgagtgaggcaatgcctcgccctccttcagctcgcgcacgacgcactgcacccactgtcctgcgcccactgtctggcactccctagtgagatgaacctggtacctcagatggaaatgcagaaatcacctgtcttctgcgtcgctcatgctgggagctgtagaccagagctgttcctattcagccatcttggctcagtatttcttttttaaacctgaattattttctgggagagaggctcttcccaagtgacccaaagatcattaggtctttgggtattcagtagcccttctggaagttcatcttctacttctggttactgtgattttctgtgcttccacgacactaacacgtaaacatcaaagagtggtctctctaagacagcttgaggagtgcacgagcagaagtactggcagggctgttcataaagccaatgccagaaagcagctcctcgctggcacatccactttgtactttgagacgcagtatccagaagccaggatgggcaatacccaaactatgttactttaagggctgaagatcaggcagggaactgagccccagaattgttagacattgttgtgagtgcaaagtgagcacttttgtctttctttctgctactcatcttacttgatcattcctgagtatattaaccaaatcctgtggtgtcttaaagataccatgtgtgccctgagaggctggtctcggtctagctttctgatttccttatcaattgggtcacatctgtattttctgctgactcacttatgtgtgtaaaaaacacaaaggcatacttttttttttcctaagcagatcggaacttctattccttttttttttttccagaagacctctctcgtgtactctcatcaaatgcttgtcctacatttgtaattattcattctagaagctgaggttgcccctagcaaccagcagttttgtctaaactgttttggtttcagggttgtcttaaaggagagtttctcaaaatccatttccaaagagcttttataccccacacagcaaaacatgtataaacaacaattcaaatttagggagcttaacaaggcctttcaacaaaggtttaaagtggtttcatcatatgatttatttaagattaaacagaatttctgttactagttaaaacgggagtgtaatttgcttttatggattcctatagtttcatttaataaaactcatccaatcagatgcactccctcccctgtgaaatcagaggcagtgccatatttgtaaatgtgtttcaggcaactctccaggtagtaactgagggctggaagaacgtacagcatccacctgccctcactgccatagctggcagtgttttttcccctccaaagctctggaaaatactttattataactcacagagccaaatgagaggcaatcaaactgttttgtcatttgaattaggaaaggtcaaagggaaaggaacataatagtagacagacagaaaagtgctttgtgaaaattacccattttttccacgtaaggaaaagtaatttgttttttttcagtgctagagatttttgttttgatagatttacagagagaaaagaaaccaccaagaattttgaaaggtcccatttcccaaacaaatatgtaacaagttcttaccatttaaaagatggcattataatctcttgcatctatgtgatcatttataaattacgctttcgtggacatcaagtcattgatgatagtaatgaccctggtggttgccagaccatgtactgttttccttatttcacacatgaagaaacagaggctcaaagaagtgaagaatgtacccaagtttgcatagcacagcccataaggtgcagagcctgaacttggacttcagccatgacttctatgaccacatacttctctgtcaccatcttaaatgtagatatctactaatttgtcataaactgaaggacatacatagcagcatatttaggaatgctggataatcagtaacatataaatagatgaaaggagaagttgcttcaaggtgcttagtttaaaacacatatagcatggtatcaattctatacaatggccaaaggatattgtgtaaccatgcagacatcagttgtcactagtaattctcaatgttttatattcacactttcttggtataaaaataaatatttgtatttgttcacgaagttaattctataaatcctgctacaatgagttttaaaaaaataaccaacaacacttcacttcagtcatctgtgtaattttcctttagtttggggcattttctaggtaaagttttagctaaacaatacagaaaaattaaaaagttcagagatcttttaatgatatgaaaaactgtttctaataataataaatgttaaaatcatttcactattcaaaagactgcgttcagagcggaggcaccctaacatactactctaggacatttctcactgccttcatcttcaaataaaagtgagaatagaaccctaacctttgagagatggaaataatgcatgtatatgtctgtttttatatctttcccatgtgtatagagcttagacactctatatgtgaagaccctccaaaaatcaagtctggctttcttctttcaggataaccattcccgaaacaccaaggacagggatacatcagaatggacccctacctgtgctatatttaaagatctccaaggatagagattttacgtatgtcagtattttttaacactatcagacaatgagaatattcctggccaggtccacttagtgatttcttcattgaaggatacaatttagaagattggaggagcaattataaaagaaagtaatacaatttagaagattgggggagcaattataaaggaaagtagctgtaggtctccaaaagttaaagtcccttaatcccagttgccttagtagttcttgcatgaaagcactaaggaaggatcaatgactgggagatgggatgaattctgaattgcaaaagagacatttaaatattacttgcaaactaaactcaaagcacaaataatttaacactgttttgttttagtttctaaaaaagtggactctaattcattctttccttgttcaggagataaaactatttgtaacctttaacatgttcttttcttcacagttgagagctcagtttgttaatactttctttcccaaactgttttctgaatgtattggaaaactgcacctgccagaatggattggtgtttgttcttcttcaatgaaaggtggctgtgatcaggagctgccccttttagagagcttaagctgccaaagcctaatacaacagaggtggaacggaaaatgagaatgaaggacatattcaaaaatttaacaaattgttggtgcctcaggcatgaagcccattggtttccaaagaatttggcagaaagatttctatcttctcatcttgtaggcaattaccttaatatggcacacttttgtgatggctttcattgaaaggctctgtttaaacatctttttctgaatcaccaagataagaatggagcaaatgaagggaaaaaaaatattcacttgtacacaaagctgctaccttcaattctctgaaattgtagttaatgcctaattatactgacattcctattgtacaaaagtgttgagaatgcaaatataatttcccagctaattatttcattacatggaagtgacatgagtgaagtaataaattagcatcgtctttataagaaccagcaattctggactttataatattgaaattttcaagtggagtgaagtgcttttttcttatgactactctgattaggtgaaaaatgccttttaaatttatgtgtataatacacctccttccttcagcagatattttaccattaatataggacagtgatatttatgtgagtacattattactgagaaggagacccaaaggatgtcaaagggcagagctgccagctgcgacagtctggcttgtactgcttttcttaaatgtggttcaaagcaatcagattatgaattgcagtgaaataaacttacttttatttttaaaatacaaccaccattaacagctccccagttagaacaactgaatgtcaaataattgcattctcaaatttaaactagaaaatagtagagcttgaggaaggggagtggaaactcaatagtgacacattgagatgggttagaaggtattcagttctccatttctttgatttaaggatcgtcaattgttagtggtgcgattaaaattaatacaaattttcaggaaaaataaaactacattaaatgcacaggggtttttaaactgacaatatcatacagtgcccaacacttttgtttttagaatcaatccatgtctaaaataccttcaatccagagtctgcagatgtctctgaaccctttggtcattagcagtgaagcattggcattaaggtgccaggccactttgtgtcacccatgctccttgttttgacaaggtgctaaaggtgtacccttgtggttggcagcctattacaaggcatattgaacacgtttttcctctgtactttcaatttggccaagttttttacacttaatttttaattttaatatttctgtaagccatatagcttctcctgaaactctaagggagcttttggcaaattgcttagtacctgagtgggaggcctccatgattcatggctggctacaccagtctttgctcaccttgaacactctagagtctattctgaagatttggcgatttctattgtttttcattgttttgcctcacacatgaaaatcaatcttctgtgtacatcaaaatataatgaagaattttaatcaataattatggactgtaatttaaaatttaatgatctgtgttgataccagtgtaaataagtgaagtgtaaaatacattatccagggccctttctgtgtgatgaagtttgcatgtggacaaacaatgacaatgaatatatgaatacaatacaatgaatatgtttgtttatttgcctagaatttggtaactttcttatggaatgcatcaataacaagatacattccaatttccaaaatgctaaaaaaggagaatactgtgattcttacatttagggaaatatggtattttatcttttgaattttatactggcagaaacaggagatgcaaaaaatcagaaaaacaagccagacgtggtggtgcacatctgtaatcccagctacttgggaggctgaggcagaaggattgcgtgagcccagggtttgtgatcagcctgagcaacgtagcaagaccccatttcaaaaaaattagaaaaattgtgcttaagtagccttttggtcctgatttgcttgagagtccagcttgtacccattgtcctgacataatcattaatagaatcccttttcactctcaaaagtttcctggcctacatagcaacttaagtaatggttactctacttattagtcacttttgttggtaataacaatgcctcgagagaacagaatagcttggtatattatagcccttcaaataaatatattaaatttatataatcctcagaacaaccctattaaatagccctttctttttgatgaggatatgaagctcagtgagattaatggttgccagggtcatttagctattatgtgacagaaccagtactccaacccacaggtccagggcaaattaattccattgagtttaataataataacactatgaatgatcatcataatcaccattactaccttactaataaagctaccatttgcccaacagaggttcttgaccattgctgtgccacaggccactttggtaatctggtgaaacctatggacctcttttcaaataatatttttgaatgcataaaataaaatgcatagtattacaaggatatgaattttattaaaatatagttaccaaaaattttaagctaaatttgcaatatagttatatatgtggttttccaaatgaattaaacaagatcttgaaggattatttaattatgactatgatatcaaagtaatgatgaacataaagaatacttagagatttctgcaacaagtctaatgtgatatgaaaagatctatgatttctaccagcaacaaagtgacaggttttgctaatactactgaagtttgttgcttacattcataagtaaagaaaattctaaattttacatagaggttagtaaaaataaagatgtaattttttcccattcaagttcacagagctcatccaagtgtatcaacccccaagggaccccgattaggacttgctgccttggaataaacctgcaaaacaactattattcccattttacaaatgagtaaactgaggctcagagtaattaagtaacttgcctaatattatttaccttatggctgagaagtgcatcaaatggcattggcacttgtacatcacctccttttgctccccagtggcaagcactatagaggtgggtattgtagtgtccacccctctctgagactgacaaccttttcagcatggttgccctagtcacttgcacatcctttaaacaccaatgatgcccttgatggagaacacagatatccaaagagaaactggaggagaggtctgagtgtctgactaatgctttttattcaaccctccttgaggatttctagtgttcagtatcccgtcagtggtcctcacatggctccccagaatgatcattattcccgacatatttgctgctattttctaccatagctattttcctcttctacctttaggtgattattgctgctacttattactattctcagatgaaggaaattgtttttcttcacctcccttagttcaatacaggtacctatttggattttttcagtaattgctataattccttagcctctctttatctaaactatacccattaaattatgttaactcttctcaaagctaaattgcctcatctgtttattattttcctcatcttgcctgaatattttaaaacttacaaaatatgtgaagcgattgttaaaaatctaagtagtcccaggacacatttattagttactgtaattgagtcttactgattacacatgcattataagcctcatgatgtgctaactttagcacaacaaagatacagttttaaaatattatatatttaatattttttaaattctatgttgtcagttcagttactgttgctcatctccttctcctcctgagtaatggccaagttattttggtgagtctaacatatgggagtctcatctttgatagcaaaatgatgatgacatatagtctactgagaatatattcagccctgttttcacctgagaaggaggagattttgccacctagcctccaaaataagagcatcttattccattattgaagggacctttgaagtttcacttgtattttgataatttatggccacttcttaaaaaatcactatcactctatatatcctcctggaaagcatttgttttagcacttataatggatgttgtaaacatttgtatattattaagtgctttataacatacacagtaaagattcagctaataactttaattgtggaactgtaggttttcttgagaacatttttttaaaaaggaaaacagattctgaaaaactgatgttattttatcaccaacatgagtaaccacatcatcatcatcaacataatcattatcttcaccaccaccaccatcatccaaaatggcatctagttacatgctcgcatgggttcacatatacaaatatacacacatatgtgtttaaacacacacatacatgcatatatttattcattcagtcagcacatgtttactgagagcctactaagtgccaggcagtgttttgaggtctgccctcatcttgcttccattctagtgaatcaagactgataataaattggataaataagtaaaattgtatgttagatgaaaataactgctaaggagaaaaataaaacagggagcagagatagagtacatgaggagggggctgttttaatttttgatagaggggaacaaggcagactttatggaggtggtaatatttggttaagacctgaaaggatgaagaggagagccacgtggatacctggaggagagcattctagcgaagatggagagttgttccaaaggtgctgctggaggccatgcttgacattcaggggatagggaggaagccaatgtgcttgaaatggagcagtgaaaggaaagcagtaggacaagaagtcaatataaagaagcccaggcagagtcaagccccatgggccattttctctgagtgaggttggaactatgggaggcttttgagcataggagaaacatgatctgaatcaactttctaaaataatcattctggctgcttggttgagaacagactaaaggggaaccagaatggaagaaagataatagcctaggcaagacaagagtgtagtttggaacaagatgatagctgtggaaggcatagcaagttgtcaggctgcagataatattttaaggaaggagcgaacagaatctgatggtggattgcatatggagtatgagagaaatagaggagtcaagcataaactgacagtttggggcccaaacaactgaaatgaggggagttaggcagggggaaaagggggagataaggagtatgggtttgaacctgttaagtttgagatatcagactttcatgtggagaggtcaagtaggcagtttggtaaaaagtatagagttcaatgaattgacatttctcaaaagaagatatacaaatggccaacaaacatatgaaaaaatgttcaacatcactaatcatcagggaaatgcaaataaaaaccacaatgagataccaccttacccctgggagaatggccattattaaaaaatcagaaaacaatagatgttgtcgtggatgtggtgaaaagggaactcatacactgctggtgggaacgtaaattagtatagcctctatggaaaacagtatggagattcctcaaagaactaaaagtatatctaccattctatccagcaatcccactactaggtatctgcccaaaggaaaagaagtcattatatcaaaaagacacctgcacatgtacatttatcacagcatggttcacaattgcaaagatatggaataaacctaactgtccatcaatagataagtggataaagaaaatgtgttacatacataccacggaataccactcagccataaaagagtgaaataatatcttctgcagcaacttggatggaactggaggccattattctaagtgaagtaattcaggaatggaaaaccaaataccacatgtcctcacttataagttggagctaagccatgggtatgcaaagacaaacagggtggtataatggacactggagacttagaaagggggagaatggcaggtgaatgaaggatgaaaaactacctattgggtataatgtatactattcgggttacgggtgcactaaaatcccaggcttcactgctatacagtgcatccatgtgaccaaaaaaccactgtacccctaaagttattgaaataacaaaatgttttaagtatagagttcaggggggaagtctacagatagccataggcatggagttttcttcatataaatgctccatctgaatggaaaataatagttaccctctcacaacacccctgtccccctgtccaatggaagctcagcttctatgttttcaatgctgtgattgttggttttgctctccagggaatatagtgcccttagaggctctgtctcttcatcttgaagatcccctggtcctagggtctggattctccacaagcctcctttatcacatcatcatgatcctcactggaatcagtctctctgaactgttttcttcctcctcctgatgtctcactcccctctctcctttctccagggctattgttgccaccagttcctaaagccattggttgcaccacctttccttcaataagtcagctgatgtaattggatagagatggttttgtggctaactttttcagccttttgaggttcaagtccatattctgtagacaacttgaggcttctttagtcataaagccaaataaataataactcaactctcaccttcagattctccctgaccaagatcatttctcccattttctaaataggctgaaggaaggcaagggctgaaacggagacaggatgctactgcagtactccacgtgaaggctggtggtcgcttggactgagtcagaacagggaaactgatgggaagttgtcggagagtaagtctatgttgaaaatagagccaacaagatttgttgatagattgcattttgggtgtacaagcaagagaggagttccagaagaaaccaactctaccagcaccttgattttagccctgtaaggcttatttcagacttacaacctccagaactgttagagaataaatttttaggccgggcacagtggctcatgcctataatcctagcactttaggaggccaaagtgggtggatcacctgagcccaaaagttcaagaccagcctgggcaacctggcgagacttttcctctataaaaacacaaaaaaattagctgggcgtggtggtgcacctgtagtcccagctactcaggagactgaggtgggaggattgcttgagcctgggaagccaaagctgcagtgagccaagatcatgccactgcactccaggcttggtgacagagtgagaccctatctcaaaacacacacacacacacacacacacacacacaaattgtgttgttcaagtcagtgactttgtggtaatttgtgacagcagcaataggaaactaatacacaattagacatctaagtggaggtactgagtagctgtgggatatgagtgtagaattcaggagatgcatgaaaatatgaatttggaactcatcaccatacagatttatttaaaaccatgagcctaaataagggttccaacacagtaagtgtgatagagaaaagaagaggcctttagtctgtttctgagcaccccaatttctattggtcaggaggatgagaaaaccagccaagaaaaatgagaaggatcatccagtaaagcataaaaagagccaagagtctgaggttccagaagccaaggcaagaatgcatttccaggagtaaacaaatgtcaagtgcagctccatcacaggtttgaaatttggtgctcactaatggtttccactttaaattttttgctaatgcctacaaaaattctaggagggacaaccaatgtttgagagtgagatactctacagaacatgcttatatttatccttttagagattgcctaagctctgatcctctcttggaaagctacattctggacattagttggatgcttagaataaagtcatctgttcatttgacaagtattttcaagtgcccgttagctaggttctgagaatatgctgatgaactaacaagatccctgctctcatgggaacactttcagtctagggtatttgctgaggccaaacatcacctcttttatcaagcttttgccaacatttttcagtagttgctttcccttctttgtacatattcatagaactcatcacatttaatgtattagccagttattgcctctgctggtaaactctcccctcctttaggaaagcaaccctatcttagtcatcttcatatatagataccctcatatgtaggttggaaatatgatttattattaaaaccaggaaatgtctgcaagagaaaggaggctctgttaattaacaccaagacaggggatgtaaactgggacttcctagggcaaacaaaaatgtatagtcaccctatcactcaagtttacgtcaaaataactgttgaataaatacattttgcttcctgaaaaaacacatttactgaaatgtgacttaatattttgcttttggctttaattgaggatcaatatgtaagaaatagtgttaggaaaagtgtttctgcatcttttgtaaaactgttattggagactgtgtccattattttgtccagcgttcctcatataaagagccatgtaattactccccttagaactgagcgctagaaaaaaatattgcttttttcaaggagatggtggtgcactttctcttcctagataatgagagctcagtaatacatcaatcacgctctcacattggcagccacaagctagagctaaattatatcctcaagttgcttttaaggctgtgtcaaaatgttccaaattgtgacttttcctttgccttaaacatttattgttcacctactatgtgcttagttctgttatttaatctagagatatggcagagatccacacacgtgattcctgtgttcatggcattttcttggttctagcacatttacctactcttttagtacagtatttggacattttcttgtagagagccttaaatttttgcaggagcaaggcaggcatttaaaaaaaattgaatgaagtgcaataggccaacaaattagggaggggtatggacggtagtcacagaaggcttgggcagaagtagggcatgaagtcacttgagcagaccaaggagccctgaagttcatattttggtacttttgtttttcataaggtttcaaacctgctaattttcttttgaaaaagaagaaggaaaggcccgcctaagaaaatataattatttctaaagttgtggttagcatctttactaatatttgtaaagagtacttgatcaaataaggcatatggggatactgtcacaatccagaaatgctgaaagtgcttgtctgtaggctagagaaagaaaaacccacaaattgggttttaatatgatacaccctatacaccctaggattgagtaaatatttgggttctagagtatagcgtagtctatttttgcaggacaagaaaatgatgagtactatttttttaaaaaataacctgtctacttatgggtagatgaacttagcggtccattataaccttagaaagggacttgaagaagctgctgcagtcttcccaaccaagagaaggacattagaggtcaaccagaaagcactatcttggctggaacaacaatgccatcaaaaacaagaaacacatctttatgtgttggtttatttagcatgtcacagtgttaagggaaaatggtcaaatgaaggaaaggttcttcaggcaggcaatttagttgttaccttttgaacctggagaagaatagtagtgtggtgggtataacaggaaagactgacagataacctgttagaagaggggactgagagggatagagaatgaaaaaggcagggaagtctgctcctacaaacccagctatgttggcactttctcttctacaactgcatactgaaatgaacgtgaaaccagtagcatgaaacacttgaccaatacatagcattaaaggaatcaaaatttaattgtgagctcttgagtcccactacttctattattattatattgcttccacatgaaagaataaaattagaagctgaaatagatatcaatttgctatgtaagcctttttttaagtcatatctaccgaatatcctggatattgcattttttaaaaaagcatatcaaatgcagtcagatttgctatataatacaaataaaattactctttttagctaatgtttatgccacatttttagccttctggctcactgttatgaccgtagtgtcatttatgcagggttcgtgtgtttttggtaagcttaagagttatccacggaccttaacaagcacaagaggagaattcactaagatctagagtgcttcaaatgacattgcaaacattggactgcctgaaaacataggtttgtctcagaacagaatacctctgtgcacacacacagaatgataggtctggaaagggatctccagtggctactcattctgttcctgtctccaggtacgatggtggctaaaccatagtaggagtgcagtgacaagatggttagatccacagaggctcctgcatgtgttaggtttcccgctctgtctgcaattttggtactaatgtaacttacccaagactgcccatttccccaagctgcagccagttgagctatcaaataaaataatttatgttatcatccctttcctggctctcccttgggtgcccaaagctgttcaaaactgagtgctggagactgaaagtaaaggtcaaaaggaaaagtctgaacttcagggtagatctgaccagaaaataaaggctgtctttctaccttgcacagcagaggaaccttctttacctatcatccaatcatgttagttgtttgagctgaagctctgtaaagaaatcaccttcatccacagaaactgggaattccagggtcactggcagaactgcaaaacaggattgcagcaactcagcacacacattgtaagatgatttgcttttgagaacttgttttgagcctaccacctgaccaaacagcatcaccaccattatctgtaaaatatttacatttacagggcaagaaagagttactaaaattgattgccctgtgtcagtgtggagtttacttctttgaagaataaattgaggaggctacatgattaattcaaatagttaggagtctcttttctttccacttgatcttgagacttcaatgtcactttaagtcaaattcaaagacatgttgagaaacatgagaaaatacgtttatttcatttatttttccatggtggtctcataagttattttttctaggttatgagaagataaaaaacttttaaacaaagaagccaaatttggagagaaaggagctattattgaacttgggtctatgtttctgaaaagtagcctagaattttataaaagcaaaaaacaaaaacatcatccttgtgtttatattaggaagtattttaaaacatgcaatatgtattttaaacacttttcttttgaatcttgcgttgcacccaaagaatgctaatggtaaccaaattgttctttggcagagtagcctgacccttaaaaaaaggaacagaagtgttacagcatgtgattgtagcacaagacaattatgaatcctcaaccctgagcagatattaactaatcctatgatctgaccataagaggttaccttggagcattcctctacattgcattatgtatattacatggtaatgaatgacagttttcatggctcctaataatgagcagcttctctttatttagagaacaaaatagggggtttacagataatatctgagtttatcattgagctgctcagcctcctcttctatgtgcctcagcttgtctcaatcagtgctggttatctcagcaataaagcattcagcctctagaagttggtttcttcctacaccctataaacaagaggatgaatatcttgttacatgtgctaaaatgagttgggtgaaatgagcattactctgctccctgtcactagctataatcagcttttcaaatctatactgagtgtgtccccacacatagcacactaaggaataaggatgttcgtgacaatatattcctgagaagcagcagttctaacatcccagtgacagctattcattccagtttctttgtgcagagacattgtcccaactccttcaccatgtgctaacaattagataatgactccataaatgtagagaaaaagcagtgtcatggacggtgggtagtttgttttcttagttctttattgaaaacatatggagatgtttatatataaatagaaaacaataaaacgctgccatcatgtaagcagcaacttaaaaagttctacacgaatagaaatcaaacatttctatacctatgccagaattctggtttactgatatctacacatcctgtcttatttggcttgaaaagatgttttattattttaggctttttatttatagttggaagcaaattgtggagcaagagatttttgtttttgttttcatttctttcttggcttaaacaaattacttttttagcaggaacaacaacttctgtccaagtataccttgtgttatgatcatgaaaaaaagtttttaatgtatacatttaactacggtctttgtatttctgaattaaaagtgaggacttgtggcctgacagaagtgactttcaggagacccagcagtggagaggttgagagcactgcttaggaggtagaagcaattcctctgggttggaattctggctgcaccacttaactagctaggtaaccgtgggaaagttagtcaacctgactaaacctcagttacttcatctgtcagatgagaaatataagagcacttaaagaatgatcatgcacactcatgggatgagctgtaagacgttacacatagtgtctggctcgtaggaaacatcacagaaatgctgcctagcatcgttgtaatcagctaacagaagggcttatattgagaccatccttgaaaatctgagaagtgttgatgctcagtgccaagaacagtaacaacagtaatgctactgtttaccaagtgctagttatgccctagcctttacaatgtactgtttttgacaattccatgagctgggtaccattatcatccccattacagctaaagattggttgatgtgagggtcaaacccagtctggatcattcagaagcccacactcttgatctctctgctaaaatggctgccacatatatagcctagggcacctttgaaaccttctttatttacactattctctatgttcctgtcaacatcctgtgacattgcacaatggcattcacaaactgtgaagtcccctgtccctaggacatctgttcatttgtagttaaagaggaccaggaaacacttaatgaacacattattagaagccctggttttcaattcatgcaaccatttttgctttggtttaaaggccttttctttaaaggtgcttgaagcttcatatggacaggctcattattcaagcttttgtcccaacctacagatgcagaagccaaggaccaaagtaacatgacttggggacagagggagaggccattcacctgccttggtagcccagtgtatcagttgctgaatcaggaatacaacagactgagcccagggcagtgtccaactcatcaggctgctcattaatgttgggtctaacagccaaactgctaactagctccactttttaaaaacttctattttaagttcaggggtacatgtgcaggtttgttacatagggaaacttgcctcctgagagtttgttgtacagattattttctctcccaggtgttaagcctagtacccattagttatttttcctgatcttctccctccttccaccatccaccctctggtaggttccagtgtgtgttgttcctctctatctgtccatgtgttctcaccatttaactcccacttataagtgagaacatgtggtatttggttttccatttctgacttagtttgctaaggataatggcctccagctccatccatgtccctgcaaaggacatgatctcattatttttgtggttgcatagtatttcctggtatatatgtaccacatttcctttatccagtctatcactgatgagcatttaggttgattccatgtctctgttattgtgaatagtgctgcagtaaacatacacatgcatgtgtctttataatatagaatgatttctatttccccttaactggtatatacccagtaatgggcttgctgggttgaatggtaattctgtctctaggtctttgaggagtcgccacactgctttccacaatggttgaactaatttacactcccatcaacattgtataagtgttcccttttctcctcaacctcaccagcatgtactttttttagtttttaatagttgccattctgactggtgtgagatggtatctcattgtggttttgatttgcatttctctaatggtcagtaatattgagctttttttcatatgcttgttggccacacgtatgtcttcttttgagaagcctctgttcatgtcctttgcccactttttaatggggttgtttttctcttgtaaatttgtttaagttccttatagatgctgtatattagacctttgtcagatgcatagcttgcaaaacttttctcctgttctgcaggttgtctgtttactctgttgatagtttcttttgctgtacagaaactcttaattaggttccatctgtcaacttttgcttttgttgcgattgcttttggcatctttgtcatgaaaactttgctagttcctatgtccagaatggtatgcctaggttgtcttctgggtttttatagttttgggcttcacatttaagtctttaatcaatctttagttgatttttgtatggtgtaaagaaggggtcaagtttcaacttctgcatgtggctagtcagttatcccatcatcctttattaaatggggaaccgtttccccattgctttttttttgtcagctttgtcaaagatcagatatttgtaggtgttcagccttatttctgggctccctactctgttccattggtcttgtgtctatttttgtaccaataccatgctgttttgattaccgtaatcctgtagtataatttgaagttgggtaacgtgatgcctccagctttgttcttcttgcttaggattgccttggctatttgggctattttggggttccatatgaatttaaaatagtttttctagttctgtgaagaatgtcattggtagtttaataggaagagcattgaatctgtaaattgctttgggcagtatgaccattttaatgatattgattcttcctatcatgtagctccaattttaacctacacagtacatgactagaagcactttgcctgattttcttgttggaagaatgggatctgcctgcaatatggaaaccctcacaaacaagatgactcaattctgttttcatttgcaagatatattgtgaatgttcttttctcctttttgcaggagagggaaagggtttagggttgtgggtgtggcagggcatagaagggaagaggcttaggactgccaaattacatgtcaacctgctgacttagcatcagtgtactagttaaatgagccctgaatgtaagacattaatgcaaatattttgcatattattaactctaatgatgctaccataatgcagtatcctcagctgaaagctgaggtggcattttttattataaatgccctgggtctttcactgaaaatcaccatgaagacaagtcccttagaagtgagagcagaaatatgaacagagttctgcatcgttaaccttctcatcattaacaataacaaaaaatattggtgtcccagggccctgcattcagtaaatgccggcaacatctttctttagaaactatcactgctcttgcccttataactacaatatacttccaaagcaaaaggttaggcaatcattgtaaaatggaatctgttttagaaaaaaatactatgcaatccccaaattgttatgtaggtggaaaatcattctaaatgcagaacaagtattgcttaccctccagtgccatgctagtgatggtagtgtggagtcttggaaagcagagggtttcagagccagcgctaccatttgccagctgtatgacattgagcaaatcgcttgacctccctgattgtcagatcctttcctataaaacagcaacattaataatactgctttgtctattttatgagttgccaaagaacaccaaaggagattgcaaatgtgaaagctctctggacgcaatgtacaaatgttattattgattttttactaggtgagtaatgaggaatgagtagcagtgtttgtccaaggatagcttgggaataagtcaaccaaggtggcagttggtaggtcttgaagatgtggttggctcctgggaaacagatgagctggccagtttgaaggatcttaaagttgcaagttttcgggctgggtagcaatttaactgtgcaacctgtcaagagcctattatattctaaatttgtgccgtgacaatattggctacatgaaataactgtgtgctttcttaccagactttatttggaaagagtttatgaactagtggcctggcagcgttgcctggaattaacagtgctgtggttttacaccagggagagaagtgtttcatgccttgttctattacctccctccctggagattcaacagatggaacaacaacaaaatcagaaccccaagacaaacctgtcagcttgatgcctttaagcttcggcagaactcacaattaagataagatagaatatccatttagaggaaagaggtgcaaagaaataagttcacagagcataccttcttttgtctgagcatggctaatactatctggagatccctgccacataggaggaattgtatactggaacacagtgaacacttaagaaaattagttgaaagaatattattgctagtagaaataactgaacatctttaatatggggctttatatttcccttcattatatttttttaatcctttcaagccaactcttgagtttggcaaatcctaggctgagtaattgtgcatctcagaatggttagataatatgcagagcagaccttaagtcaggcacagcaacatgtgttttggcacagccgtaaggaggtaaagtatttggtaattgttgtttgatagttcccaaggagaaagcactgaagcaacagataagaaccaaacaattttctcttgtgtttaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggtaagaccaaaagatgaagttgtgttccttatatattgccaacaatttaaaataaaatttctgttttaatagagcacaatgaatactagtaggccaggttgtccacggaaaccttaagcttttgttcaaggtataatctgatgatttctaaaactgggataatagtcctcaccttgtatttgtttacccatctgtatccctccactctttctaaattataagctcctcactcccagagattctgatttagtcattctggaattgggcctaaaaatccattgttttgttttgttttttaaggaggtatctttggtgattatagcacaaatgatctcataaccaaaatttgagaaatagagtagaaggcaaatattactactaatatccttctagttctagtcctgtgctagaaaaacttccttgatccaaataattccctattaaaacactgtggtatctgaaattttaccattagagatagattccttgagggtggggtactttcttttaatcatgttttaccttaatgcaaagactcctgtgcaagaggttgagcataaactaatttaccctgggcagtgatttatcatgtgaatatcctgaagagaagtcctaagtccctggggttcagggatgaaattatgaaatgggagcggacatgaggaggttacttacagaaatacaagctggaacagctggaacagtctttttttttttttttttttttttttttttagacagggtctcactctgtcacctgggctggagtgcagtgacatgatcacagctcactgtaacctccacctcctggccttaagcaatcttcctgtctcagcctcccgagtagctgggattatgagtgtgcaccaccatgcctggctaacttttgtattttttacagagacagagtttcgccatgttgcccaggctggtctccaactcctgggctcaagtgatctgcctgccttggcttcccaaaatgctgggattataggcatgagcgaccatgcctggcctctagaacagtcttaaagaagacaaatgtatactacttcacaaagttacctaagcctggccattgaaaaagtttactgatattgtttgtgacccgaggttgcttcctcaacaccattatatccataatccaaaaaagttaaaggatccatctgcaaattgttctgtatttgtactatacacataggatgcctaacatttgaacagttttaacattgctgtattcagaaatatttctgtggctacaaacatttcagaggtactaaaacagtgtctctggacctactccactccagatttttttttccaggctgcaaagtagattttaccaatagtaacatactacatagatttaagatttttaaaaagcttattcttgcaatactgcagatttttaaggcatattttaagttttaaggtttataataatctttcataactaaaaataaaaggagcttttctgtactctaatagaaagaccaaaattattttcctttgttctttgttctgtgtatgttaacatattttgaaatctcttaaagcaacatttccatttacaatgctgtacttctctggacagatccaatactatctacatatgtgtcattgataaacatgatctaagtgtaggggagagagtctgccctttaaattatatagaatcatttgtatgaaattctagattttttctgagcctgaaatatttcaacaagaacttcttaaaaattgagaaaccctgaataagctgctgtgtggtagctgtgaggaaaagactggtagactgtgggtgaatgagagtgcagacggggggtggttcaaggtgaggtaaggagctgaaacctaagacagaattgggaacaaaaacttgtccctccccatcccaggtatttcttttttgttgtgtttgatcattgagacttggctctagcttttttccttcacatgtacgtgttgtataagaatggttctgtttggagtgatcaggttaatttgattcttttcacctaaaataagaaagcattttctgtctttgccatggtttaagatgaggtcagatttgatttctacctaatagaatggagtggggagactgagcccattatggttgtataagaattaataagaggccgggtgcagtggctcatgcctgtaatcccagcattttgggaggccgaggtgggtaaatcacttgaagtcaggggttcgagaccagcctgaccaacatggtgaaaccccagctctactaaaaaaatacaaagttagccggatgtggtggtgcaagcctgtaatcccagctaactgggaggctgaggcaggagaattgcttgaacccaggaggcggcagttgcagtgagctgagatcatgccactgcactccagcctgagctacaagagtgaaactccatctgaaaacaaacaaacaaacaaaaaagaattaataagagttaaaatgtgttgaactcctaatgtgtaggaagtacctaggctttttgcagacactgttttatccatacaaccatcctatgaaggaggtacaattatcatgatccctattttgcagatgaagaaacagactcataagggttaaatgacttgcccaagactatactgcccttagggcaggagtcaccctgagaacaggccattttggcttcaaggctggtggcccttttctcacaatatgcaacaacactgaggggtctggaatgctgagaagcctccaaatctccggcagtgtctaaaatgtttatcttactcagctcttgcttatgcaaaggatttcagtccattcctgctccacagtgatttacccctgggagaaaggagtttgttattgtaaataactacttatatcttctcacattctttgttctactcccttctttaactctgaaagatcagaaaggtttacataaagtcagtagctcatttagatgactctaaatgtttccttgaatgctgttttatttcctttagagcattagaagacagaaccaaattactgctgtcttccttttattacttttgagttatcctttgatatttcaaatttgggctattcctggaagaaacaatggtactggttataactcttgtcacctattgaaaatttcaggtacctcactgtgtgcagtggcttacccctgtaatcccagcactttgggaggctgcaaggtgggagaattgcttgaggccaggagtttaagatcagcctgggcaacacagcaagacccccatctgtctctaaaaaaaaaaaaaaaagaaaaggatgaagaaccatatttgggttcttcatcttttttctaaaagatgaaaatgaatttgtctgaaaaagaaaaaagtaaaaatatatcagttgtgtaccctatatttgtgaaggcctgacaaattatagcttaaagctaagggtaggattctaaatactaattaagttatcatttaaataactgctcacctaacttctaaaaaattaatgctaaataatatttctaaactccatccttttttctttctttttttctttcacggattcaataaacatttattgagtccctaccatgttctaggcctattaaatttctataatttgaggtgactgtatgatgactagaccccaatattccatgtatactatttaccaaaatactgatagaactgtatatctatcacacagatagaattaaaattcaacattgctttcattaattatagaagacaaaaggatcaatttataatacggccatctttgggagagaaaagatgatatcctttacccatctagatgatatctataatggacagaataactgtcaacattaatataaggctttggggaaaaaagattttctttaaaagtatcttggatgtactttccgcataaactctttgttctagatcttcagattccagccttctcccatgtccacctccttccatattcctattctttctctctaaatcctcagtgctctttaaggctcattctgtattcactggtgttcatgaatccttcctgagtccgtagtgctctattgcttttccaaatttctaacgcgcttcaagtctttgtcccacaacctggcatgtgaattacaaactatgatattgttcttggaacactaggggcttatgtgcatcctgctgcctatatgcagtgatcagttctttgaggttaaggtcaataatttctcattctttgcctgttccagagctgtcggtttaattttaggagacatttaaattcttataaatctgacttagcagaaacaaaaacattgaaataattattgtctagacaagcttttagatacttcagtttaagaatatgaagaaaataaaggatactaagagccaaaaatgtataaaaaatattgggagaatgatataaattgggaagcctagagcaataaggattatttctcttaaaggagcaaagactgagagaagatgtatctttcaatactttagtgattctcacacataaaatggtgaattgctcttccctgacaatttgaaagacaatacatgacttaaagtgacctaagagggatttaagctagtctctagtcactccagataatagagaggctttaaatctcaagtttttgcctgattctcctatatgagctccaggttaggatgaaaggagtctatttcattctgagtatgtcaccaatgaggtataatccatggttcttagatgtccctaagtgcatccttcttgaatatatttcttctttagaaactctttcacaaaatatacattaatgaaagaaaattaaataccctcttactgtgacctgagagaatgagcccactcttactctatatctgccaagaagagtttactcctctgcttcagaatctgaaattcaactttttgttgttgttgtttttagtgtggtggcttgtggtagacggtgtattgcaaggagttagaggacttgagtgtatattctgacttcaaaacttctaactatgtaggcaaacagtgtaatttttctaagcctcatttatttgttattaagcatccttattaatcaactattgtatggtactggagaatcagtagtaagaaaagacagataagatccatgctctcacagacaacacagactagtaatgagacctggttatttcatctgcaaaataagtctggtaacctatgagtcattatttctaccaggcctccacttgtgttctcctcctcctctgtcccctatctcattagcaggcactataattcagaaacctcaaaagcacccaggacataaagccaaatgtttacaagtcctgtttactccaaatccctgctatttcttaaacccattccctcctctccaccccacagaccttgtctcaccaaaactcactgattcctacagcagcctcctagtaatatcccaacctgtgtttttaatcttctttcacctaattggctcactgcttctagaatgaactttctaaagtgaaaatcagtatatcaacctggatgcttttggctgcaaaatgaaacagaagacccagtcagaatggcagtaaggggatgatgtttttaaattcgcttaaaaagaactttgcagcaggtgttacagagtgcataatttggccatttgaccacttcagggacgttggttctttacatctttccatgttgccattctcagcatgtagacttttgtcaggcctgtctctttgtggtcccaggatggctgcagttgctctaagcagcacattctcatacattgtgcagtagtggaagagagaatgtctgtaacagatatcccttttgaagagtgaggaaatgttttctagaagccctaaaacaagtttcttaaactccatattattggccaaaattgtgacatatgtctgtggctaaatcatgcagaggcgatagagtggaattacctagattggcttatactgatcaaattttacttcctaggcatagggtggggcccagtattcactgaaaaacaacttcttgagaagctgtttgagaaaaattgggattctttagggaaaagatgatgatatctattgggtaaataattaaaagtagctgcaatatctgatcatccctgctccttgcttccaatcctccagcatctccctgctgtctccagagtatgtatgaataaagtgttcaccaagtatggcattcaaggccccaaatctcagaaatcaccgctaaataacttactcatgtaaccaaacaccacctgttcctcaataacgtatggaaacaaacaaatgaaaacggtaatttaaaaaaaagaaatcggggcatccaaatcggtaaagaggaagtcaaactgtcgctgtttgctgatgatatgaccgtatacctagaaaaccctaaagactcctccactcctttctatccatctctcagtcatacaagtctaattgaagttccaggcacaccctgctgctctcatacttccttgccactggacctgccctattctgtctttttcaccagttaatttctactcactcatgatgcagctccttgttctcctccttctcaaaccttctgcaatctgctacagtctgagtaaatgtcccctgggtacactcgtacaatgccctgtgttcacctctcctcttagtacttatcttgttctcctaattgtgatcaattgtgaattcctcagaattctcagtgcctacaagtgcctggccctcgacaaaatgtccatgactcaaatgctgaataagcaggatccatgtctgtaggaagagtaagataatgccaatgaggtttattaactataatgcaagacacaactgtaagttatgattaatttagtaacgacatcactcattgagctgtcctctttcattgcatattgtgttgttttaaaaatcatattttagtttatgtcatcttttctataatagttcagactccacgttgaagtaccaaatacacagattactcagaatttcacgtattttccatcttgcttatttctgcccaatacctcatatggcattaagaagaactaaattaaaactttccatttctacatttgcaaaggcctttcctctaaaatgttctaagaaaggagacctcaggacacaagtagaaatggtactgtaaagtaaattgaaggttcagcctctggacccaggactcctgcgttttccaatcaccagatggaatagcgcagcccagcggctctatatcccctgttgtccctaatttaatggtgcctcccttatggtgaaaacactgtacagtgatgtttgaagggattgatgctccatggtaagcagacttcgccctactgggaacatgaaaaggaacctctctgatttgtggctgtaatcctcaagccctcgtttaaatagccagggcagtttcatttaatcaacaagcatgtgttgagtgcctgctgtaaaccaaacgctgagacactgaggagagaggatgaaaaagactcaacaggtctctgatcttgtggagtttacattgtgatggaggggtgggacactgggaagatacagactataactaagaaatagattaagaatagagaaaaacagtagacattgataaaggctatacagagaattatagtaggtggttacctcttacctctttaattcagatgagtcaaagctcttgctattcactgactgctatttgcttgacagcagtgtatgacatcctcatcaatattgcattcctggaaattgttcatcagaacatcttataagcttcttctgctcttccctcttgcagtagatctgcttcagctcaaacagaaaccactgggtatcttgcccaaagcagacctggctcatgccttctaggataattaccaagtaggagaagagcaaattgttataccattgggcagttagtcatgcactgctttatgaagtctcttctattgttgccttgaactgttttttaaagcacacactttaactttaaagttaatatactttgtactttatctccttaactggattgaggatgaagagactattttcttcttgttcatatacccacgacacccattattacttggcatataaaatgtatccagtaaatgtttactgattagatgtattgatttaaagatgaaaataagctaaggaacaataaaaggaagtttttggtatagtaccaagataaataacacatgcagaataactgcaggggcacataggtcagaagacaagaaagacgtggaagagaggagcttgagctggacattgaaagatatgtagtataagaatggacaggccaggcacggtggcccacgcctgtaatcccaggactttgggaggctaaggcaggcagatcacctgaggtcaggagttcaagaccagcctgaccaacatggtgaaaccccctctctactaaaaatacaaaattagccagatgtagtagcgggtgcctgtaatcctagctacccgggaggctgaggcaggagaatcgcttgaatccgggaggcagaggttgcagtgagccaagattgtgccactgcactacagcctgggtgacaagagtgagactctgtctcaaaaaaaagaatggacagaagagggtagagaaggacattcctgatgagataataatatgaaaaaggcaggtgtccctgtggggccggaaaggaaagtgacaccactttcctaattcatcttgcagggcagtgggcaatgagaataggtgagtacctctaggccagatgaaaaagagtcataaatgtcaggtgaaaactctcatagctgatgcgaagataccggaacgctttacaaggagagggattaatcaaagcagtgttttagaatgtaaatccctaaagcttgtgcatgcctagagcatccaggtcacactcaagtagaaggctcaaagtaagaacacttaaagggaacgaggagcttgaggaagtagcaaagggttgaaaacaattgctttagaaaatcagataatgacattatgatgttgctccattgtatgtactataatgacccataaaacactattacttaagtctctgtaccattttccgtgccttctaatgacatagcctagaaaagttttccttttctatcttccccttttagggtctcaagattagctcttctgagttccccttcttatccataggactttccatccatttcactttacaagttctctaatttatttcttatgttacactttaatcaatgggtagctacagtgtatataaattatggaggatacaaaaatgagatatggacccttctctcctggagctcacaattgaaaactgattttggttagcttaataatcgtgaagataagaataaagacttcatcacagaaaactaaataaagctacattaaaatttctaagaaaaatatctaaaattacttgaaaagccagtggagtataaagaagaaggatttcaaaatatgttttctccttgtcagccatgtgagatttttctctctctgctttaaataattaggaaatgtagaatttattttgacttgttttaatatatgaagtgattttaaagtgtgattttttaaaaatgctattaccaaaactttcaaatgtatacaaaactaaaataatatcatgaacccccatgcacccaccactcagcttaaggagtttttcactcatggtcagtcctatttcagccacacagcagctactctcctacacccagtttattttgaagcagatctccaaaatcacatcatttcatttataaatattttaatttgtatttctaaaaggtaaggacttggttttatttgtttttgtttttgttgtttgtttgtttgttttttgttttttgagatggaatcttgctctgttgctcaggctggagtgcagtagcacgatctcagctcactgcaacctccgcctcccgggttcaagtgatcctcctgcctcagcctcctgagtacgtgggattacaggcacacaccaccatgccaggctaatttttgtatttttagtagagatggggttttaccatgttggtcaggctggtctcgaacacctgacgtcgtgatcctcctgcctcagcctcccaaagtgctgggattacagtcatgagccactgagccctgccaaggactcatttttatttatataactacaatactattattctacctaaaatattttacagtgatttcttaatatcatatccaatatatggccagttttcaaatattcccaattgtcttcatacttctttaaaaatagttttctaatgtaaaccaggattccaataaggttcaaacaatgcagttggctgatatatcccaagtttcttgtaatctgtaggttctacttccatcttttttcttcttaccacttatgtgttacagatgccaagtatttgtcctaactccatttccacggcatcatttgtcatgttcccctatcccttgtatttcctgtggattgagttaaatctagaggcttgccctaagtttgattttttttagcgggggagagggagtgggctaaaatgctttctagatgttgctgcttgttttcataggcataatgtctaattatctccctttttatgacattagcagcctagatacatttgaagttgacccttgaacaacagggagtttaggggtgctgagccctgcacacaaaaatctgcatataacttttgactccccaaaaacttaactactaatgagctactgttgatcagaagtctttatgataacatagtcaattaacacatattttgtaaatgtattatatactgtattcttataataaagtaagctagagaagagaaaactgttaagaaaagcataaggaagagatacatttatagtaccgtactctatttatcaataccatctgtttacaagatgaattttctgaaatggcaaccacggtggcacacctcaatctgtggtacatatcaagcaattcaactttttcttgtaaagtcacgacttttccctgcttcttgggagcacttccaacatcactagttgcacattgtatgagtcctatggtgttagtcaaggtctacagtattacactaaatgtgatgaaaagtatgtgagagccatcacttcttcctgtgatatgcaatttactggagagatgaactgctcacatagaggtgattagcatccgcagcattttaccagatactggcaacacttgagctcaccacaatagcaacaggaggtagctatgaaattactacagtagtacagtatgtactacagataatgttctgcagttatgatttaatactacatctttacatttgtttacatttctctcatctgcaaagggagccatgtacaatctgtgtttatgtgcatatgttttgacaaattttaactttttataatagatctgtgtatactttgtggtagtaaatgctaaaataaactagcatccacatatatttatgcattcataacatacctttttcttaattattttgatatttccagactatgtggttcattgtagaatttttttaaattgtcacaaatctccaaaaaatttgtggaaaaaaatatttgaaaaagtggatccacacacttcaaactcatgttgttcaaaggccaactagatttaatttcagtatattctgaatggtacagtctaatcatgtaattccttctttattaatttaaataaatctatgcaaacagaactttccccttatcagctattcagttactctgagatacttttgtataagaaggtaggataaatgcctcattctttctctttatttacctatttttaaaccatcagtttgtttactagtatcacccaaagatgatttatttattttttgtgtcattattaactgatggatttaaaaatatttgatgtgtttcattccattgtagtagctattttattgatgctcaaattgtcccatctttggccaattgaaacatctttaaactggttctgagtccttttgacatgaccctcatagttgttgatatcatcctggctttctgataggacaaattgtttcaggctatcttgtacatgtcctgccctagatctgaaatcagctatctcttcaaagaatccaatttattttcctaggtcatagtatttagaggccacagtctgaacagtaagtgtgtgtgttgctactggattgttcattgtttctaggtcttttcagcagacaggactaggaaacactttttttctccaacatgaaattatattactaattatatgatatttccaatttaagttgaggactataaaattgcactttacctcactgatgttacatctgcattttctttttcccctgcctacaatcctggctctcagtggaacaacataatcactcatttgctttatcccacaatacacacccagtagtctcagaaaaacagtatcaacacgatcaccaacagtataactattgaaaagagttttctgtagttctttttgtttttagtatgtatattctactagagatgtacaaatttctgttaacctatgatgcatattactctaaatatgatatcatttccatttctctctctctctctctctctctctctctctctctctctctctccctctctccttttttagagatgggatctcacccaggctggagtgcaaaagtacattcatagctcactgcaacctcaaactcctgtgctcaagcaatcttcccacctcagcctcccgagtagctaggactacaggctggcgccattgtgcccagctaatttttttaaaatttttatttttagagatgaggtctcactatgttgcttaggctggtcttgaattcctgggctcaagcagtcctcccacctcggctgcccaaagtgctgagattataggcaggagccactgcacctggccatttttattatttttgttttaaaacctccactattgatttctaaaatgtttaaatgcttattttctaatttttctttataatgtggggaagagaatatgagtaggaatcattatatgatttatgaattaccttggagtgtcatagttagatcctcaggatactattgcctgttctttcttcttagacctgactcaatttcacaatttcattcactcattcatttaagaaacccaagtaaatgctatgaagcaattggaaaagaggcttaaggagagaatttaacatatatttgttgtttactatgtgtcaaaattatgatagatgctttacttatctcataatttcataagaacattttgaagtataaattattattatgtgaccaattttcaaatgaggcagttgggaatcagggagtttcctttgcccaaagtcataaagatattaagtagagaagctagaattaacatatacagtctgttttactcccgtgtcacatataagatgcagtccctgtccttaaggagttaatggagggttgagacccaagaagaacagagtacaataggagttcaggccaaaagaaaggtattaaactgccggggcctcacaaagaggtggcatttcacctgattatcaggaaataataaaatgtgctggatgtagagggaatgcatcccatgtcaaaaattggagatgagcaacattctgtaggtaagaaaatgtgaggggtatttaaaatgataaccagtcgggttggaccaaagtttagttaatatagggaaatagaaaactaaaagcgttgcctggaatctcagttgggatctgaaggtcattctgaggattcaggacagctagaaacttttgaaggtttgagcaggagtgaaatatgctagggcacaatcctagccactgggcaggctccggctaacccagatccttctccttggaaggactccagacaaaacccaccctcatagatccacaagtcttgctgattgactgcatgtcttctagcaatttcctagaaaagttgcattttcttcgatgttttgctactggaagttttgccaaattaagtcttccagttgaagagagatggagtagccccacatagcattgcattgcgattggcagtggttttctgaagtctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcacaattaaagagattttggtaaaactgagttaaaattgggtaggactttttactataaaaataagttatatctaatgttatacaataaactgcctagtttggataatttcattagcttaaactcttccctttgctcagtattaaagttcagaagtggccacctaacctaacattcttacatatccccctcatggggacttttaacacagtgaattaagtgtcccctttattccatttttttataagaatgtatgagattgcataattcatgataactaaacttacttttaaaatatgacatttgctgtcttaattctttccagttcataatctataaatcaaatatggtcgagctctgtgaaatctattagttatgcatcttttgagacctgagtgatccgttgcctatcataggacgagatatgaagtgtgtcctcagtattcttagtacccacccttctttccttccttccttccttctttccttccttccttccttctatacatgtattttttgtaatagcttgaatagtttactgtcatgtaagagaatagtatcttatgtagaaacatagcgtggacttcaccaatactcatttttggaagtttaaacctaagagaaaaatgtttgctggatacatctttataaaatctacatttttacagaaatagttcattgattattataaatatcatgtttgaaaaacttttaaaaatgaagttacacacagatattgtttaatacctttagcactatactgcgaagtgcactgcagaaataaagccattgtttatttagatgggtcagtgattccagactcactactcctcacacaagattttatctgagataccctgatcattgtagtcatttggcttgtgagcttcagttgcccccccatacgcttaaatttttcattttgtgctagtgtagaccaagtcaaagcccacataaacccaatatatgtgttaaggttagagttgtgcttcacactcttgactgtactttaaaatcacctggggagcttttaaaattatctcagtgctggggccccactcccagagagtcagagctaattggtcaggctgcaaggccacaacagttgcacaaatgcaggtggcacctcttaccaagaacctcttcatctccctggccttccaacttcctggagcacaactccactgttttccatgtgaatagcacccctgtacttgtgcaaacttggaagccctagcgatagtggctgagcacccatgttttcagaaggcccccaggtgttctaatatgcagccagaattgagaaccactgacatataactttgacattaggtgtatggattaaggagctgtgtagaaatagattcaagatctagctctactactttttagctgtgtgaccttaggaaagtcatttcactccttggaacctcaatttcttcctaaataaaatagtaatactaatacctacctcatgagattatataaaagaaaaataagatggtcaaagtgaaatgcttggcacaaagttaacacttaataagccacttttattattttagctattaaagcaagatttctatattagtctagattcctacagtactaagttacagaggtctatctcagatgatctgaaacaaaaatggggaaattaagcaagccacggaaggatagagtttgatttggcctcagattttggcatttgaatgctgttaggacacatattctctctctctttctctctctggggcttattccagcttctcttttcatggtgcttgcattctctcagcccaacttccccccttggggtaaaccatgaccatgggcagctcaagacatatcttttcagcctctttagcacagaacaggcaaaaaattcatcctatctgacccggttggaaaagttacagtgacccagcctggctccatccctgtggtcaagagctgtagtcattaaaacggggagaaggagtgctgtgcaggtaaatacaataaccagctttgtttcattgttgagacctgattcaaaataaataaaatacataaaactcctgccattctaggatctattggcagacaaggaaagtcagcagtaagatcccaagagcaagaacttccctgaaattaaaacacctagtctctccactctccatgatctatgcacaataatcaccccttaaggtgaatttaagatcacagaagtgtgccttatcccctctggtccagtttatttgagacgctcaaactcacaggcaaatgaggagttgaatcacttcataccaagctcccagcaatctgcattattgaatacctgaagtgttctgtcctcccactcccaccccatggtatttccttacccatacaagtgagaagactaggcagagttatttatttatgtaagtgttatttataggaacactctctacagctactctaacgtgtatgttatccaagaataaggcaatgaggtaaaacaaccacaaaaggcccagaaacatcctttaacatttggattgttctaaccacttacctgacacttgtggtggagaggcaacaagtgtcatgaaagagcaacaagattcatcacttatagcagtgtgcttttgacaagttacttaacttcctggagcttcagtttcctgatctgtaaaatgagggcaataatatttcaaaggactattgtgagaattgaatgtatttgataagtgataatgtatttgaatgtcaattacactctgtacagttgacattaaataagtggttttccaaggggggtgaataattttatatttaaagcattattgaaaaagctttgctatgaacatgttctcatgtatttggacccagtagagaggatgactgggcatgtactcgactatcctaagaaacattgcaaaagaggcacaagtactattggtactcaccagccattgggttcttagcatacttactttgtggttacaaaaaagagtgatggagctactagcatacactataaccaccctgctactatactggttcagtgtccttgtttaggaaagcagcctgactcatttcactgtaacatggtacaacactgcagagaataatgccaagaagaaaaatgtcaaatattaataacattactagctcttctatttcaaagaatgcctctagggattttgaggtctctttatagttcctattcagccaaagtaaattgattgattataggtgataagagtcggtggaggattatatgagtgaatgtataaaagcacctggccaaaggcacagaatagcacttggactgactctcacaggcgacatcaagttctagtttgtctgctatggactgactgggtattcttcactgtaaaggagcctcatccctaatggtgatgtgaagatagtatgtatcccaaaatatacatagggtatgcattttctgtgacctggaaatgggacaagtacctctgtaagcctcacttattttattttttttcacactgccatgagaaagtaaatgtaagcctcttttagcattaaaactctataacccaaaccccacatttttccagaagtgaaaattgcttacaatgtaaaagatgaacattttgaatgaaggagcagtctactcataaacttttaggagcaagagatgaaatagcacaaaactgcctatatcaaagaaacacgaataaagttcagacgtggattttaagttgttcaaaagattggtacttcaacctactaaaatactggggacaaactgatgagaatatcttggaagtgaaggaacatatttccttaattttcaacatgtagtcttggaaccagttttatttcaaattttttctaatataaatatataaatatctgatttatacagtttatgtatcccgtggcaatgtgatcttttgcttcttttattttcttcctacccctcccccatctttttcttgagggaatcaggaaaaggtgtcctatttctcaactgttgaatctatttatgaaaattagaactaaacagtttagcacaattaagcagaatgccacattcatcaaatcttcatttttctaagacttcaattctgtcagtcactagaaagcatgtgctaagtggaagctgtgtttccggtcttttggcatcccacatctgttgacaattacagaggcacatacagtgccattcatagaatggcatgtgtctccctatgccttggttcacaggccctcggggacatttacaaagtgtgtactttttaactgtcctagaactaaggagtttaattttgcctgagaatgtgtttatgtgccttgtaaaggagctagtcattcccttttgctttcctttattatgatgtgtgtatactctgtgtgtgtgtgtgtgtgtgtgtgtctctctgtgtgtatgtacaccaaagaagaaccacaccaggaattgagcataaaggctttctcttacccatctacacacctttcttgtaagttgctgcttttattttttatttattcttttgttaatagtgtatttcttggcttctgctggattttttttctgtttctaaacactatttagttctgatttcatatccttatgttcttcagtcaagactggggtcagacttctttatattatatatgtaattattacaataaaagtcaccatgtgtggtggcccacacctgtaataccagcaatttgagaggctgatgagggaagattgcctgagcctaggagttcaagaccagcctgggcaacatagcaagaccctgtctctacataaaatttaaaaattagccaggcgcagtggtgcattcctgtagttctaactacttgggaggctgagggaggaggatcacttgatcccagaaggtggaggctacagtgagccatgatcatgccactgcactccagcctggatgacaaagtgaaaccctggctctaaaaaaaaaaaaccaaaaacaagtccctggaccctctctggagctatgccctctttcttttggatctcttcctgacccataagcaaaccatattcttcaggaagtatctagtacctagaaaactgaagctgaatctacatgtcatctatccaggaacttcatctcgctagtcttaacacctcagatatttggcaatacccagaatattgaccatttttcctattttcatccaaatatttaatattgggtatgcatgaccatagtaacattaatttttttcatttaaaagataggtactgcctttggacattgtaagcatctcttgttaataccatgaatagttaaataaattctagtataggagccacctagaggagttgtttaacggctgaaagaagaattaggtgaaaaagaagttgagactgaggctaaagccaattgtggtttcatccacagtggttaatggtgtttcttaatctttaaatatcaaatgtgttgtaatgcttaattatccttaatacataaaggaagtgacctacaaattctttactgtttattgaaaagtagcatatttggaggctttgacaattctacagaagagaggaagctgttaaattctaggctaccatgtccttcaaatgggaaaaaacaaaatgcctgagcatgtctcttctccagcattaaatttttcatcagtttcctattaaactcaaggatatgggaagggagcaattttaattgcttggcacttaaaaagcctcctccactgttcaatgagttagaaatattttgaaaatttgattgcatttagaaccacacaaatttacctgtaataaaatttttgctgcacgcttaaataatgtcttctagaaatgaacatttaaatgaactatagaatgctcagggggtaaagggaagctaatatttattgaagaccataaggtgccaaatacagtatattcattattttatttgctcttcttaacatccatgtgaatgggtattgctgtttctgttttacgaataagaattggggctaaaaccagctgagggggttacctaaatggtacaaggtgcagggcagatctgaaatctgctctgtttgattgcagagtctgttttccttctctgttgtctttacattctcaggattatgttgaaaacagcaaagagtgccatcttattagctcatataggctttacagtcagtgcagcctgattcaccaaagctacacacccaccctcacacacagaaaaccacttgggggctgacttacctggatttgtgtctaaattatcccatatatcaaataatactagatctcctcttcagtttctgctttgtagttagcttaaaatatctcaaaactcacattgtcccagaggaataccaagaatgtcatcttacgttaagtaagtatgtactgtactgtctcatattaattaaatttatggtacctaaatcaagaatccttcagattggcttttgaagtgcactctatctctgccatgggaagagcccattttgaggttttcctacacaaaagaaaagaaagccacctccaggtatccttagggtcctttcaactgatccccaaacagaggaatctagtttcaatggaagtttttaataaacctcattatttgacaattagtcaagtgtctggcattccttctttctttatttttccacttctgcttatgctttcaggctcctttgatgttgtttgcccctccggtggtggtaaatgaccacaatggctaataggctggcttccacaggtgcctgttaacaaccacttcataaatattcaacaggagcattctgtgcgaaagactggggaattaggtgacctgccaaatctttccacatccaatatctatgataatggatacacaaattacgcgggacagaaggaatggccttgcactgtgaaaaaccgaaggggaatcaatacagcctgtggctcccagctcaggcaggcagcctcgcccagtatacttctcccaggtgccgacttggggggtcaagggctttcccctctgcctaatgagcagttcttccatagcaagtcatcaccaccccagagtggtgggctcttatctgtattttaattttttgttataatggtaattagcattacatcttgaatagtaaattaagaaacccaaaacagaattttaaatttaaaaagcttttccattaggaatccagttgcattaattttgtggatggaaggtgagctaaattagccaagtttgtgcattcattacctcgttctaatcctcaacatcacaaatgcaaaagactgtcattagatttgagaactgacaagaactgggatttcacagtatgaatgttgaaagattaatttgaaaagatctcactaaaaaacacaaaaggttattgctaacatggaatattttatattcatagtctgtacctagttttaaaatgcctatttacagttatctggcttaaaaataaatggtacatttacagtacttgatcaaattggaatatttctaggtatcttgttttgatgatagagaagtgtaggtatccaatattatatgataatattggaaatgctttttttatcaagagatatttgactttcaattattatatccaaagagaggttaaaaataaagagaaacaagaaagagaatgggctttttcacccttttacttcatagtatgttgtcaaaaaagaaagttattcttttgcaatatttcaccctttgtgtttgccctgaaaatattaatggtgaagtagaaatcacagtgatgaaagcagtgtcatacatttcatgaaagtacagttaattttcaccaaatgagttgccaagctggtagtgggtaaaaatgtaaatgttcatctttgatcaattgaattttaatgttgtgaatagctgtatgccttgatttatacatctgtagcacattttaaacatctgtgttcaagatgaccatttgggaaaagattcattggcttcacttagttcatgttgtttggttctatatactatattcaagtcccaaatgagacttttctaaaaagaaattttacacaaattgcttactttattatagactgcgcaacctagaatggcattttaaaaaccagcatgggtgatttcaccatgagttttcaaaggttatacaattgttgaagaatgaaaatgtatccgtttcaacagtgaaaatgagaataattgatatttaaatgctacagtagctgaggctaatgtttctcttaggagctctgttaccacaggaccctcactctctgtgttgtctttattagtttctaggagatttttgcatttagaacctatagcctagcttttaaaaaatgctactttaaggtcatagactggagtgtagcattatttttcatcaaacttgattaattttaaccataggtagctcaaaagaacagctcaattaaaactaccacatatacaggaagaaaagaaatagattgcctgtagcttagctctaaaataggaagtccaagctatactcgaaataacttttacaggtgacccttctatttttaagacaattataagctgggcatggtggctcatacctgtaatcccagcactttggaaggccaaggcgggtggatcacctgaggttgggagtttgagacgaacctgaccaacatggagaaaccccatctctaccaaaaatacaaaattagccaggtgtggtggcacacgcctgtagtcccagctactcaggaggctgagacaagagaatcacctgaacccgggaggcggaggttgtggtgagccgagatcgtgccattacactccagcctgggcaacaagagcaaagctcagtctcaaaaaaaaaaaaaaaagagaaaagaaaagaaaagaaaattatagtattaccatttctaaaatgtctaggcagccattgctattaagaaagttgcattgcttctatttaccttacaatgtgtttgcatctttcctaaaagcacaggcctagaagtaattccaatgatccagggggtagtccatagtctccccttcgagaccagagctacagctgcagattttgctaacatcagaatagtccgctagttcttcttcattttctattagtacaggaatccccccatgggcttaaaagcagcagctttgttataagaggatcttttaaaaaaaattactcttgagatccctttctgctggagatatatttattttgtagtcaataaaaacttacaggaccccttctgaaagttttgcttggtaactcataatttaaacatctgtcattttttcctttttaacactaccctttatgtgtattgaactcaacctaggatggggtagggagtactgatcctttctttaattttgagtggccttttggaaacacttacccctggaccagtagtattcaatgtggttaacaatctcctgtacagcttattacaagcgcaaagactcctgagcccaataccccaaaatactaatgtagtaagtgtggggtgagactcagaattttcatttttcttaagttcccctgcgggctaagaagggcatctgggaaccatcctttgaggagtaagatggtctctgagtccttgtttatctgtttacacagaaactacctattgtaaccacctaagaattatgtgatctaggcagtgttttcccaggtatactaatgttaacagttgcagaagcaaaaggataacactgaggttacttcacacgaatggatgtttgatggattctgagagttccctggagtagggagacctgggtgagttccagggccctgatgctgatgctctggcattgtgcaacttaaatgactcagttttctagtgtgtgagtggagataatcatctttccctcctacccacataattccaatgctctgacaaatgtcgaggcactacctgtaaaaataatctaatttctacatgatggtgtagttatataagtaaaagttttccagaacaaaataccaattgaaaacctagcattttttaatgttttataatttccccccattttagatgatagcttgtaaaactacttcctcacagactttccccataactttctactttacctttaacctgtgctaattcatttctataaagacattgagataccagattacatgtcatgtttctaaaccactctctaactggtgtccttggaaatttcacatttcccacactcagaacctaggagatcaaccatatttgactcaccgaaaataataaccagtctgggatatggtatgggaaaaaaattaggttaaaccacaaaactcttcccaataatgagtcagtgtgtgagtgcctctgtgtaagacctcatttaagagcagcaggagctgagtgggggacagttctcaagcggttctttggaattagcatttttgcaaggaagctttcttacccaccccaactagagaaacctctcattgttttacccacctcatcctctccaaacattatgatgcaacttcacatcataacaggatgctgcaagagtccatgcccctttaacttctgctttgtctaagaccaagaacacatctatggctggacaaattgggtttatcattcattgcagtgagggagaactcatgtcatggggacccacgatgcatctcaataaaagggtgttagaagggcttggaggaggattgagattttgtgtagaggagagtttggtaagagtccaagaaagtggcgttcgctctagactgggcgctgttgggaagtggggaccatcctatgactgtgtatcttaataaactgtgtctacagggacagaagcccagaaggagactaaagctttaattagtaaagatgcagccatcacttatatttctcagaagaggggatgtctgatattttgtggtttgccagtgactttgttttttctgggcttaaatgaaattatgaactggctagttttgactgacttcagtacagtcacagagtgaccttgtctgttgctggcgttccatgagattagttatttgttcatgaggagaacagatggcatggtttctttaacagcactgatacctacttgtaattgtcaggccagttcccagatgtcagaggctacttcttttttagatcagatacctttgtagcataaaatcagttttagggcagtatgatttttcatggtgaacattttaggttctctttgtaggtgctggtttttaaattaatctttagttttgccattgtccatttatgatcagttgatctgatttcaaaatgcaaatccctagcatttaggaacttatacattgggaacatttagggatttaggaaaagtgggaagagtgaagaaaggtttctcccatgaagcagtgggtcagtagggaaattataaggaagaccaaagagaatgaaatggttaccaaagtgtactaatgtgagagatacaaagatggatggatagatggatggatggatggatggatggatggcagagagagagagagagaggatgaaaatgtcatgctcatctgaacctcattcttatcaccccagggaaactgcagttatcctaaatgcctctggtaccaataactgacaaaacacatgattcctaccatttagttattcgtctgtttgtatgtatgtacatacgtacatatgcattgcatctgtttgacacataatactgaaaccgtatactgctaaaattatgataaagagcagctaatgttccaataggcttttcttgcttcatagctaaggggaaaatgtatgggatgaaaactccagtagaaaactgtgtgcggcatttagttttaacacccactacctttgaaatctgtcaaaaatccattgtccgctgtggttagcctcagaatcataaggtttaaaggctataaaatgttcagtttcatataaacatagaatggattcaggatttgaggtgatgcattccttttccaataggtacttctgcataactacccagtagagaaggatcctttcacaaaaggtgtgggaaaactatactacaagcctgcagtaaccaaaatggcatgttacgggtacaaaaacagacacataggccaatggaacaggttagagaagccagaaataaagccacacacctacaaccatctgatctttggcaaagccaacagtaaaaaacaatggggaaaggactcccaattcaataaatgctgctgggataactgactagccatatgcagaagattgaaactggactccttcctctcaccatacataaaaatcaacccaagattgattaaagacttaagtgtaaaacctaaaattataaaaatcctacaagaaaaccttggaaataacattctggacattggccctggcaaagacttcatgatgaagactccaaaagcaattgtaacaaaaacaaaaatcgacaagtgggacctaattaaagagtttctgcacagtaaaagaaactgtcaacagagtaaatagacaacctacagaatggaagaaaatatttgcaaactacgtatctgacaaaggtctaatatctagaatctataaggaacttaagcaattcaacaaactaaaaacaaacaatcccattaaaaagtgggcaaaagacatgaacagacacttctcaaacgaagacagacaagcagccaacaaacatatgaaaaaatgctcaacatcattaatcatcagagaaatgcaaatcaaaaccacaatgagataccgtctcacaccagtcagagtggctattactacaatgtcaaaaaataacagatgctggcaaagttgcagagaaaaaagaatacttacacactgctggtgggaatgtaaattagttcagccactgtggaaagtacttttggagatttttcaaagaacttaaaacaggacctaccacttgacccagcaaatgctgtgtgtatactcagaggaacataaattgttctaccataaagacacatgctcacatattttcatcgcagcactattcacaatagcaaaacatggaattaacccaaatgcctttcaatggtagagtggataaagaaaatacattcattacctgggtgacaaaataatttataaaccaaaccccaatgacacacaatttacccatgtaacaaacctgcatatataccccctaaaccaaaaataaaagttggatagaaaaaagaaagaggtgtgagaaaagaccccactgtgacacataagtggcatagataacagtggagattcactcacatttgttgagtattacctagacagtggagattcactcacatttgatgcgtattacctagacaaggaggacaatggcccctcttcctttctgtattctttgtaaagggtaggccttctgagaggttaaaccaccaatcagaatttgaaatctttaaagtaatcaatttatccgctattcatttgccttctactttaaatctaaagttttgtcacagccaatatttatagtctctgacatcactgggatcagaatggaaatactaaaatctgttttgtggtatcctaaattcactgaattagtatttattgtaggactcccatagggtgtgagtctttacaaataaaggtagggaatgccctttatttgtaagggcaaataagttcctccttctcttgtcaaggggatgtgaaaacctccttgcacattttttcttttctttttttctctttgcagaatgagtgttctgagaagaacaaaactcttttctgacaactcttataaaacacttttgtgtttgattctccaacgactaagatttggacacacaattctccattcatttctcaagtgtcaagaaagaattgagtttaaaggctccaattcccttgcaggttacactgtctatctagatgaattagtattcagcacagctttgggaaaatctcaaatgatttgcaggtttgcaaattgttcaaactcataatgaaatttcaggctgaggaaatcactaaacagttcatggcatgagtttttccctctgagatctggacatcttagatcaattcactcctctaccttcgctgccccatccatgccagacagcccagggctgcttgagaaagtcacacacacctgtcaccactgaggttattctcctatccccatgtcctcccctgctcagcaaaccagcccactctccatccattttcattctttattttctgttcctatagcatgtgttcctcttcttatccagggctatgttctgagtccggtccccctctatgccctcaagcaactcaaactggcaattatttatatcctattgcttcaattctctctcttctctaaacttttcccatcagaatataaatatttcaagtattcgccattaaaatatatatatatatacagctttacccaactttatgaacctccagctctttcttttctttgcagccaagctttttgtcctctcactcattcctccttccagtgcatcctgaattccacttggaactgtccaccaggattaccttcccaaggacacaaaggtcctccttttggccaaattgaactggtgcattctagtccttttcttgtttgatttttctgaagcattgacatagttgaccaccacttacatcttgaaactctgtatgtccttagcttctcttaactcctcttttcattcctttttcgcttcccttccttgtgccagtcccttacgtgttagtatatgctaggatctcatccttggactctatttattcaggtcactgttcctggaagataactctatagattctcaaatctatatctacagattttggaagccatgtggccaatgttaccacttgggtatcctgtaggtatttaaattcaacatgtctgaagccaaacttctatctcacccttaccacaacccatctctaggaatagaaattatcgtccaagtcgctcaaacctgaaaacttggcattgacttagacttattttcctcattcactctcccttattcagtcaatccttaagataatgccatttctaccctttaaatgtagcctctcctttattcattgtactgctgccttagttaaggcactcaaaattcctcattactgcattgctcccagttgtcttcccaaaatgtggcttcccattctttcaaggccaactcttgagcatgacatattggtatataaaggcctacatgacttgacacttgccaaactctccagcctggtctctcatgggtttttcatgtggacttaactctggccatagcatcctgctggaaattatttaaaaacaccaaattatttcacaattccttatttcatatgctattattccctttgctacttatcttttaaggcttagcacagagagcgtcttaacacatattactcaagagatgttagcaatcactattgttgtttttgttgtcatgtctccctttagtatctaaggctgtttggtactcctcctctgttttcatagtaaacttaaaacatagccttaatcatactatatcatagttggctacttgtttttcttgtcaccaaattctgaattttacttttctcacttacattgccttcctggaacctaaaagcatttgggcttgttatttctgtttaaaataacaaagaccatcaacaaatttccagtgaaattatagttgtggtggggatgatgatgatgatgatgatgatgatagctacatttattgaactctatgtcctaggcacttgctaaatgtttttaaatgttttccattataatcttattaatgatttcatttaatgggtaaggaaactaacactgagagaggtaagtaccttggccaattcatataagttatgagtggtagagccaggatttaagcacatagagtagtattccagagaccaaaaaataaagaaatcattatctatgtcctgatactaaccttatccttattactttatgagaaagagagcctggaaagtcaattcaaaatatttgttacatgtctactttatgttggattgaattaggtctttgaataaaacagctcttctttgaactttatctcctagaaagggaaataagatatgaacctccctaaataactaggcaaaatattataaatgctaaaacgtacaactactataaaaatggaaagagagaaagtttaaactggttgaggaaaactcaggaaagtcatcttggagaaggcggcatttgatatgtgcctgaacagttgagtcctaatgcgtgaagatggcagaggattgaagagtgcatgagatttgaagggtacttgtaaggaatggaacaaccacctcttattactctgctttatggcaaaggagtaagatgaaggcaagaggccttcatagagctttctccctgcagagaggggaagagtatagtccctcatgactcagaatctcttggttgctgccatgcaggcatctatggaatcacaaaagcaaggcccaggaaactttaaactaacctatgcttcccgcccagaattcagtctatttccatattagtgggtgccttctgtccgtacctatttctgtgtgcaatgtgttgagtcttttgagtggtggcttaacagcccaggagagaattgagctatactgaggcttcatatatgaacacagtatggttctattcttgaaaaggtttccagcgtccttttccaaaactatagagttgtgctgctcctgtctagaaagcagctcagtgaacttgaccttgacccttctgctgtatgaacttctcagaagattgcagatacttttattcaataagtctattccccctttttttgtttagtcaagtaggtaactattttgtgggtatattttctaaggtcaaattcctaatgataatagacaacctgaagttgatagtggccaactccgtgacattgctacttgataaatataccaatcttaggatctcttcttttttttgagtacacaaaaatcattttgaaatgcctgacttgctagttttttgatgccttacatatggaatatgcttaataaattacatttgttatttactatatgtgactcaatatatacatatgcaagtacgtatgtgattgtaacccccattctttagtcctactctctgtcaagaataagaagcttaaaggtccctataaccaacacagaattcaatggcctctgtcgtgtaagtaatgctggcagctacaacaagcaatcccatctcagtggcttaacaaaacaaacatttagttcttgctcatgttataggccagtggggaacagtttgtgggaggggtttggggaggaatattgtgcgccatgcaggtattcaggtatccagacttctatctactgacctggctgtgccctaaggtctcagagccttgaagttctccactggaacctctgcaactggttgcccagacaaggagagagagagagagagaaagaaagaacatgtaaatttacaagagaggtttctggaagtaccacacatgacttctgcccaaattccattggctagaacaagttacatgttacatggccctaactaagtgcaaggggagccaggaaatgttgccttcctatgtatccagaagaaaaataaaatgatttgttgaacatacagcattgtctctatcacagcctttatccccttcattattccactcatttctagtattttgaaagtttcaaggtctcccccaaccctcagatgtcaagagggcctcctagtagattgatggagagagttggggatacataaagaatgcagtcttcccaactttacactactctctttttcctggatcatggctttctgcagctgcttctcatttagttcagtccaaaaacattaattgaaatcccaccatgaaccaagcactgttgtaggatctggggagtcaatgatgcacaagacagtctctgccctcaagatgctgagtctagtggggtcctctactactgtggcatgttctttcatcaactccaaagggctttctccagtgcttttccccctcccaaacttctgggttcttcagagagaggtcatactccccttccaactctagacagcaactctcagcagaagccctgctggtccttacaggaatagtctgtgtttccaaaaaccttctttgaacaccctagaattaattttgagggataagtctagaaaacataacccagagccatattcctgcttattattaaggtcctctttagattatgtcctcaagcatggcacacattcactgatgttctctggcacaaggaaaactctcatcctctctgagtggattggttgtcttaatggtcacagtacaggtcatcatacacctctggaggaagtctgttctccagtattgagaaaaattagcagtagaatcaaattccccttcacaggggaatttattcaattgggtcctggaaacagccattgatatcccatgattcccaaacagagacatgcaaatagaattctacaatagcctgaggttgtatgtgtgtgtgttcactcacacccccacacacacatacataaacacacagatatgtgtataaaattaaatttagaaagccattttgtagaagagactgacttaggcctgttaaataaaagtttaatttaacaaagcaacccggtatttttttcaccaagtttttaaagcattcaagatgctaaattttccaagatgagttttctggaagaagtcccaaaactcccttctctctctttttttttttttttttttttttttttgtgatgaagtctcactccgttgcccactaccaggctggagtgcagtggcacgatctcagctcactgcaacatccacctcccagattcaagggatcctcctgcctctgcctcctgagtaactgggactacaggctcacaccaccaaacctggctaatttttgtatttttagtagaaacagggtttcaccatgttggccaggctggtctcgaactcctgacctcaggcgatccatccaccttggcctcccaaaatgctgggattacaggcgtgagccaccatgcctggccccaaaactccctttctgatcacatcctatcaggcttagaaggggcaggtattttcttttggtgggttcaactccacctttgttcattttgattataggaaaaattcttaagatatgtgtgttttttttttttctgactacgtggtttctcctagtgctaaattctcaccatgcttgaaatattgtagagcaaagcagctctagttatcctcaagaaaaggatcaaagaagggaaaatatattaatgagcacaataattcaaaacctcttaaaatgctgttcccaagtgtgctgggactttctggtcatgtctctgcgaaatggatattttggatcttgctttagcatacacaggaaaccaatctccaggcagttcttccttataatttctttacaagtttccccttaaagaattcctaatgtactttcctcaatagtaacatagatttttctagagttagaaaattatgagaaaatagagtgagcggctatctcaagtgtgtttacttgtctagtcccctgatattaactagctatgtacctctaacaccaaggcaaccacattattgatttaatgataagctgtacagcagtgaaatcacattgtttcttcatagacacagagaaagcagaagcatagctactgttgtcaaggaggttaaaatttagatgtgaacactaaaagtgggaaccccaactggaacataagttccacgagaggcagccttattcactgctgaatctctagtgtcttgagtagtatctggaatatgatacagttctccagaattatttgttgaacgaatggagatccaacagcatagagcaatatatcaccaagtattaaaactgtaagaatggcaggagttcactgagaaaagtgaagactttatgaagacagtggagttgagcagagccatagagctatagacttccaataggtggaggagagaggagcgggcaaaccaggcaaagagagatgagagaagtaacacaggaggtaatgagcatgttgcagtgggaaagtgggcttggctctggtcagaggaatcatgcaatggattaatagaatccaggcaggtcagggatagggataaggacttagacatctatctggttttgtgtcctagcttcgtcatttattcaatagctgaataaatcaccccttttagtctcatttaatatctaaatttgagaataatacatagaacatatatttttaaaattcaagaagaatttataggttaaaaatggtaaacttgaagagcttttttaaaacatggtattatcattgttattatttatgacaacagtgttctggttgaccttttgattgtggttttcttagtgggaaaatagctcatataatggcccccgaatgtatgcctgggaagaaatatgttaaaaaatgaaatctagtgattgattgtttattggataatttcaaaatagtacaagggaaaaaattattttagtactcctaagtattagaaataattttacagttcaatttgtgtgattaaattattgtatattatatacagtcatttcacaaaattgttatgcgggaagtaaagatccgttcagtcactgagttagcaaaggaacttgattagaataatactcaaccacgtttgtattgtcaggaaatgttagagaaagctttagtgttgttaatgactcttggcatatataatactcctcgtccttaaagaacttgacaaacattgatttaagcctcttttcaaatatattccaaaactaaagtcattgtttctgagtatgccataaaagataaagtacgatttggtggttctcacattaaaaaaactgttgaagaagcagaagtgaaaactgcatattcatagagtaatgatagtttgggagatgatagtgttggcttaaaacaaattgggtggtatgttctgcccacaattgatcaaattgtggtcaattatatagacagattcagcaaatatatagtatttctgccgtactatatatatatatatgatatactatatatgtagaagatatactatctctctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagccaataccagagatcagagttggcacaggcaaaatggaacctacttactatcctagaatcaaggatagttctacgaaagtttcaaagagcctcccttatcattaatggctgcaaatatataagggcatataattaataatacataaatgcaggacttaaatgacagtaatatctcaatctcccttcccacgtgttgctttcttcattcatttggcccttcatttttattcattagattggtggctctctctctctctctctctctctctctccctccctccctctctctctctctctctctctctctcctgatagctcaccttatgttaagtgctaaagagaaaagatataagacctgcttgctgctctgaaagagcatgcaatatggtacagttagggagataagatctagctgtgagaagcagtcacacatcctgcttctttttaaaatgaatgtgattacttgagttgtttgtttgttttgaaaataaaaatgcactcaaactgaaaaaaaggaaaacggatgtatttcttcctgggtttgcaaagccacttctgatttcaaagaaagctgctcgataatttcttacgggctcaactctgaaagaagctcttagaaaccaaagtacctaattactaagtcacccccatccaaccatcactactgtttgagttaaactgcctttttccagaagtagagagaggaataggggagaggttctgtgatgggaaaagaatgaggaccagagtgattgtatatgttgctgtttctcgctattcaacaggcaattgaaggcggctgctttacaacattggcaatagtgccttttcacttaccttcttttactcgcagtttcaaggattcagatttggtgttttgattaggaacatggtccaaaaggcctgagttcaggtatcagctgtgcgatttcagccaagttcttaacctatctacatgtcagtaaaatgacattactgacatttttcatctgtaaaatgagattaaaaacagtgtcactgagggaattatggtgcactaaaccacccagcactacacccagactttgcatgggctgaaaaaatcttgtctagtattatcactggtgatgcttagttgactatattagtttccttttgccactgtaagaaatcaccacaaagttaagatgacttaaaacaacaacaacaaaaaagtgtctttttttacgttctagaggtcaaaagtcagaaatctgcttcactgggctaaagttagggtgttagtagagatggttctttacagagtgtctgaggggagaatctatttccttgccttctagtgccttggggccccttcttccatcttcaaagtatatcactccaatcatctctgcttccaccattgcgttgtcctcttctccaactacctcctggtttcctcttgtagggatcattatggttacattggacccacccagataactcaggataatcaaccatcttaaaatccttaatttaagcacacctgcaaagttcctttttgccatataaggaaaaggtgacactcacgggccctaggaattaggatgtggccagccatctttggggatcattattcaacttaaccacattgactaatcagattattcaacatcattgagacagtctgcttcatagtgctataacgcagagtggtgactgtgaaccttgaggccatgagggtttgagatgctaatcaaacaaatcactttagaaaactagtattttttaaactctagtgttatttctgtaacacccatctatccttccactcctgtcttatctctacttgctcagaaagaaagatgaaatctgataaagcagaacagaagagcataatcctaaaactcagatagacctgagttcatgttccaactgcaacctgatggctagctgggttaccttgggaaaattacatgattgcattgggtgcattcctcaaaagcattccctgagacaaagatttgaggtaggactttatctgaaagatgatcccaggaaagatggatggaaagtgaggaaatgagtcagagaatggaaagaagctaataaacagtatattatcaagcaggttactcctgtgggccactgggtgacctgtgggaagtcacaggcagacagtgtagaacatcagaggtatcctagctgtggaaaagaagctttcatcattggctgaggactgatccctggcacattatcttccgcacttccaggctgctcctgaagcaggctgagaaagccctggggagactgcataggatggcctacctctagtgagaaacactgagtgccacactggttgtaaatggggtactagaaaggcctctctgaacttcaaggatgatagtactcagcttgcagggattttctgagaattagggattttctgagaatcacatgctaaagcacctactagtatgcatggcacataataatcgctcaacaagtggtagcttctaaataatgatcatatcaaaggtttgcctttggtttctgcttatgaaattagtttgcacatgagaagatcactcgacatttttgtgcccagtcgttttttaatctctaaaatcagggaggagagtaaactaaaccatcccaaagtgtattcttaggactaataatctaagtcgtcatggcttagtttctcatgtcctttggcactataatttcgctctggcttctatgctgatgattgtaaactgacctcagctgatttggtcatgtatgactcttaggatctttttggtaaatcatagtagcctctgatgaagttttgaggtaagagttgcctgctcaactggcaacttcactactaggttataatgaacagaaattccagacaaatactgtcacaataaaacatccatcaagtaaacatttattagcaagtaaacacacagttacacacacacaatttatatgacctgttttgtaaacttgagcatgtgtcagctgttatttttagctcctctgacccccatcttgcacaaaatattccctgaaggccatcacaaagattccacagtcaggaatttgtcactctttggctagcatcagggatctagaatccctcagtgttcctggctgggcataggactatttagagatttagtctaggtcatcatccctgagggtgaagtctacaggactaattggattcttgtgcccttgtgaagcaggtgtgggaagtgtttctaaaatatttctgccgatccacatgtaaggaatacttttaatttcactgagagtcttttcctaacattcactggcctacataacaaactaccaatttcatcaacagaaaatctgtttctgactttcagtatgttaattagcaaagcattgcttgtgggttgagatacaggtaacaaaaacttgtggtagctaattgaaaagaccaccccggcattgtgccttcttgattagcatgcagacagctctcgggttatagcttaacctaagtaatggtcacgtggtatcacacagcacatgctgaagtttggggatttttttagattatagtaaaatagacataaaattccactcagcccttgacaaccaacattctaccttctgcctctgaatttgacaactctggatacctcatctaagtggaataatacaatatttgtccttttgtgactggcttatttcacttagcataatgtcttcaaggtttatccaggttgtagcatgtgtcagaatttcatctctttttaaggctaaataatattccattgtatgtgtataccatgttttgtctggttttttattcagcagtggacatttgagtcgtttctaccttttggttattgtgaataatgttgctataaacattggtatacaaataaatgccaaaagcattttgacataaattacagatataacaatctgctccttttactaggaacctaaggaacatgcaaactattgcttaatccttagtattgttgcagtttagtaaaacacttgtagcttcttagtaccttagtatatctaaaagcattggtcacgtggatcttcaaaataagattttagaaggaaacagttttaaactctttatttgttatcataagcctgatttcatatttcattccccaaacagcttttaaaaatatcatttaccctatagtcatttaatttcctatacagtactttcattctgcaaaaatcagttacatttctacagctatttggtaattctgctttgtttctaggatgcagttgcataaaacattatattctgtgacctcaacctcttcatctgtgaatgctgaaatgtgccttcatcttcctttccattgggaggtcccgatactttacagaattttaataacttccctctgtaagaccatgaatgtggatagtatctgctctgaattctgatgatggccacgaatgaatcaagtggattacataccagcagagattggagggcttggattctgtgcaggatggattgtttgtttccttaatttatatgtgagaatgaatgtgtttgtaaaatcaggaaaacccaggaccaggcactgttcttacctacaggtatgctgtcagaaagcccctgcccagacttctggatatttccttaacatgcttggaaagaagtgtgtttcctgagtgatgagttcccgggttctgaccctatctttgcaagtgatagactgcaagttcttagaaaagttgaccttggactttgatcacacatctgttaacacatttttattgagcacctactatgtgtcaggcactctgccaggtgcttaggatacctcagtgaggaaacagtgctccctgctcttgcggcacggcgtctagagctgctccttgggagccactggccacatgtggctaataaaatatgtttaagtttaggaaaattaggtaaaatttaaaattaaattcttcagttgcactagccacatttcaagtactagacatccaaatggagatgtcaggtagagagtatgatgctaagaaagaggtgaaggctacagaaatcatttgagaatcaatagcaggagagccttgggccagatggatcgcaagtgagtgagcatagagaagagaagagccctggcagttccatcattaagagcttggggataaagagagagaatcagcaaagagccgagaaagagaggccagtataggaagaaaacgaaagagagtggaatactagaagccagtgaaaaagcgtattgggatagagggagtgattctcgtgtcacatgctgcaggaatataaagtaaaatgaggatagaaaacaaatcattggatttaatatattggtgaccttgacaagaacaattctattagaaggtgaagagcaaaagccaaacaggaaagaacagaagggaaggaatgggagctactgactctaatagcagaaatttgctacaaaggatctttttttcaaaaaggcttaataggtagtgcactaacatttatgggatccaggccaaaatggaggcctatatacaatatttgtaaataggtaaaagttatttatcaagctaacaaactattaaacaaatatgtgctttgcattatattgacaaatataacttcataagaatctggaaaagcagattccaatttagaattattggactttggagttctgttctataacttggtggcacagggaaagggcctgaggcccacatgccttggcttccaaaccccagcaccatcccatactctgaagggtgtgcttgtgaggggcctgcatgccctggcctgcatatcccagccctgtccacacttcttcaaacaacgatcccctgaatatctcttgagtccaggagtgtgtaaatcagcaagtccaccctaaggaagatggacccagagaagaggactatgaacaccctgtaaggggctaaggaccatgtgggcagagaattctgaggtgcagagtacccatgatctagatggcaggaagcatcagctctgactaagcacttctccttggcctagcaaatgctcacccagagagagatgtatggctggagaagggccagaatacagaccttaaggcacagagccaagggcagctctctgaggtggtggggaaatggggcaaagaaaaagatttttaagataagagaaataacatgtttgctcatgagaacaatccagtagagtgggaaatagatgatgtggaaaagaaaaggatagccaaagccattatctgagtaggcaaaagggaagaggctgtggtgtgcaagtgtagaaatgggctttggatataagcttgaacagttcctctacagcagcaaataagaaggcagagcatgtggatgctgatgcaggtgaggaagtggatgtggtggtgggacgatgtggaagttcccttctgattaatcagcacatgtttctggaagatttctgattaagaatgccttgccagtgctgtttcaggtcaaagttgattatttttgttaatttaatttctatgtaagtctcactaataatgcactgtttttaagtatataaagtactaatattccatgttgtatagctctttcactggcatagtttctccatgaggaaactgaggcacagagagacaatcatttgtcaagggacacataacaactctgctgccattttctcctgacttatgatataacaggcagctcctactggccttttgaatgtttttcttgatttaggagtctgggggttcccaaataagagattttatttttaaagacttgatgggattatgtcaattttaaaaatcaataaaagaactagaaagatgaataagaagaatataactcctttcttctcataaattttatttttaagtgtcaaaacacgcaatttcttttcagatactgaaacctgtgatattatgtgccctttgcctactgcaatcgctttctgaatagtcaagtgattcagcgattacctctgtgcacccaaatcctacctgattggaaggaagtcaccggggaggggatggtgagatgacgcactaaagtaaaactccttgtttgtaaaaggtgaataaaaaccacttttgtgttactcatagagactgaattgagatcaactttaaaacatattttgaagaatttccagcttcatagaattaaagtggttaattatagacaataacataagagaaagagaagcttgttgagtgaggattctccaccacattttctcaaggacttcaacctttggctcactcttcctccatacccatattctgccatgatccttagtgactccaacgtccaacacaaaatgtcaccaccgttcagctcatccctcagcatagcttgtaactcatcagcattcagagatgctctccttcaaatatcttgagcattaaatttaccttagttgatccacattgcctcatacttaccaactttcttgtacatcctgaacctacttctcttcttcctgacttccagacccttgacccttccccacccttcactggccctgctccatcccattcctgcttctagccataatccatttcaagggtgttcttaatagctacggtgcactttcattctccatgctctgctagtttcccacattggcaatgatctccactgttggtctatgccatacaactcagaattgcttcattcatctcaggcaaaccccctttcagattctctatagtgctgtgttctgaacccttaacatgctcttgagaccacagttctacctttcactgaaggtcttttctccactatgttgagacattggaggatgtctgtcaggggttctcattcttttcttcccctcacccttcacagctttacccagccctccatcttccttcctgacccagaaggttcccctcctttctaagggtgagccatcaaggtctaccagaaccttgctctgtgaacgatctcctctcttcaatgtctcttcctcagtgattccccctttggcctgcaaacatgctacacacaaatgatttttttttcagttatctagacttttcagactccttgaatgattattccccttctctttcttggtgaatcctatggaatatgtactcagcgcttttggctcctactgccttacccgctgttttatgacctccgcctccctttctggctttacctccattccccacatgactcgtcctcaggccaatgcacatccccagctccctaccttctatctccatttcttcctccttctttgccttccccccaaaaaattctttaagggttattctccatggagccttcttgaggcagcacttctacaaatccatgctatctttctacccaactcttatttttttctatttttactgagatacaattgacatatggtaaaatgcacccagcttgatgagtttggataattatgtaacctgggtgaccaccacccaaataaagacagaacatttccagcaccccagacattttcccagttctacttttcagtcaactgccaacttcaccaagagacaacactattctgatttctattaccagatattagtttttcctgtgcttgaacttcatataaatggactcacacacgggtatgtatcatatttagcactgcatactgtttctgagattcatccacgctgttgcatttatcaataattcattctttttgattgctgagtactattccattatataaatacaccacagtttgtttatccattttcctgttaaatgcatatttaactttttttcagtttttggcatttatgagtagagctactatgtacgtacttatacaagtgtgcaagttttattttctttcttggaaaaatatctaggagtgggattgccaggtcacaggttaaatatatgtttaactttctaagaagctgtcaaactattttccaaagtggtttttaccccttttcattcttcacatcccaccagcagtgtgcatggagtctggttgctccacatccatcccctacttctgtgtcctccttcttggctttttttggcatcactgcctatattcttagagcatcttatctcatctcccctccacttgagcttctgagggactgcagttgtgccttcatcatctctgcacccccacactctagccttccttaaagctctaaatttgtacagaataggataatatggaatccagcgaaggagccagggattcgggagttctgtacaaacaaccaagtggcccaaccaaatcaatatgatccgactcacccagcagtgtattacagtattgcagcttgaatgtggggctcctgcggccatttgtcacagtcttcaggaaaggctttttatcagattcatagtggcaagtgatacaaattattggatttcttttccaacataaaaaatagctatttgcagccttttgaagctgggtaaatgagccattgatcttacctgtggaacaccgcagggtatttttgtccatcctaactttcaatattctatgatgggagcccacccctccagccaagctggtctaatcattattccttgggtgtgcctgatctgtatcctcctccataccttttcccacaatgtagagaaaatttttagtggaaatgtcctcccttttcctcctcctagaagctgtcttcaaggcctggcacaaatgccagtacgtctatgaaggcttcccagctgcatcatcctgtagtaactcttctctcccatgaattattacaaccttcccaggatgagatgacggcctccctcatagcttcctggacttctaaatagaaagaggaatctgagaacagaagagagctccctaaatgacaagtgtaccccagatgtctgtggccatgtcccagagggccagctgcaatgcagggcctctcttttgatgtcccttgttcacaacgagccatttcacttctagtcaggactatctgcctcctaccatcatcttgaagcaataaattgcttcagactgtgtttcatcacttaccagtcagtcaagagcttgggttgcattcaagagcacatgttagagcattctgtctgctgagtgtgtgggaaggcacagagtaacatggccctgcctcatgtcgtcagtgcaggatgctcatttccaagggggacaagaaacattcagcttaaatttggtaaatatcttgaacaaaacaagaggagtctaaaaaccctccaggtttcttttctcttattctgtctcactctctgtcaaagcaaaccagcacctggtctgtttcttcatatgctctgggatatcttcctgaagaacagcctgaaaagcagagtcttctcttgccattgtccacactgatctccaggaaatccttcatctttaaccctggaaaatggcagctggagaaccaaggaataccaccctcccatgcttccttattttccctttccagctttggtactccactctgtcctcacctcccatttcctataaaatatgtttattcattaaaaagtatttaatgccttattttttattatttttattttttttttatttttttttttgctaagacactgtggtaagaattagaagtccaacaacagacaagatgaaaacagtgtctacttctggggcttatattttactaggagatatagacactcaacgagtcatctacaaaagagtatcctgactgccatcttagtaaaagtacaaggactgtgggcatatgagaggggcaaagaggccaagctcaggacatctgggaaggcctcagagaagaactgacccataagctgatgagagttacccagaagtcagctggaagccatgagggtggcatggcacagaggacatgggtgggggcacccagcaactgagagcatggcacaataaggaagcagtggcaggtatgagagggagtggtgaagacaaagctgaaaagggcagcaaggatattcccatcacaggcctttcttgtacgttctaagaaagagtagggacttatagcaaaggggagccatttataagctcacacaggggaatgagggcatcccttttgtgtttgcaaaggccgtgctgcagcagcactgacagcatggatcagagggcaacactggacaggcgggaagacagaggagacatgacaatggcttccatgaggggaggggcagtgctgatggcgtacatggaggcactagtgatgtcacggagaggaaggagtaaaggatggggctctggtttcaggcttgcgcctctgggataatcgtagcacacccacagaagttgggaagactagaagctgcagatctagggacagagggaagccatttcggggatagtttgctgtgtatctgggcctcaggagaggcctggaccattggggtcacaaatcatcaaaactttgctagtcatgctgccctgggagtgggttagacagcccaggagaagaggagggatgctaaggagcaggcaggtaaagagaagcccatggagaagactgcggggccatcagcgagtgggggcaaccaggagagaggctaccatgacagggcttggggaagagttttgcaaggaaggcagatgatcaagcaggtccagtgtcccagaaagacctttttttgtttttgagacaagtcctgtgctgtcgcccaggctggaacctcaagaggcttggctctgaagggaggagacagagagagcagcagcaggagaagggtgtggggtaaaagaatgggttggtttaagacaggaggaacataaacaggactttaatgtgttttagaatgaagaggatgagtgaatgaatgtttggtgagaagcaattacaggatataaagcaaataattagaatataggcacagtgtttactgacttaaacacttaacaacaaaattatatgatagtggactgaatcctcagtttgcaaaacagagaattcagttccatgtggtggaggcagcatagtgagcaggttctggagcaaacctctgtggtgcattcccagttgagggtggctaagggcaagtgacctaatctctctaccagaaatggagataatcacacccatctctcaggcaacaacaactgagctcagttagagcgcaacaaatgtcagctctaatcagctactgaaacctaacattaagggaataaaacgtatctggtggatactcacccagtctgctaaaggtacagaaaaatgtgttcatgtgctgttgatttctaaactgctgaaactcagaccagtcctcaagagctgggcctgttccaactgtggaaacacttagggtttgtattgtttggctacaacgtgggcagcagagtgtccatcacgaaggccatgtgtgcacagccaagaaaactcttttaggttcctacctgtctctttccagagccatccctctggatttcagatgagatttccctattaaggagggatgccaaatgctggggatttcataatactcccaaccccaggcaccagatttgtgtaattgcagtggtggagatttaattgtcctttgaagaggccccatactgtttgtctgtcaaattgtctgcatgttggtgcagttgaaattataggagaagaggaaaccaggggtatgtttcaaagtagttggcacgtggttggtgatccatagtgcaggtttcctttctggaaggtaacaggactgtgttctcataaggcagcatggcagggtggaagccatatgggatttgccctcgaatttcagcgctgccgttgagcagctgtatgaacttgagctatttgcatatcttcttgaacttttttgctcctctgtgaatgaagccattgcaccagcatgttttcaggattaagtgagacaatatgtggaagtgcctggcacacagtaggtgttcagtatttttttattttccattctctgtgtccttgttttgactaccaggtaactatgtttaccctcagagatctgatgtatttcttcatatcaagtatatatcaagaatttcatccctcatcctaatgcattaaactcactgcatggaagttataccattacctagactcaccacggtcttgtcagacaccagcagagttttgtgtggctgcaatagagatgttattgccagttgtcagtattgaaatgaggcactccttcatccttcagtgaaatctgtgcaggcattttcctttctctggttaaacattttatagtctcctttaaaaacaatgccctcatttcatttcctctctctggctggactcttctcctccctcctgctttcctaaaatccatcttgtttccctgtattgtttgctgaatgggcagtttaatgaatacagcatttccattttgaaatgtacagagcacaaggcagaaactgaatttcctcctggacagtttccatccacagtcctcatttccagttttctcccttcttttcttttctacaacacaactgaaatttgctgaaccagaaaggggaggaaggaggtgtgacaggagaggcaatatgccttctcattgtttcagcaaaagcttattagcatcctgctccctagaagagaccaagtgccctaaagatgccctgggtgcctcttctattgcacaaagctcaaggtccagagtatacagtgcatgacagaatctaattaccaagataattactgttacctgcactacctaactgttgtgttttgtaatcaaaagctatattggcaggggtgagtgtgagcctgctgaaaactcagggaaactgttgaaggtttatcaacccgaagcaattttactctagttagtgggcctgtgttgctcagttagcagaatgtttggggatcagaagaataccccagagcacttcagccattgcatagacattagttaccgggtaggaatatcctcagctgactcaggtattcatgttgttgaaaccagacttcatggcaatttgaaaacgtctgtgccatttttaaatttgttctcgaaatagttgatcagtacctgacttagccttcatttggcattcggtgaaggagaaattgatttcctttgggcatggctgtatgtacctgatgggtacagcgtgtgctaagctggatgtaggtatgtattcatactatcaccacctgcttcatattcattatggcacaaggttacaaattggctttctgtttcccatctcagccagctctagttaatttatgtctttacctctgtgcttcacacactaaagaaatggagtttctactttaaaaatcaggtgtattgaaaaaatggttataattgtttttttaaatttttaaagaaattccaagtggaaaacaaggaataagttgcaaaagagtatgaaaagtttggtaataaaggcaaggacacttaaaaggagggagtaaaataacaaagcaaaatgggtgaggctgacaggctataaattgaaaagggagaaggggtcaaggaaaatgcagacaggaagaaaagagacagaaaaagaaatgatagggccttgagtaatggactcagaaaaggaaataggaaaagttaagaccaaagtaagaattatggagacaaaagtcaaagacatccaggtctcaagaattacaggttattggtggcctgggaggtagtgaagaggggctaggcatatccctcatgaagttagatgtctgaattcctcaggacagtgtgacagtcagggagaatgtcccctgaatatgctaattcagactctaaaataagagccagccagattcattaccatggttggccagcctgtaatggcaacagaattcactgatgcatattaaactgaatttttctaaccaaggtcttaaataaacagacaccagctataactgaaaattagaataaggccttcagtggtgactatttctgtagggaaagtctgaaaacccttaacatggtttttttccaaatttttagaaatttgtggttcttaaggctgcttagtatgttagcaattgctccagtgcaggactgtgtggatccctctggtattttcttttaactttctgcaaggcagagagtgtggctgacctgtgatataaatgaaaccccgtggcaggaacattaactccatctacaacaaaggaacatgtagagatttggattctaatgaaaataatagaagctccttctcccaaagttgggaaatacagaggaggtcttctcagccagtccaaatttgcaaaaccagaatcatcacagaaaggtagataataggaggcctaagagaaagctcagttgtcctttggcctatggcctttgggcttgctgtagatcctctgttggcaactggatgctctgttgggtccaggaattgatgataaccagtagtttgtgggtagatttccatgttgagcactgccttcagctaagtgctttcagttgcctcttgttatggttggagctgaatgacctttgtttacgtgtgtttcaggctaactgatgaattacaagattttcaccaatgagtgggaaatgtagcgataattattcagactgatttatatttgtctttgggctggtttttcatgtatatttttagacattttaatatatttggatctgattttttataaaatcatgaggttctctttatgctcaagtgctgccaagaagttggacagccctcctgttcttctcccagttccccagtccctattccagatgaggggatgcagagttagttgtcaattcattcaacaaacatttattcagcagttagagtgactatctcatctcagtttccctgagacttttctggtttgagcactgaaaagttctatattctaggaaactcctcaacctcaggccagccaagacagttggttaccttatcatctaccatgttccaatagagctaggagagaccctagaaatcatgacaatttctttattattattaattactttttaatattcttcttttttttgagacaggatcttgccctgtacccaggcttgagtacagtggtgcaaccacatctcattacagtctccacctcccaggctcaagcaatccccctgcctcagcctcccaagtagcttggactacaggcatgtgccatcacacctggctaattttttatttttatttttttgtagagacgaggtctcatcatgttgcccaggctggtctcaaacttccagtctcaagcaattatcctgtcttgatgatttaaattcaaagaaacctagcttcccaaagtgccaggattacaggcacgagccacagtgcccagcccattctgatttctacacacccattttaaagtgccagttaaagccaaggagacctctttatcaatttgttttccttctgattcacacattccctggattggaagagataattaagttctatggttgaagatgttatcttcaggctgcattaaagaataaaattaaataaaaggtcatgcagtgtgccaataagagttttacaagccagttggaatttgaaaattagagagtcaaaaagataaagtgaatcaaaaatcatttatttagtattgaggtaccttttggtacatcaaagagatcatttataaaatagtataatgtaaggaagttgaaagaatgaactacagtggaatactattattatatctacttatgcctttttttctggaaaatgttcacaatgatgtgaaaggatctaagaccagcctggcagccaccagatggtgattctagtcctggctcagtcagtaataggtcactgaccccagagaaatcaattcagcctccccaggtccttggatttctttctgtgaaaatgaaagcataggtaggaatttcccatggaacagctagcagaggagaaatattaaaagtcaggagactcatgctatagttttcatacttcattacaacaatgttgtttaggacaagtgagttaacctgttagcttcctctatataaaatggaaagtcattaaaaacctacatagcagggttcttgtgaagatcaagtgataatgtaggaagcatgtacaaatgtcacattctgccgtcacgtaatggtcctcacagcttgaggtagcatttagcatgtgtcatgatttagtacaagggttggcaaactgttgctcttggattaagtctggctcattgcctgtttttcaaagaaaaaaattgtatatgtgtgtatatatgttatatataggtacacacacatatgtgctatatatagcatatatacacacataatatataaacatgtacatatatagcattatatatatacgtgtataatatctccagtcctcatgaccagccatgcttgttcatttacatttgcatactctatgattgctttcatgcaacaatggcagagttgagtgattgttttgcaacagagactgtatggcccactaaacctaaaatatttagtctctgaccctgaaatgtaagattgatagcccaggaccaggcgtggtggctcacacttgtaatcctagcactttggcaggccaaggagggtggatcacctgaggtcaggagttaaagaccagcctggccaacatggtgaaaccctgactctactaaaaatacagaaattagctgggcgtggtaatgggtgcctgcaatccaagctactctggaggctgaggcaggagaatcacttgaacccaggaggcagaagttacagtgagctgagatggtgccactgcactccagcctggacgacagagtgagactccatctcaaaaaaaaaaaaaaaaaaaaaagatagtccaagatccaggattcttttaggttctgtgtcactatgtgatctcaggttaatgatttattgtttctgattctgtttcttacactgtaaaaaaaaaaaaaatggtgggggggaatacaaatccagccccttctttcctcacagaaatgttgttaagatagataagaaaacaaaatcattgatctcttctggaggaaagatgatttaaattcaaagtattactcataaggtggatgctgttagatgactcagaaatgatgactgatgtgttattattattctctgaaattagttccctcatgtacctcagtgggggattacttagaacagcgatagcatacagacccctgcatcgtgacactacatcaaaagctaagatactgcaccagaatctaatttaatcacagtacccagtcaggagtgagttttaattgtttctttatccctttatcctctgaagactgtcattaacatttacaagacatgaacttcagatcatgccaacatctctgctgaggtcacctggcagctagccattttagtccatgatcaagacagaggggccttctgggcacatgaggagggacaagacagaacagtagtggtggtagcacataagctggtttacagagcaaataccaaagataggcttgtttctgttaaaacttgaatttatattttattcttggacacatgactgatatccaggctgactaagaacatacacaagtaaataacaaaactttgtctaacacgtataaatattaggacctcctttttccccaagaatcccctcaaacctctagggaggatctccctaaaggagcagctcttcatgtggctgaaagcagccacataaggaggctaaggctggcctctgaaagttacctcggcccaggtgcagcccatttatagaccctctatacccaactccagatttatggcatagataaattagtgggcaatcatttgctctataaaatgattcttcattttacaagcttattcactgccgcattcctttactgatctattcctttactgatctattcctttactgatccctctatacacaactccagatttatggcacagataaattagtgggcaatcatttgctctataaaatgattcttcattttacaagtttattcactgccacattcctttactgatctattgccactagtgcagttccaataaaatctcattgttagaaatccagtacacaaatgctttttcactgctaacctggatggaaagatgaagaatacaatgcacttataatccccttagatcttatgatgtggctttggtcaaagtcttctgttctcagtttaggagcttaatgttccttggtacttacaattgacagggagagacaggacaaaagattctttaaaataacaatgaaacaatatgtgatttcattaactaacttgctctaattatctgcatgagatttttaataaaaggatcagtcatacagaaataagctaactggccttttgatgatgagtaataatgatactgacaatagctaccatattgagcattaccatgtgccccatagcattctaactcattaactcattgaagctaaaacctaaaaggtaagtataattattttcatttctgtattacagatgaagaaattaaggcacagagaagtaaaatatcctacctcatgtcacaagctgctatatttggagtcaatattcaaactcagtggcactgactttataattttgctactaaatagttacagtgctgtattgacaagtaaagcaactgtcaggtgctgaaatgtaggagcaagagcaatacataacatgtgttctaccttcaagaaactaataagaatttctgcctcaggccattagagaaaaactggtttgggacttgtcctttgccataaaatgaaagaaaaaaggaaaactggacaaaatatatcaaacaactaatttcataccttggacaacaggaaggttgttgttggacaacaggaagccaaagtggaaagaacttgttgggtatatagtaaattgaacagagaccctagaagggccttggtgtaatagtaaggctaaactagccctagaatcaagattattttagactcactctggtaaaacttaaaaacaagacttgaaaggatcaagtacatctagagctgccaaaacaatagccaacactttttaaaggaaaaaaagacaatctagacagacactcaacatgtaaaatttattatatctatcattcaatcaaaaattactagacatgtaaagaagcaagaaaatatgacccacaactagaacacccactgaagagaagcagacctagaaatgatagtgatgatgaaatttgtagacaggcactataagcaactattatacatatattcaaggatttaagagaaatcagaaacataatgaaaagagaaatggaaactatagaaaaggaatcaaatgtaattctataactgaaaaatacaatatatgaaataaaaaaattcaccttatgggctcaacagtagattagatactgccaaataaaagatacatgaactcgaaaagatagtgatagaagcaattcaaactgaagataaaatgaggctgaagataaaaaggctcttgtaaaaataagaacagagtctcatttttaaataaaaataaacagagtctccatgacctgtgggacaacatcaagcagactaacatatatgtaaatggagtcccagaaaatgtcagggtaatggcaaaaaaacctgaggaattaatgactacaatttttccaaatgtaataacaactataaactgacatatccaagaaactcaataaaacccaagcatgataagcgacaagaaaatcattacaatcaactagtcagaaagcagcaatacaaaaaaaacttaaaagcctccagagagttgaaacacattatataaaaaagaaaaagatgagaataatcactgatgttttttgagaaaatgcaatgtcttgtagaagacaatgggtgacatctttaaagtgcgtgaacaaaaatctgcccacctagaattctataatcagcaaaaatattcctcaaaaataagaatgaaattaagaattttttagacaaacaaaatttgatgagcaattttttcaccactctaagaaatgtcgaagggaatttatcaagtcaaaataaaataatgggaactcagatttgcacaaaagagaaaagtttctaaattaataaatatgtaagctgggtgtggtggcttatgcctgtaatcccagcactttgggaggccaaggcacgcggatcattgaggtccggagtttgagaacaggctgaccaacaagctgaaatcgcatctctactaaagatacataaattagccggacatggtggcgtgcacctgtaatcccagcttctcagcagcctgaggcaggagaatcgcttgaacccaggaggcagaggtttcagtgagccaatatcacaccactgtactccagcctgggcaacagagtgaaactctgtctcaataaaataaaataaaataaaataaaataaaataaaataaaataaataaaataaaataaaataaaataaaataaaataaaataaaataaaataaaattaaaataaaataaaataaaatataaaataaaataaaataaaataaataaaataaaataaaataaataaaataaaataaaataaaaaaaataaaataaaataaataaaataaaataaaataaataaaataaaataaaataaaataaataaaataaaataaaataaaataaataaaataaaataaaataaaataaaatataaaataaaataaaataaaataaaataaaaaataaaataaaataaaataaaataaaataaataaaataaaataaaaataaaataaaataaaatagtgagtaaatataaaaggcattttggtttttaaaatagcttgaaaagtaaatggactgttcaaataaaaaataataaagatataataatgatataataggaaaaaatatatgataatagcataaaagaaaagagaataagtggaagtatactattgtagaattcttaaatatatgaagtacatatctaatgaagactgtgatagttaaaatgcatattgtaaatgctagagcaaccatttttaaaaaatggtatagccaataagccatagaaaagatgagatggaatttgaaaagaaaaacctcatatgaaatgaaaggaagaaaggaacagtgaaagaataaagaataaggtacaaaaaaatcaagatgatataatacaaactcaatatatcagtaattacattaggcataaatagactaaccatgccccattaaaagacagaaatcgtcaaactgaataaaaaaagcaagattcagttatatgctatttacaaaaaaaatattttaaatataaaaatagctaggttagatataaatggatagaaaaagatatacagcaaattctgtatacgtgaaggctgtcataattgtactatctgaaaaagttggcttcaaaatagagaacattattagagaggaggagggacattttataatggtaaaataatctattcatcaataagacacagtgatcttaaaagtaaattcactcgccgaggtgggcagatcacaacaaggtcaggagtttgagaccagcctggccaacatggtgaaaccccatctctactaaagaaaaacaaaaattagatggacttggtggtggacacctgtaatcccagctgctctggaggctgaggcaggagaatcgtttgagctggggaggtggaggttgcagtgagccgagattgcaccattgcactccagcctgggcgacagagcaagactccgtctcaaaaaaaaaaaaaaaaaaaaaaaaaagtaaattcattcaattacaagctttgaaaactacatgaagaaaaaactgacagaattgaaagaatacacacatctatagttgtggctggaaatttcaacacttctcagcagttgttagaacaagtagctggaaagtctggatatggaagattcaaacaatactatcaatcaacttgatcaaattgatattacagaacactgcattcaacaacagcagggtgtacattctttttaagtgcacatggggtattcaccatgatagactatatgctgggttataaaagcttctcaacaaatttaaaaggattaaaattatatgaggtctgtttgttgaccaccatggaattgggtaagaagtcaaaagcattaagatatcaagaaaattcccaaatacttggaaattaaatatcacacttctaaataagccatagatcaaagaagaaatcaccaggaaattagaatttatttgaaccttattgataataaaaacacaatatatcccagtgtatgggatgaagctaaagcagtgcttagatggaaatgtgtaggttaaatgcttatgttagaaaagaagaaagttctaaaatcagtgatctagcttccacattaagaagctaacaacaacaacaaaaatactaaccttaagtacgtagaaaaaagtagaaatcaatgaaatagaaaataataaataatagagaaaatcaatgaattttaaaacggactttttgaaacaaagctataaaactgataaactatcaagctggtcaagaaaaaagagaagatgcaaactggcaatctcaggtgtgaaacaggacacatgactacacatacgtcattaaaagggcactaaaggactctaatgaacaaacatatacaaaaaattcaacaacgcagatgacatgcataaattccttaaaagacaaattgctaatactgattcaagaagaaataaaaaacctaaatactcctataaattaaatgaattgaattcataagtaaaagcctttactcaaagaaaaccccaggcccaggtagttccctaattaattctgtgaaccatttaaaggataaataataacatgactatgcaaactttaagaaaacagagaaagaggtaaatacttcccaactcattttataaggcgtgtatgacactgatatcaaaaccaaagatatggtaagaaaactatagaccaatatccttcataaatatagacacaaaaattcttaacaaaatataagcaaattaaattcagccatatgtaaactggataatatactatgttcaagtggcatttatcttagaaatttaaggttggtttaatatttttaaatcgatcaatataatttaccacattaacataataaaggaaagagtatgatcatttcaggaggtgcataaaaagcattgcacaaaattcaacacccattcataataatgacttttggaaaattaggaatagtgacagcttcctcgacctgttaaaaggcagtgatgtcaaatcttcagtttaattatgaaagagtgaatgctttcctactacgatggggaataagacaaagattcccgttctcaccacttctatttaaacatcatattgcaagtaccaactagtataattagacaagataaagaaatcaaagattacagattgcaaaggaagtagtaaaattattattatgaataaacaacagaattgtgtactgtcaacctaaataactaaaagagaggggctctgtgaaagaaagatgtttatctgggaatagagctttgcaatggaaatacctaggctgtagttaactatgtgtgtattcagggaggtaaaggaagacaaagctttttcaaggaaaaaatgaggaagattacataattgttttaaaataattatccttgactacaaagatcaataagaagggtgcgatgggtacgctaaaagcccagacctcacaactgcacaatatatacacgtcttctgcacttgtacccactaaccctataatttaaaaaaataataataaaaaatagcaagagtgacaccttctgaggttggacaggtagctgctgggcagatgtacttacagaagtaagttttatgcaaagtcttgatggtctctgtgcaaagttgtggttttagcggtcttttttgttatcaggcatgcaagcatgagaaccctctcttcgtgaccttccctagctgtatttgtttgggttttcataacatttatgccttcatttttattctgataactttcacagtacatagaaaatcctaagaaaactacaaacatatgctgctagaagcaagaagtaaacttagcaaggtcacaatatacaaaattaaagtttatgtctgtatactaaaaactagcaaataatattttaaaaaataacatcaaagaacatgaaatactcaagaataattttaataaaatacatgtaaaatttaggagatttttaagcagacttaaataaatgaaagaaaaattttgaaaaggagaaaaaaaatttgaggacttactctgatttcaaaaactttcatctacaataatcaaagtcatgtggtattggcatattggcataagaatagacagatcagtggaatagaataggtctatgcgtatatggtcacttaattttttacaaaagtacaaggttattcaacgggaaaaggatagtctttacaacaaatagtgttaaaacagatatccttaaggggaaaaaaatgaaccttagcccttatctcataccctgcacaaaaattaactcaaaatggatcataaacctaaatgtaaaatcttaaactatgataattatagaagaaaatataggagaaaaatcttttgacctcaggttaggtaaagatttcttagattactaaaggaactaaccatttaaagaaattgataagttggacatcatcgtaagtaaaatttccactctttggaagatatcattaagaaaatgaaaggcaagccacagaggagaaaatacaatacatacgtctgacaaaggacttgtaactctcacaactcaattaaaaggagactaacaagaaaaaatgagcaaaatattttaacaaacatttcacaaacaagatacaccaatccccagtaagtacatgaaaaggtgcttgagatcattagtcatcattgaaatacaaattaaggctaggtgtggtggctcccaacactttgggaggccaaggccagcagatcacttgaggtcaggagtttgagaccagcctggccaacatggtgaaacccccatctctacaaaaaatacaaaaattagccaggcgtggtggcacgcacctgtagtcccagctactcaggaggctgaggcacgggaattacttgaacctgggaagtgaaggctgcagtaagccgagatttcgccactgcactccagcgtgggtgacagagcaagactccatcccaaaaaaaatgaaaaaaagaaaaagaaatacaaattaaaaccaagacaagacattgctaacattcactaaaatgtccaaaacaaacaaactatgcaataatgtggatgaattcccaaatcattatgctgagcaaaagaagccagacacaagagatcacactgtatgattcctttcaggcaaaagtataggaaaggcaagcctaatcaatagtgacaggaatcaaaccaatggttgcccgagacgggggtgggaaggaatggactgaaaaggaccatgagtgaatttttaggagtgatggaaatgttctgtgtcttattgctgtagtagtcacacaggtgtgttcattcgccaaaacttgtcaaatatacacttagaatgagtattttctattctattcaaattttgcataaaaagaagcagctattttgttgttcatgatagaagcaatattagcacttactgttctctagctctttcccaaggttttgcagcactatgaattcctttagtcactcagagaattaggaaattagcatgggttgttttgatctgattgggcatcacaataggaactgacctttctgtcttctgagctctaactttggatctcatgttttgctcctggtgtgtaagtcctagctctcctatttgggcctccttaagggtgggtgcttggtgcaactgtcatagtcctttgcttaaaactttctccttggccaggcacagtggctcaagcctgtaatcccagcactttgggaggccaaggcaggtggatcacctgaggttaggagttcaagaccagcctggccaactcggtgaaacctcgtttctactaaaaatacaaaaattagccaggtgtggtagcaggcacctgtaatcccagctactcaggaggctgaggcaggagaatcgcttgaacctgggaggtggaggttgcagtgagccgagatggtgccgttgcactccagcctgggcaacagagcgaaactctgtctcaaaaaaacaaacaaacaaacagaaaaaactttctcctcagcttattttacgaacatagttgtaagttgaatgaatgcacgcctggagagcaattgggatgcactactgtggaaagtagaggtattcagaaaaggctcaacagccatatattagggatattatgaagtgatttaaacattagatgatggttggactagagaagttctttcccagtcctgattatgtgaaaagaaagcttccaagggcaggagacatttctccacagggggaagtgagtctaaatattaggagggtcagtagccattctgacaacctacccaccatagacagagtgggattcacccctaaaccagcagagtggttagatgtctgtcaccaggcatgtgggtctgaatcagaagaaagagaaggatatcattttggaaatttacaagtgagacatgaaatctaatagaagggatttcaaaaagcacagattcatatgagaagttccctggaaagaaaagatgggtgctgatgtgggcaggggccatctgaggatggcagcttcacagaattgccctctcactccactctggggccaggactccccactcctgtagtcttctccctaagatgagtaaatatgaattcagcaccaagtaaaacggcctacacatcctctcaccagactcttttgcttataatcatcattattaccttaaagccaaagtttactcatctgtaaaatgaggataataataattatagaatcattgtgaggctttgataagataatgcctgtaagtgtttagtacaggctcatagaaagtacttagtaaatcctggctatgattgtggttatgattttgttacttgtttcatcattaaaccatgtatcatttactccggaaacaaaaagtaggaatgctatttcccaatctctgtaccacgctcacagcgaaacagcctgtgccatccactaacatacccataaacaatctccactgcattacaatcaggaacttagggaaaatgaggcttttttcttgttaagctttatctgcagaatctcaagtagtttttagctgtgctcttttatattccagtcaacctcatttccacagatgtactcccctagattgaaagttccgtgagagcaggcatctggtaaattatgcccaccactctttccccagggcctagcaaggtacttggcacttagtgggagctcagtagatataagatgaatgaatatggtgccctttccaaaatccttctacgcaagtcctgctgcactagtcgctgccctgctatggatgcaaaaatgagtgaaaggttgatacattgtaaacgtaactgtgatcattctgagtagtcatttaacctctttacagcagctggatgattatttctcagctatacgaaattattaaataagaaataattcatgcttcatgttccatgtcctccatcatgaggcctttttaccagtttaattagttagtaaaggacagcacgctttcctctccaccttttatcaagaattctaaaggctttagagaaaaaatgactcaggaggtgaaacagcaggactcctggtgttatttataaactcgtccctggcatctgcagcagcaaatctcaagcatcgtttaccttgccccgtaattctggagtttgagtataaatgatgaaacagctaatggcatgttacccgacaaagtagcattagcttcctctatcatcgtcagctgttttttttttttttttttttttccacaaaaatgtgtaaattgcagtttatctcaccagagaagcatttgatcaaatgtactttaattatattttgtgtggctactgagaataatcactgtttcttcatcataaggattgtcctaaaaaattatattaacgtgggtcaaccataaacagcagtgggaatttagctacctttaaatgctaaatttacctctcagcttgtagatttcctacaaatgaatttctttgggtcaagattttttcatgagcattggcaattagtggatattccttgaaccaaccttttactttaagtgaaatgtatttgcattaagagcatattcatttcccaggctgcttcttaacacatttgtttccctttgttttggaattcacaaagcttttcatggtttgcctattcattccctcactgcataatgatttatagtaggttatattttagaaggttttgtgtcaaaaaaaaaaatttgcatctcttcatcaggtagtcagttaaagaggctgcgttgagctgccaaatgggacgctgccaggtgaccaagaaagaaaagcctacttgcataaataaaacgaaagcatattagaacatttagctaacattcacccaatttttcatagttggcaacttctaactttgtttcatcttcaaggattatggtttgaagcaagggtaattcgccttgtgtcttccttttagttcttccctcagaacctggtttgggaaaaacctcactaatattttgtagcatcagccaagtagttgtcatcttttttgtaaccaactgccttatacaaaagcatagacacacttattttggataaatccatactgtctgacacataagcaaatatggaaaatataaaggaatccaaaggctctcacacagatcaattttcttcattggccagagctgcctctaaagaaattcacatgacaccgtcttcatttttctgaacatgatacatattattcattagcatttaagcttatatctaatgcacatttttagataggattttttagtagtaagacttttttatatgtctacctattattatccatggtagagtttcttgtgaccttgaccctgtgatatctggaaatgaaaaaagcccattttgtttcagactcttggtccctctagctataattctacttctgacagtggcccccagaggcattttgtggagggctgctgccactttgacatcacccctaaaattgttgggcacaccctctctaaaataattttatttctcattatagcttaatcactatgaatttctactagagtcatttaaaagaacaattttagcctgccctacttgttgggaagaataggggaaattaacagcatcttgtaactggaaggacccttataggttcctaagactgattccaattccaaacaataataccagtccgtaagtggatctgcttatagagaaacacctgttgcttctgttttttgtctcatatccagttagtttcccattcacagcaaaacattcccttcaatgccaaggaaactcaacctttttgattattagtatagtttcatcaaagtttctttgaaaggtaaaatatcccctttttcttgcctataatttttaaacctttttaaaggttgtaaagaattagttagtcaaggcttcttctcataaagccagggtttcttttttcctagactctatgtgcttaagtgctctatgataaaatgtggatgttataaactcatcagcttggccatgtggaagtgaaaaccactggtcagaggtgtgtggattctcccttgtgacctatctcatattactgtgaaccagctggcccccaataccataagcattaacaatggctgacaaaattgggactccagctccattgtgtcacctgggcatctgtgcagcactcctgccaaacagtcctgctaaactattccgatttcagatgggaatttggtcagaaacagcattttcttgtaatacttcccacttttctaattcccttgtttctggttgccaaaagaatgggaggtagacaggaagaggtggggaaaaatgtttaagttcaaatgtcatctctgctaaaacctgacttccactgcactgtggctttgtaacctccttgtgtttgtagccagctatcaaaaatctgtccatttgaacatgattatactaaagcatgattattttaaagctttcattataaactctacactggaaataatctttagggtgttttcaggtttgaaaacccatatgcactgaatgttctcatggtgtgctctgtcagaaacaatttttaatgatgtttcctcagtgagcatcattccctagatgtggacagagctgcagaaaggcatttacaaggagtcatgctggctcagatgggtgaagagggaactttattgacgtcagaccatgaaaagagagtgggcaataaattctgtatagacaaaggtgaacacaataaactgagactgacatataaacacgagtacaattcaaaatacagtggtaaggaggtgtggatgtttctttatagctgtatatgtttttgacacacccgcacacacagaaaattataaagtcaaagataatgaacctagagtcatgtggaaggtgtgaggtgggtcaagggagaaatagaggttattaaggagtataggtaggtattgaagaagagcctcattttatacacatacagacacatgcacacatatatacctatatatactctctctccatatatacatatatttatatttatgcacatgtaaatacatatatgtaatttatatttattttcccccaatactcctcatacctagagaccatgaactacatacagagggaaggcacactttctacctgaaggccagcccttatattggtgatcagtttgttcagtgctcttaatcattagagtaattgtgtataaaatcatgaatggggactttgtgagtcacttaacatttgcaagaagcatatgaacgtgattgttcttttagagtttgttaggtgggtggtggtaaagtaatacaattttctaaatggtaaaatcatgaatctcatgcatgtcaaaaaatttattcaattcattaattaatgagaatatcagtaagatgttacaccattttaaagagcatttgagaaaccaagtctgtgcaacttaataaatatatattaggataaaattgctgggttagataaaaactggttaatgtcttagaagccaataaactgtaacatttgagatatctgttctatgggacaaaattcattttcatctcttttagacatctttaagttgacatgtaacttcactaaatctgggacctttaatcaacagtaagcagtgagtcaaaataagtacattctaataaataatctttgggtggacttggcccctgaatgacattgaaagaatgtactgcctacctttttgctttatttttaagtcatgaataatttttataagagtggtgaaaggtataagaacatactgagttctacataatagtgtttggatctcaacttgtatactgctatatgttcacatggttttggtaaggagaactgacttgtcattctccaaggcagaagctgagagtagaactcccagaaagtgggatttacttaccataagttgctgtagaaaaggaggatggagtcaatctttatttctgcttttgtcccactacatgttaagaattttttcatttacccattcagtgattcaacaaatatctgttaagcatccactaagtgccaggcattgaggattggggtgaaaaagcccctgctcttaaggagcttacattctagcagaaaagacagacaacaataataaaaccatgataatattgtttcaactggtagatagtgctatgaaaaagaaaaagaagcagcagcatgaaggtaagggagataatgagtgaccacatggaggggtggactttagactgaacgatcagggagtcccaggaggactggcaggcctgcagagtgtggcccggccacagcgatgggcttggtgtcaggtagggctgccattcatcttctgcccactgtatgaatgtaattcaagtctttactctatttcatggtccaggatacctccgacccaagtttccatctctttgtcataaagtagaataggggtgggagatcagagctgcaaatgaagcaagtcatgcaaatggtttcccactggagaaaaggcacattttttcccgagatagggcagtgaagaaggtacagagcatggatttcagatcagagacacctgggtttgaattctatttctaccacttactactgtatgacatcagacaagttactaaaatctattttccatctgttaaagacacatgaagatctctccctcatagggccaattcaatgaaatcatctccagaaagccctcagtacacagaaagcactcaacaagcagtgactattattcttgtaattcccctatttggggagtctgtagcatcatcttcatgtagtactgattaactagtcttagttattgctgccacacagttttaccaccttacagagatgactcattatcacacagttcagatactgtgggacctgcaagtccaccagaggtgttggtgttgacctaaactatttggtcaaaattatgcccatagccaagccaaggtttccaaagagatagaaggtacatgggcttagtggcgcacctaaaactttttagcccaagtttggagattcttgggtagcttgagagttagaaactaaaagtagaatacttttaatggatttgtgattgaggattttttttgtttttactttctggtcctgtcctgtcctttgttttcctttcattttttccccctcttatgagttgagttgctttctcttctagggagctatgtgttaggaagctgctaatgaactgcttttgagtctaattttcaataagatttaatacagtagggattaaactgcccccttgaaaagagagattaagtgtctgcaaatcccatgaattgattttctaattgttttggtaataatgtgtatgtgtttttcatttgctaatgttgctgaaaataataataattttaattaaattttaaatgtatttttagtattttaaggattctagagggactaagttttcttgcaaggaatatgttaagaccataacattcttccctcaccccataattattatgatcagggaatatctataatatattccatggcaattaaattgcataccccagactgttcaagatgtgtttataaaaggagaaatggatttcccacagctgctcgcctgtgaatgcatccttcacacagaaccacagtagccagtatatgcactaaaataacagacttgaatttaaactttcagtgctttcaaacgtctttcaaaaacttctcataacacaaattgcttaatttgtgtacatgaaaactcactgattacatatgaatgagagtcaacctataataatggtgactttgagaatctttgtgtatgtgcccacccatctcttcaggaattagcaggtattcagtcttgttccaacattctgcacaagccacagtcattagtgagagcaccctgtgaaggctgaaatctgctgtgaacagtatggggcagctcaggtattttttataatattcatcagatggtcttcacccagtcacgtagctggaaaatgttttctgtgagatgagtgtttacaaaaaaaaaagattcatagagaaggagcaagggaaggaggaagagggaaaataatccaaaccagggtcaaggcagtcatatagactagaatcacagaccaggtgttccgtctttaaaaagcgatcgtcacaactttgatttattaaattggaatttaaatcttccaagctgtaatgaattgatcatgatactgttgatatagattggctcatctttgtggctgtataacaactataataaagaattaattgagtacctattaatcctcacaagcatcttggaagttggatatcattagccctgtttgctgattgaggaaactaaagttgaatggctttacatcattctttcaaagtcacccaggttttaagcagaagaatttgaatttgaacccagccctacctgcctctaaaccccatattctctcagctgtatctccctcctaggtgcaatggctccttggctgacatgctgaaggatatgtcttcacattcttaaactccaaacctcccttggaaataatttcctaacagtgaaactgccctaataatgccgtagtttgtttccaggggagaatatttgccttcagagcaggctccttctgccagctttccatttcataaatgcattttatgactccctcttcagagctcatatacctgtcagaagatcctatgcaatttatccctggggatagttaacattccccctgacccacccaccctgcaatgtcaggtgctctcagaaatggaagtgcaggatctccctcagtgcccatcttttagatcagtagctgtcactgataaaatgtctccttggaactacagagacaaagttgcaagccagccagcgggcccaccctggtatctcctgcagttatcagcattctcactagtgattgatagaacacgttttggagttgttttagttttgtagaatgttcatgggaacttagatgatatctgaggaaatgccttcttcaagtcactagttctaaaggaaggcagccaaattccttcagtctgagaattttggagctctgaagagggcatggacaaatatttcttgcctctcttttttaaatatggaatttggaggctttgtctgtcgaccaccatgccgtgtctttaagaagctctgactgggaaggaaacagccccaagtgttccaagctctgtctgctggaattaaatgtcccttcctgtttcctgacatccacaattctaattcatcctccattcaccctcagtgacttctgttctttgaaggttttgactctgtccttgtacatgaatttgacattcacctgatactctgtggggtccagagagcatgtactccccaccagcttcaactaactctaaaatgtcacagtttctgttaaagtgctttctagctactaccagagtaaacatacagatttgtctcccctgggtgtgctgtgagttcatggcataaagtattttctggttttaaaatggacttctggcctgtaatcccagcactttgggaggccgaggcgggcggatcatgaggtcaggaaatcgagaccatcgtggttaacacggtgaaactccttctctactaaaaatacaaaaaattagctgggcgtggtggcaggcgcctgtagtcccgggaggcggagcttgcagtgagccaagttcacgccactgcactccagcctgggcgaagagcaagactccgtctcaaaaaaaaaaaaggacttctggcttttctactgggaaatgtggttatctgtgccttctggaggtcaagatgtcatcatctggccctggtccctctcacttctcctcagactggacctcttctccagctgtttactcaccttcgtagttgttcacacaatttctccttcatgttttttggagcatctccctaaggtgcatctctagtcaccccaccttctcattcatcctcccaaccaccatggctccacatttatgaactacattcagtctattttcagcctgacatttaggaccttccacaggtagttgccaactttatctgccaataattagcccaagttaccccccagtgtcaaccaaactggaacgctcacatgttctgttcatctggaatacctgtgcctatatctgtctgttgacatcctaagtactccaccccagagcaaggggtttatgggagtagataggggaaaactctggtacaaagttgtaagaacgtgggttgggcttggagaaaatctagatggcatcctggggcaatggagggctcaagaacaatggcaatgtccagtccacaagacaggaggtaggggatttgaagagggaaatcctagcaatgtggttaccagaaacacatagaaacatacctccccttccctaaaatagttattggatataataataattgccttttaataatacatgacttagcaagaggcaaaataagggaattcctcagaggtgagaaataatagaaataatgaaaatctatagaagtaagaaaaccctggggcctggcatttgtctgctaatccctgtttgcctagagcatgggttttaatgagcagtgggtgcatctaggacaagtacaaaacttggggccactagtgtactttataagatattgattaactttagacttattaagatgaatatgtaacctataatttccaaggtctccactgacagaattgaaataaagcatgtagcttccaaactatagagttggagggaaaaggaatgagagaagggaaaaaaatcaacccaaaagaaggcaagaaagaaagaaaaaaaagaaacctagaaaacataataaacagatagaagcaaaaaaattcaactctaaactattcataagagaaactcctaaaagtatgagatagagaaaggctgccagtaaaacgatgggaaaggacataccagggtaatactctgcaaaaagaactaggtgtgcctatcttaattattaggaaaaactggacttccagaacaaaaagcaacattacagatgagttttcaatttaccagggatacataattttaaatttgtatacccctaacagcataactttgaaatatattttaaaaaattactggaactacggaatattcaaaatcacaaagggacattttcacacatctcacagagggacattttcacacatctctctcaaaattgatgggtcaaatagacaataaatcagtaaggagttaaaaggtttgaagaacacaattaagaagcttgatctaatggacttacacagagcactgaaagcacattctcttcaaatacacatggaatatttacaaaaatgcatcacatactaggccatagagcaaacatcaacaaaattcaaagaatctatatcatacagccaacattctctaacagttaaattagaaatcaataatgaaaaaaataactcagaaaacttcatacttttgaaaattaaaaaaatgcattctaactcatgagtcaaggaaaaagtaaaactagaaattaataaatatttagaactgaattgtcatgaaactactaatgggaactggtgagatacagctaaagcagtattgagggaagattatagccttactgcttatgctagagacaaagtacgtctgcagagtaataaactgagtgtttaactccaaaaattagaaaaagaaaagcaaataaatccaaagaaaggaggagtaaaataatataagcataatataaacttaggagcagaaatcaatggaagaacaactactaaataatagaaagtatccaaaaaatgaaagtcatcattttttctttttcttcaaattattaataaaactgacaaactgcaagcaagatttaaaaaaaaaacagagaagacactgataatcaacatcaagaatgaaaaagagggcatcactatagatgctgcagacatcaactaaaattaaaaacaggatattactgacaacttcatgccaattattttgagcatttagacaaaactcacaaattcctagacaaatgtaatttccatagttaattcaagaataagtacaaaacctgaataagccaataaccatgaaagaaattgaatcattagttaaaattgttatcataaagaaaacatcagactttgatggctttgttaaaagttctacaaaataaccaggaaataaataattctaatcttacacaaactatcccagaatgtataaaaaaaagaaggaaaaccatgttatgcatcagatacatccttgatactaaaactggagagccacaaacagaaaatgtaggtttttcaaaatgaaaatttacaatagcaacaaaatatataagccatcaaagaaagaaaatgaacaaaagggatgtaaaactgttataaaactttaaagacattaagaagacaaatagaaacatatataaacacaccattttcatggataagaacacaatattctaataaaaagatgttcggttccccccaatttaaaatagatattaccacaattctgatcaaaatccaaaaatacttttggagtatatttaaatgattctaaaatttatctgaaagagcaaatggttctgaataatcaaaacactcctgaagaagaaggaagagaaagtgagggaatttgccctaacagatatcaaggattctaaagtaatagcaattaagatagtgtggcattgttgcagagatagacaaatagatcactgaaacaattagaaagccccaaaataaacatataaggaaacttaatatggcacaatccgtaccgcagatcagtggagaaagaggatgtactactaatgaataaatgtttctaggcaatggaaaactgaaaatagaatcctacctcacacccaacacaaaaatcatttcctattctggatgggtagagaacttaaaaatgaaaataaaatatttttaaaatttagaatagaatttcagagaatatctttgtaatattagggtaaggaaggacttcttaagacataaacagtatggatcttacaggaaaatattcataaatccaactacattgaaagtaaaaacacttattcatcaaaacacacactaaacagggtaaagagatgagccacaaactgggaaatgatatatacaaacttactaacagaagtgtctaaattatgccaagaactcttacaagtcaataagaaaaagacaaatccattgaaaaatgggcaaaatgcatgaacaagaacttcacaaaagagaaaacacacataaatgacaaaaaaatccacatgtaaaaacatacttaatctcacaattagtttcttttaaaactgaaaatgaaatgttagcatttcacactcaccaaatttacaaaaattagtttgacaatatcaagtgctgtagactatgtgaagcaagagaatgactcatatactaacagtgtaagtgtaaattgaaaaggaaaacattttggaattgcacggtaaaattgaacacacacatactctatagcccagcaaaccactcctacattcaaagccttgatagtgttggtagcagcacgtaatagaaaactggaaaccacctaaatgaccattgttggtaaaatggataaataaatacaaagaggtaatatactgcaataaaacatgaaaatactagagctatacacaacagcatagataaatcttatatatgtttgaatggaaaaagcaagctaaagaaatatatctggaggatatggttcaaaagtaggcaatattaaactgtatatctgtacacgtataattgttatatatagtcatatacatatatgtggtaaagtatgaagtggtaaaactgtagaaaagcaaggagtaattaagaggcaagacaggctagtgggtacctctggagggaggaaaagatctgcagtgggcaggggtgtcataaatgggtttccaagatactggtgatatcattcttgcattaaattatggacatatatgtacttattattttcaccctttataatatacatttatgttctgtacaatcttatgtgtgtatggtatatttcacaataaaacagtcaaccaaccaatcaatcaagctagctagaggctaaagaactgaaactagaatccataagatgggtctagtaggttttcaaggataaataagagacaatgaagtttccctgaggctatgatccatgactgaaactagcaaaaagcttcacacttgaatgagaagaaagctttgaagcagggcagagactcctgctggtgcccttggaggttgctggggatgttataactctaggaagtaaatggatgatttgagaaggaaaacttgaacaaaggggtattggctttcttttgtaaccaggaaggtacataatttgcaaacgtgcagatacaaagaagatactgtctttttataaatatgaggcatttgtctcagttacttatacaaataaaagtttattttcccttatatcacaggaaatccagaagaaggcagtgcagagcttgttgagagagttagcaatattttccaaatgtaggctacttccactctgccatttttagtttaggggctttttgccccatgcagctccaaagttctcatctgccttgaatgcagcattagggatattttcccaactctttgtcaacgaagttaaaggcttttctagaactcatccacagccggctactcacatcatagtcatctgaatggtgacacatggacatttcttgcagcaagagagcctggaaaagtaattattttgctattgcagactgtataataggagcaggcaaaagtgaagggggagaggtgtgtattcagcagtgtctgtcaaaatactccactaagaattcttcctcttttatccccaggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatttttggaaga

SEQ ID NO: 36989 - DNA, 80418 bp, Homo sapiens
cggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccaggtacctggagcgggcctgcccggggcgccggagcggcggcgggcgggggctggcgctacctgtggcggggcggccgccgcgacctcgccccagaggcgcctcgcgggcccgggccggggccagggggcgggagggcgcggggccgactacgctcctgccctgcggccgcagcgtcgcgctcctgcctcctcccgggcgcggcgtcgcgggagtagggcttctcaggaatgtggtcgggagggcggagctggaagggtgggaagcaccgatccaccttattgctctggccgaggccagagacctccgggagaggctgggccaccgagccgggctttactgctccgagggtccgggcgtggggctggagctggagccccgcgcgctgcttttccagccgcctgcggccgcgccttcaccgtcggggcgatagcggtggcaacttggccgcggctccgcgtggtctccgggcttccccgcgccgcctgagccggagctgcccgcttcaagtactgtgtatttctttgtgtgtgtgttacgctctttttataagtactctcttaggtaatatgtccgggtgggagtgtgtgataatgccccggggaaatggtggcttctaggaagttaaaaatgttctctgatggggtgagaccatttcctaggaattcctgatgccgtcctgcttctcgccgtgcctaggtgaagtttgggatgggccgggctaggatatgaccgagtcgtgcgttctgttttctaaccaccctctcccctacccccagccctctctggttgctagagacggtaagtcaggggtttgtggtaaagaaaagggaggtggtattcttccttcttagaatttgctcttggggagaggtttgagtagtcttttttgggatttttaaaacacaaagccccgatgtctttctgcttttgtcaacctaaaaggtgtggcatatgctgggagagaacgaaggtaccctgttataacaggaaacaaggatatttttcacagtatctagagtatgaacggtgaaatatttttgtctggtttccttttcacccatttgtcattaattgggatacctgaatagcttatttcacttagtgtttatagtgacattaaaatattgagtactgtaacaaatgtgattgtcacctttcacattgagtaaatgagcaataattgctgctataatattccctggattactgctgctaaaacctttgaatccaggaagaaaggatgttttatgtaatgagcatttacagtatgcttattagtgggttaaaaaaatcactgagtaaggggtgagattggtttaagtttagcaggctacagaatcagggatgctgtcaggttgctatttccctagggcgcagagagattgtacgtatctaatggcaaagcaaaacaatttatagctaaccctttggggactagtctgatggctgagggagggtgggggtgaggggataagtggaggagaagtctaggagtgggagaataatcttgggttacaatattggtagtgttatttaaaagatttgaaccacaaatatttacgtttttttgaggaaggggccatctgaattatttgagcccatgttaattaattaaggtgttgggcctttttgttttggggaagtaatggtattaaaccattaagaaagcggtaattgggcctggcgtcgtggctcacacctgtaatcccagcactttgggaggccgaggcgggtgaatcacgaggtcaggagttccagaccagcctggccaatatagtgaaaccccgtctctactaaaaatacaaaaattagccgggcatggtggcgcgcgcctgtagtcccagctactctggaggctgaggcagtagaatcgcttgaacccgggaggcggagattgtagtgagccgagattgtgcctgggcaacagagcgagactctgcctcaaaaaaaaaaaaaaaaaagcattaattgccgttttcctaataatttatagaatcatttgttgaagaaatacctccactgtgaatagtatagtacctggatgctctagatgatattaaagaagtaaaggaagcaggtatgtatgaggaagacatatgtgtacataaagagtatgaaccttgagtcttacagacttgagcatgtgtgtcttttaaagctctgtcatttatcggctgtgagaacatggccaaaatactcagcctctctgagcctcagttttctcgccagtaaaatgggtctgattacacattctttataacttttatgacaaagatggtagcattgtatccagcatgttgtatgtgctcagtaatggtaggtgttatcagtgtttatgcctacagttctgtaacatgtttaaatgcaaagggaattcagactcagagaagtctgtggaaaaaattgatgaaagcattatgtaggcttggtggtggggagaatggaaatgtcatatgtgggagtcatatgctagtttggagagaggaggtggcaagtggggaagtgggattgatagttgatttgggacctgtgatctggtctctgcaaaaaggagcctttttggagagacaggaacccgaccacctggatgcagtctcagctctaccacttgctgcatgtgtaattttaggcaggttacttaacttctctgtaccttagttttccccatctgtaaactggggaaatatggtggaccacatatagctgtgaaattaaatgagttaacatgtcaagggcttagaacagtgtctagtacagtctgtagtaaagctgcatacatttttatattaattttagattatggagctaaagcgatttttttatatttacacttaatagggtagctattcattgcctgactcctggaatgttaaaattcattccaccatgattgtttagcagtagtaactggagggagagaacacagcagactaatcattttaataagcagaagtcagttctcttggtaggagattagaatggcacaaattggacttacttttttaagactcctgaaacaccagactgtttttacaattttcagtatatatattttctactatgtgattttgagcagaaaaaaatataaaattgggaacggagaatttaaaaacaatgccttttaccctaactttctttgacttagatttagttgttaccttctgttcatatgaagagttgcaaaattagggaactaagataattaaattgagataccttttcctttttaaaaataaatataacaaatcataaagtagccatgataaaatgtaaagtattatgttatttaatgaatatgtgtgtgtacattacctcctcctttctgttgctcatatttctttgaaaaatgtgtaaagttctgttggtaggtagaacacctaaatgttaagtaaactctaggtaggaaatgacttcaggatggtacagagtggttaggagagactgctgggtgtgtggggtctatgtctctctacccaggtgactttgagtagtttcttaatctgcctttatctcgactgagcttctctttcttccccatgaaatgttgggtttggttgaacaaatttctgcacttttgaaattctaggagtgtttttttttttttattcatttaactagctgtgtgtttagtcaagtttcttaggttctctaaacccaagtttcaccatttgagaagggagaataacattaaataatagtacccttagggtttttggagtaaataaaataatgcaggtaaatcatccagcaccgtgccatctacagagtaagcaaataagaattgttggctgggcgtggtggctcacacctgtaatcccagcattttgggaggccaaggtgggtggatcacttgaggtcaggagtttgagaccagtctggccaacatggtgaaaccccacctctactaaaaatacaaaaattagccgggcgtgttggtgcgtgcttgtaatcccagttactcgggaggctgagtcaagagaatcacttgaacctgggaggtggaggtcgcagtgagtcaaggttgcgccactgcactccagcctgggcagcagagtgagactcttgtctcaaaaaaaaaaaaaaaaaaaaagaaattgttacttggttttatttgctgctgttagttctgtatcttggtgttcctccaaaacaaaatttgtaattttttcatttttctttgacacataatctggtctattactttaagtcttcattgccctctccttcctggctcaaccctatactcccctccttacttctgtgtggtattcaggtgatgaatgtggattccgttttgagttggagaaatttctttttgtcagtttggatttaattttaagaaataatgaggtaagcatttaattttggggttagtgctttatctggtaactctgagaaaaggccatatatgttttaaaaatttacagggaggtttatatattttttttagcatattaactttttattcaacaatttgccagattttgaggtaggtaggggttagctgatttctcacgtcttgaatttcagtcagtcctatgacctgttagtctggacccagcattgctttttaaaagtttgtcttttgctgagtactttttcattgctttttcctggggcagagagccgagaagagatttcaggagatttgtgttaatagttaattgatccacatgtgaaggttgtgagtttaaattcccaatttgctgttccattgctacatctcgaagatttttcctgcaattagaaactacttaaactgttaacttttatctattattttgaaactagacatttttagtgtttaaacttttttaacattaatgtacaaatgaattgttagcattgagaaataagacacctgcccccaaagtggtaccatactaaaggttttcttgtttggggaacagttgaaatggtcctgcaggcaattcctagataaaatttctgtacacccaaggaagaacattttcttatagaggatgactgcctttggagaagaaggaaattttaacctgcagtttcttaacttacgtcttattcttgttttgttcattctctttctctttgtgtctgtctctgtgtgtgtgtgtttgtgtgcatgcgtacccctgttttgggataaggaagttgtaggaattgagtggggacactttttttttttttttgagacgaagtttcgctcttgttcaggctagagtgcagtggtgcaatggcgtgatcttggctatctgcagcctccacatcctaggttcaagcgattctccagcctcagcctcccaagtagctgggattatagacaggcatgtgccacaacactcagctaattttgtatttttagtagaggtggagtttcaccatgttggccagggtggtcatgaactcctgacctcaggtgatccacccgcctgggcctgcaccatgcctggccgagtgggagcacttttgttgagtaggtcaagaatactgctttcccttggtagataacaggctactgcttaccgggatgggattttaattcatctgattgctgaaatatcatggtctttcctaagctttgaataaaaatagtctgctccattcagttaggaaaataaattgataactttaaattgggggagtagagtgggaagagactttcttaaagctattaaaaaaaattttagctgggcacggtggctcatgcctgtaatcccagcactttgagaggctgaggcgggcggatcacttgaagtcaggagtttgagaccagcgtggccaacatggtgaaaccctgtctctactaaaaatacaaaaattagctgggtgtggtggcgggcgcctgcaatcccagctactactcaggagctgaggcaggagaactgcttgaacctgggagtcggagggttgtagtgggcggagatcatgccactgcactccagcctgggcaacacagcaagactatatctcaaaaaaaaaaaatgtctctctctctctctctccctctctctctctctctctctctctatatatatatattttaaaagtttctttttcaaattaaagttggtctttaaaattgaaacagattttgtgatgccacttgacacgcctttttttctggttggggaaaatggtctttaggatattaattccaccgtgccttccttaatgaaaagtgataatgagtaaaggattttcactttgcgtgtagacagtatggagttaatagtcatgaattttgttgaaaggccttgatcttgaattactttgggcagagctgctgagtctgtttgagattgaaacttaaacttgtagttggtaggccttagatttatttcttttgcaaagaaaaatgtgtttcaaagatgcaaagaaatataaattgtcttaaattgtacttgagaataattggactgagctccttgatgtcttataaattatattttatttttagtgttttataaaggccatgtgattatttgttgcatagcactgaacagctttaacttatagtttaattaaaaatgcagtcagtttattgtcggtatatactaacagtttaatattgccgtctttaacttactgtcaccttatacaatgattcttttttctgggagaaagctctttatccatgtaagtaaaattcagcagtagaaataagaatataagtgttaaaaagacatccgatgttgctttcttttttgactttaaccagatttcccaaatggtaacattttactatatttgcttattccctgcaatatatggtttttaaaatcatttgaatgtaagttgaagacatgatgccacccttatccttaaatatctctttgtgtatttccgaaaaaccagggcatttgctgtcttcttttttttttttttttttgagacggagtctcactctgtcacccaggctggagtgcagtggcacaatctcggctcattgcaacctccgcctcctgggttcaaggcattctcctgcctcagcctcccgagtagctgagattacaggcgcccaccaccacacctggctaatttttttttttttttgagatggagtttcacttttgttgcccaggctggagttcagtggtgcgatcttggctcactgcaacctccacctcccgggctcaagccattctcctgcctcagcctcccgagtagctgggattacaggcgcttgccaccatgcccggctactaatttttgtatttttagtagagacggagtttcaccgtgttggccaggctattcttgaactcctgaccttatgtgatccacctgccttggcctcccaaaatgctaggattacaggtgtgagccactgtgcctggctgcatttgctttcatgaataaaatatactaacctaactcagaaattaacattgatttgttattatactattacctgatgtgtagaatttgtttgaaatttgccagttgttccagttacgccttttatagcaaaagaaaatctcagattatccaattcattatttccatgtcttactttggaacagttctttagtctctgtgttttatgacattgatatttttaaagagtacaaattagttacttatagagtcccctcagtttgggtttggctgatgtttcttcatgattagattcaggttatgcattttttggggggcagaaataatacagaaattatgtgttattaggcaacataagatgtgtttatttgaccacatacatgccttttgactcagcagtcccaaatctcagaatttacccagaagatgcacttcccacagtatgaaaatacacatgtacaaggttgcagcatttcttaattacaaaaattaacaagcagtctacgtggtaggaatatccaatggagcattatgcacctgtgaaaaagactgagggcatgattaactgatatggagtgctttcttggatatgttgttcacttgtcttggtttgtcttgctttcaaacaagcttgtccaacactcagcctgcgagtggcatgcggctcaggacacctttgaatgtggcccaagacaaattcataaaatttcttaaaacatgagattttttttttgcaattttttttttaacctcgtcagctatcgttagtttagcgtattttatgtgtggcccaagacagttcttccagtgtggctcagggaaatcgaaagattggacacccctgccctaaaggaatacctgaggctgggtaatttataaagaaaagaggttttgttggcttagagtttttgcaggctgtacaagaagcacagtactagcatctgcttctggtgagggtgtaaggaagcttccattcatgacagaagatgaaggggagtggcatgtgcagagatcacatggtgagaggaagcaagccagtgggggaggcgccaggctctttttaacaacctgctgtggtggaactaataagtaagagctcactcacaccccagtcccagggagggcattaatctattcatgagggattcatccccatgacccaaacacctcccattaagccccacctccaactttggggatcagatttcaatatgagatttggaggaatcgcacaaaccaaacttacagtcagtgaaaaaaaagtgcaaaagtatctactactgtgtgtatactaccttttgtgtaagaaagaaggagaaataagaaaatacgtatgtatttgttcattggggcaaaaacaaaacacaaagataaattggaggttgataagattgatttcctagaggatgggtaaaaaggtatatggtggaaaggatagagggaatgggggcagggacccttctgaggatacctttctgacttttgaaaccatgttaatgtttcacatactgagtatataagcagcaaacacaccaaccaaatcaactgatgacaaataaaaacaccttaacagggagtacaaatagaaacaaatgaactgaaccgtatttcaaatgagtaacttaactacactgaaggagtgaaaaacaactaatttaggtaacttttgatcctagtatttgaactctgtcctcaggataaagacaaaaagattgaaagaaacattgaactctagttaatagagttaactagaatttttggtttttgttgttgtcataaaggcatgggtttgcaattttgaagcaattgtctatactgttataagcaaataagtaaatatattgtggaaaatgggagccagtttctcactgttggagaagggagttacaaaggtgaaaaatgtgaaggttaaaatgaactctgatgtttgattggaattgcagatagtggcataaattcatagttttagaagtatgtagatataggccgggtgtggtggctgacacctgtaatcccagcactttgggaggctgaggcgggtgtatcacgaggtcagcagatcgagaccatcctggctaacacagtgaaacccccctctttactaaaaatacaaaaaaaaaaaaaaaattagccgggtgtggtggcgggtgcctatagtcctagctactcagaaggctgaggcaggagaatggtgtgaacctgggaggtggaggttgcagtgagccaagtcgcgccactgcagtccagcttgggtgacagagcaagactctgtctctaaaaaaaataataaaaataaaaaatgaatacaaaaaattagccgggcgtggtcgcgggtgcctatagtcccagctacttgggaggctgaggcaggagaatggcgtgaacctgggaggcggagcttgcagtgagccgagatcgcgccactgcactccagcctgggcaacagagcgagactctatctcaaaaacaagaaacaaaaaaagaagtatgtagatatagaaatagatctcattatggatacacatgcgtacatctgtacatctttttccacttctgtctgctaagatggccaggaagcagtgatacccctttagcaatgagatcacctagcactagatcttggtttctaaataccattaatactattctctactggaaggaaccttagagaaatggaggattccagaataggggaaggaaaaaatacaaaatatgcttggagcatcttgtagtctcataagggagtgctcaaaaaggtaaaatgatggggatatttgaaagagacacaggagccagcctggcaaaactcccattgactgactatagggcaatttaatcattgaaataaataaggcagtacttgtttattacccataaatagagtaaggatctatgataaataaatgatctagaagtccttaatgtagaattctgactaatgaatgaacataaaggaaaaggtggaattagtaagttgccttttggcaattataacagttgatttaagtaagaaccataaatggatcttaaaactaagtgggtaaaaatggatgttaaaactagtatgtgaaagtttgagagtagtagatgttaatatagtctcaaagtatgttctcataagttattgttaattttacagggggaaaataacaactttacagggggaaatctgacaccaacttgcccatgtgatgaaagtcaacatctttgatgttactctacataataataatgagcagagtttgttttactttgttatgctaatgagatcttgtctttataatttgttcagcgaggcattgaatgaaattaagcctaaaggaaccaagcagagcataaaggggaccaggtttttttctgtttaaaaaatatatcttcttaattttgtagccagatgtcttgggagggaaaggttgataaatttaggttaggccagtaaggttttgtccataaactctaatctttatttagcataataacttcctccctttgcaccaagtgtgtcttttgctgtacaactgtttttgtttttttctgtgttctgtggtggtttttggaaagtagatttttttttttctactggaatttatcttaaaaattatttatattcttttaaaaattttaaagacagggtcttgctctggtgcccaggtcaggctgtagtgtagtggtgtgatgacaggtcactgcaccctcggaactcctgggctgaaatgatcttcctgcctctgcctgccaaagcgcgggcactacaggtgtgagccactgtacctaagtttttgattttttgtagcgacgaggtctcgctatgttgcccaggctggtcttgaacttctggcctcaagtgatcctcctgtcttggcctcccaaagcgctgggattacaggtgtgagccatctgtccctgtataaaatgatttatatttttaaacatacataattagggaatcagaaaatagtgtcttattcccagttacagaaaatgagaattaagcacttttgttaaccctgtttctacccactcctttcgtacattttttgtccttatttacaacaaccaaaattgtgtcagattcagtatttttaaaagatttcaaaaatcttctgcattctgttttgttattacaattacaatagttaatacccattggcattaatccgtttgtcattaagggttattgcttttatttgccatttctatcattctacctggttttagtgtttacaaacaatcctcatgaacagctagttttaattaattatttttaaaattgtctttatttagagacagggtcttgctctgttgtccaagcgggagtgcagtggcatgatcatagcttactgcaacattgaaactcctaggctttagtaaccctcctcctgtcttagccctctgagtagctaggactacaggcatatgccaccatgcccgtctaacttttttatttttattttttagagatggggtctcattttgttgcccaagctagtcttaaactcctggcctcaagcaatcctcccaccttggcctcccacagggctggtattataggcgtgaaccactgtgcctggcctttttatttttaaattgacagataaaattgtatgtatttattatgtacaacagggtgttttgaagtatatatacattgtggaatgactaaatatagctaacatacgtactatgtcacatagttgtcatttttgtggtgagaacatgtaacatccactcagctttttacaagagtacaatatattgttattaactatagttactatgctttacagctactttttattttgaattgtgatttaaagaacatttccaagtactttttactgaaaacatatctaagattaaatttacttttgcatgataaatgatgatttggctgggtataaaattattgggtcccaacatttttgtgttataacagtagaggtcctgctttatttgttatctttgtctggcctcaagtttctgtagaaataacttcactaggtgtatgcttgcagcattctcttatcattggaaatggacacatttatcaggatatgactagaagtttttctctgtcactagtattctcagggaaatgatgaaacactctcaggtctgggaagacttctccatttttgtattcatttttttcagttatcttcttaagtacctattatttacacattgattttctgtaactttatagtacattgttttaagttagctaatgaaaaggataagatcctctctattctaggaagatttatcaaatttgtcttctccatccttgatgaaattttctggatgtcacacataattactgtctccaaaacatatttagtgcccttgatttctcggtctgatattaaacaacggtaatgttctcttgtcttttcagaaggccacaaaactggtatttttgtaaagcttgatactatttaatgaaacaacttacagggaagtgatttttctttgtgtggaagaatatatttgtttttcttgtttattcatgaagagttgctcatagctatttttggtttaggaagttaagagctggtcatctctcagaattgccttggggtactgagatttctgctttgttttggtgctaaacagcaagttgacgttggagagcttcagtttcttggagattatcagtagcagaatttcaacaaatacaaaattttactacaccctctaaatcttaatctccaaatatgggcttttggctgagaggtatacttttgtagaattagagatgtttaaaagggatagttttcaagtttttaaatccttcataccacagctttctgcagtgaggcaagtggaagagtgtgtgtattcttaaaagaaggttatggattagaaaacgatccctttttccttcttttgttcttctgtagctcagaccttgaacaacgatctgtgtctggttcaccttgacattatcttaaaccctgtaagcactagactataagtattttagtagaggactttatatatttggtgtgctttgtctgtatctatgtctcttagttatatttgtacattttattcatatttgcattttcagaatcgtagactaggaatacctttgttacacagaactaagcacaacaaaatatttgttgctatttgctagtatcaagttttgagtggaggccaggtgcggtggctcactcctgtaatcccagcactttgggaggctgagtagggcagatcacttgaggtcaggagttccagaccagcctggctgacatggtgaaacctcgtctctactaaaaatacaaaattagctgggcatagtgacacgcgccaataatcccagctacttgagaagctaaggcagaagaatctcttgaacccaggagtggaggttgcagtgagctgagatcacaccactgcactccagtctgggtgacagagtgagactgtctcaaaaaaaaaaaaaaaaaaaataaagtcttgagtagggcacaggaaataaatagtggaaaaaagaggcttttggaaagatgagttgtatctattatggttccatagcatctagttactgaagaagagaaagagctggctatcattttggatttcagaaatcatgtgtggcatatacacgttgaatcttgagttttagaagttgatccgtagcattcggttttagccaaaatagtctttggagaagatagtcctttcttaatttctgtctggcaattctgacttgggaagtatacaacagtctgagagtaaggtcttaaaagttgtaacttttgttttatttcctgatgaattttctcttaatgcctgtttttggttaatgacgatgtggttgacgtttcagtagtcaaaagatgcgagctgaaaggaaagctaagcaggtagtcaagtcaaactgcagaggaagatttgtggtagatttaatgtttaagtttcagaaatcacatggaaaagatatgtggctattaaatttgtaattttgtcctttttgcctctaaaattaaggtgtgtcaactaagggaaatttgccccatgcaagtaggcttgtgtgcaggtacacagaggcatacattttacttgaggaaggagtgaatttaaggttagagagaggtttgtgggtttttggaataaaaaagtggaaatgtgaaacaaaagttaagtctgataatttaatgacgagttgcagatgtttaaattaatgattgtagtagcttgagtactacatgaattattattttcagataatggcatggaatttccatgccaacaagttggtttaagtgaactacttaaaattttttttttaaattattttgtttgagacagggtctcccaggcttgagtgcaatggcacaatcatggctcactgcagccttgatgtccccggcttaagtgattcttctacctcagcctctccagtaactgggagtacaggcgtgcgccaccatgcccggctgatttttgtatttttttgtaaagatgggggtttcgccttgttgcccaggctgctctcgaactcctggactcaagtgatctgcccaccttggcctcccgaagtgctgggattacaggggactactttatttttgttttattttattttattttatttatttttgagacagggtctcactctgtcacccaggctggagtgcattggcgcgatctcggctcactgctacctccttctgccgggtagaggcgatccttccacctcagccccggaagtagctgggactacaggcgtgcaccatcatgccccgctaatttttgtattttttttggtagagacggggtttcgccgtgctgcccaggctgttgtcaaactcaggctgagctcaagcgatctgcctgcgtgccttggcctcccaaagtgatgggattacaggcgtgagccaccacgcctggcctacagggaactactttaaaattatcaagtgacttaatgtgaaaaatttctgataaccactgcgaagatgttttatgacgaagcactttgattcatttgaaagttaattaagaatggagtaggaatggtgaggttgcatattagtaattcaaatttaagttttgagtctttgggttatttccttactattatgaagcctaagaggtgtgaaaatagtatggaaaactttgtcttctgtttcactattagtctgtaatttttagtttttaattttatatttagagacaattgtttattttgtctccttcctcaaatcattgcaaagtatatatttagtgtctatttctttgtagtgagagtttcagaaagaagccattggctgagctgattatccaatgaagttgtctgacatgagttactttagtttgtggttttagatgaacagtacatggtgcacagctgttgctcaaacagctttgttccagctgtcttactggcctgtcacaaaataccccacattccttttcttttaaaaacagaacctcttgtaatattctatacattattacttaaaatggatctagtaattagtgacttttcttcgtttttactcctatcaatagctgtttacttagagtagtgccaaaatgaattatgtgacatagatttcagccttgtcatatttttaattctttgaaaattaaagttgcagttgtgaaatatgtatatgagacaagttaagtgattaacattgaaaaaggcaccatacattaattatgtcccccaaataagtagctagtatctagataatgaaactaggcatcttctattttcttaatattaaccttgagtttgcattaatttcaatagaattatgaaatgaaaaggtataatatcatgttctatagcttgtatagaacctgtattgatgaactttggtttgtatttttgataagctggttggttggttggacttcattttcctatacaatgcggtaactgaattatattactaagggtttcaagttttgttttttaattaggagcaggtacctatgaaaaatacattgaagtaattatgactatttcattttctaccagttacaaccctttatgattggaaggcagcatggcatcgtcatggtcattatttccatcctacagatgaggaaatgcaggcttgggaagaagggatttgcccaaggtcctgtagcaagtaaaaagcgaagctgggatttaagttggtttttgtatttctaaatatgatcctcttctcactacagaactattaacgttaagttggaataaaagtgccaacacttactagaggggagctgaaaagagtgatagatactctttctgaagttcttggtcatgtgactgtgttaacaatttgaatctgggaggagcagtggggtaggaggagagggaagggtgaggtttcacccaaaagcacacttgatgtatttgtatttctattaaaactgcaattgatggctactgataaaagctagtatagagctgaagatttgcagtggtgtcctctccaaaacgtagtttaggaatactatcatatgattactaatgttgtataaatgcatgagaatgacagataccaaattcaggatattgattacctcttggtgttgggggaggagagaggggaatattattgaggaggcatgcaagagtcttcaatcatattacaaatgttttgtttcctaagtcgggaggtgagtatgcgtatttatattttttcataacattttctgaggtattttatagttaattaagaacagagaatgtactctgacttaactgtgtagtcaaatggaaatttttagctgttaatttggtgttaaaggtatcatgacttgtttgacgagacacaagtgttttcttcaggggttttccttcagagtaggaaactatttttatttttattttttttttggtccttctcaaacaacaaataaaacttgagtacattcttattacagtaagaaattcatatttcaatttgtggataaaacttgtacgtgaatgtgtgtgttatgatttgctttaagaattactatacatggtttctgaagatttctccaaagcacagtatctaatttttgtcttggtagttacaggaactgatgattaattttgcctttagtttcctatatacagaaatgcctttaacttttctcagcaccgaattcataacactatttgtaggtatacaaaacaaatgcccacataatgtagtttgaggtaggtttaccgattgaaagaaaacctggagtatcatactagacctgtgctctgtgctatgctgttgactttttttgctcatgaaatttattcctttagaaaatggattacttttggaccgagaagattttcatcaagtgttgaattttcagggggagggataggattatttatgtaaaaaatgtgctgccactcttttggtggctttgcgtatgacaggaatcttattttcatcatgggattagaaaaaatgccgtggtcattgttcatcttaaaggctttgcctgatttgggtacttatgcctttgagagaggtgggatgggggagagaaaaggaattctgtgttcttggaacaagaatgtgaaagtatatacatttgaatgttgctaatttcctcaagaaaggaactctccatctttagatttacagattataatgttcaagaggaaatgggtaggggtaggtaagaggtggaaggttggggaaggtggaaaaagtgctcttgttcttgagtttagaggtttggattatatcctttttgggaattacctaggaattaactcatggtgtaaattggggatcctttgatgattgtggatagatttttactgaactaagggtctaactcttacggtattgatttttgagaacttgaaaaagcatttgcttctagcatggtttagttttgtaggtatttttctttcggtgtcttctagcagagccattcttctcattccagtgacaagtagaagctgtggtctgttaagactttttaataaattggaaatggttcttaatgtagggattcttaaacttttttgtgtaaagggctcttggtagtttggtaaagcctgtgggattctcagaatacttttttttggctgagtgcggtggctcactcctgtaattccagcactttgggaggccgaggcagctggatcacttgaggtcaggagtttgggaccatcctggcctatgtggcaaaaccccatttctgcttaaaaaaatacaaaaaattagctgggcatggtggggtgcgcctgtaatcccagctacttgggaggctgaggcagaaatcgcttgaaccttggaggcgaaggttgcagtgagccgaggtcgcgccactacactccagcctgggagacagagggacagactctgttgccctgtctcccaggctggagtgtagtggcgcgacctcggctcactgcaacctcccccacaacccccaaaccctggctcaagcaaacctcccacctcagcctcctgaatagctgggaccactggcctgcaccaccacacccggctatttttttgtgtgtgttcttagtagggacggggtctctccatattgcccaggctggtctcgaactcctgagctcaagccatctgcccacctcagcctcccaaggtggtgggattacaggcatgagccactgctcccagccagaatactatttttaaatgtataaaataaaatgtatatgattataaggggaaccagtacatttaaattcaaatatcaaaatgttagaagcaaaattatttaactttttaaaaaaattctttttaactttaataactttcttttttaactttaactttctattttctttctttctttttaactttagtagtgtaaatgctattctgacttacctgcagtagctattacatgaaaatatctgacgtctgttgttgacaatcagcaggtattgctagagtgctttatagaggaagtgctaagtttcagttggaggtatcagaaaacaaaattacaacaaatttaattgaaagatctaattggctttttgatcctagaatctggcaacatctcattttataaaatagaatgactgttctgatgaactgagcacagcagtttggctttatagacagaaaagggctgaagaaagcaaaaacaaaacaaaaaatggatcggtctttttatttttttattatagattttttcttccccccccccccttttttttttttttttggtagagacagtctcattgtgttgcccaggctggtctcgaacaactggcctcaagtgatttttcccacctcggcttcccaaagtactgggattacaggtgtgggccactgagcccgggccagctgatatttttaaagttattttccttgtaaaggttaaagcagatgggacttccttattgtgccagctaaaattggcctgtttgggtatttggctgtcatctctcattctcctgatttctagaaggtcagataaatggcgtggtggtgtggaacttcattcagcatgggtaacttcattttggtttggtcttttgggcgtagtacagaagctcagtccaaacagatggcgtcacataagtttggtttaacagaggttagtgaaaaaccgtttccccatcatgttttgaagttttaaatcccaagaacccctttctattgtggtggaaaaaaaaaatcagaatttgggattgagtcccatattcactgttttgtagtatctgtatccttctgtaactctgagctttaaatccccaaaacccctttttaatgtggtttaaaaaaaattaggatttggagccatttgacttcgggattgagtctcatctttacatgttgtgcattcctaattcaaaaatctgaaatccagaatactccaaaatctgaaactttttgagtcatgatatgatgccacaagtggaaaatttaaaacttgacctcagttttgctcttgaccttgaaacaaagtacacaaactttgtttcatgaacagaattattaaaaatatgtgtcaagctaccttgtagatatgtgtaaaaagtgtatagaaacataaataaatctcatgtttagacttgggtcccatcccccaggataactcatgtatatgcagatattccaaaatccaaaataatttcagatctgaaacacttctagtcccaagtatttcagataagggatactcagcctgtacttactagtatctgcgtccttatgcaactctgagccttaatttcctcatcaatataatggggatgataatagtacttaccttataggattttagctttttatgtgggtactctaggtattacattatttatgtataatttattgcaacctactgatactgtcattttgccagtttgaataaagtatggaaacctttatgtccctttattttcctgtttataatataacttttaaatattctcactatatacattttacagtattaactttttttttgaactgtcaagcatactatagaaaactcgagaaggaaagctatggagtttgtccatatttttgctaaccatgttttttcctttctgatgtttcaaggttccttttattgtttaaggaactttctttagccattcttttagggtggcccttctggcaatacattctctttggttttccttatctgagaaggtcttgatttctccttcatcccagaacaatttttaaaaaatttactgtacataagattctgagttaatacagtagtccccccttacctgcaagggctatatatttcaacccccgcagatgcctgaaactgtggatagtattgaaccctacatatcctgtttttccaataaggagatagatacctacgataaagtttaatttataaattaggcacagtaggagattagattattaataaaatagaaaaattacaaccatatactacaatagaagttatctgaatgcggtctttctcaaaatatctttttgttctatattcttatgatgatatgagataatgcctacttgatgagaagcagtgaggtaaatgatgtaggcattgtgatgttgcattgttactattgaccttctgatgtatggtcagaatcatctgctttggatgatcctggatcgttgaggcatgatgatatggcttgttgaggcatgataatgtcaacagttgaatgttcagagcagacagtgtcagtgttgatgactaacggttgagtagcatatacagtgtggatactctggacaaagggatgattcattgtcctgggtgagatggtgtgagatttcatcaggctactcagaatggtaaacaatttgaaactttatttctgaaattttccatttaatatttttgaactgtggttgactgtgggtaactgaaaccaaggaaagtgaaactggggataagcaaggtactgtagttttctttgatcagcacctgaaagatactgtgccacttcttctgatccccatggtttctgatgagaaatctgctgtttttctcctgtaggtaagatgtttttcctaggctgctttcaatatttttttgtcttttgtttttagaagtttaattatgatgtgtcttggtgtagatttcattgggtttttcctctttggggtttattcaacttcttgaatgtgtaggtttatgtcttaccacatttgggaagttttcagctgttatttcatgtactttttcagctctattctccttgtcttctcattgtgatcctctgataacatggaagttagatcttttgtaacattcccaaaggctattgaggctctgttcattgctttcttttcttcagtgtgttttctgtttttcagatttggtagtttctactgttgtgcattctagtttgttgattcttctgtcccttccattttactgttaagaccatccactgagctctttattttgattattgtattttttagttttaagctcccatttgtttctttgtacttctgtgtctttactgagactttcatttctttgctgagacttttttttcatttgtttcaagctgttgaaacatttttatggagactgccttaatatgtttgccagataattctgacatctttgttatctcgatgttggtgtctgtcgattgtctttttgtcatttggtttgggatcttcctgttccttgggtttttcttttgaaatctgcacattttcatattttgttgtgtggctctgtatttttttagactgggttagctggcttttttggataccactctggcaggagaaagggaagtgctgccttgttactgtgaggtgaggcaggtgtctagattccctactcagcttacattaagtccaaaatgtggggacgctctttattactgcctggtggggatggaagtccattgacactgctgggagaaggaggttcatgctggccagttgggatgaaagtcttagctccccacttggtcttccctgacaccactgcagtggggtgttggggtgcccctttacagccttttgagtgtgggattctaggatccccacttgaccttccctggtgtgggcagaggttttttctttggtgtctgttgggagtagagcagctgtcatctaaaagttttctgtcttgctgggacgtcctgttctggtcctttagctagagagagcattcttttgttagtactttttttgtctgtgtctgttggcatttccatgttgctggctttttcaactccaactctgggatatatgttgtaaaaagaaaacccaggaaactcaccacagtgttggtttcttggattccaaagtgttggtctatatgccttccctcaaactttcagagtcttatgtttgtcaaggatttttagtttttagcaggagaaatagggaaaagtatgtctactctatcttttcagaagaaaaagttattttaagggctttttggtttattaagtaatgttgtaattgatgttttcttctgaagttttgattttgtttctatttttacttctctgctagctcaaaaaatagattgatatttttatgcctcattcaaattgcaagtcattttgtcattcatcttaatttatgatgagttcagttctgaacctgttgagtttgagatgcttcaggggctgccatatgaaggtatatatccctttttataatcagaagagaagtgtaggtaagagatttaggtgcagaggtagatttgggaatgtaaagtaaggatttttgaagctagttggtgtagatgaggatcattcatgttaaggaggtctgccggctcaaggtgggactctggaagcctgccattaaaagggactctggaagaagaaaaggaacaagatgactgaacagaacccactggagaactagagacacaaatcatgttaggtattacagaaaccaagagaagacagtttcaggaatggctttgagtgttcagcagggtcacaggtcttagattggtaaataatctgatggtgaaaattgtaagtttggattcagcaatgaacaggacacagagagcagtgtgggactagaagccagaccgctggatgggcagtcaagaaaaatgttgatggaggagaaagaaggaaggtaagagcagaggttggggctaggttggtggtagtgcagtggtgcatgtgagtgtttttagaaaaagaaggtgtcttgtttatatgctgaggaaaaagctagtacaatagggaagatgttggaggagggacagttgttgatggcaaggacctttgagaaggttggaggagatttgatttctaactgaaggataaaagatgggcagaataatatactttttttttttaacactcgctagaagggtgggaaggatatttatatggctatgtttatggatgcaggagagtttttagaaacaaggaagaacttgatgggagtcccagctagataattttctttgatgtaggagacagactaatccattatgtgtgtgtgtgtgtgtgtgtgtgtgtgtatgtatggatgcttttcaaaaaagttttaccctccatcagtaattgaataggttacatggatatatcagaattatatatataacttaatggatatgatcaacaacaagaactgcatttttaaaataaatttgctgatgatacaaataattctcatatcttaaaatgacagcaaggtgagcagttgaaaaacaaatcaataaacattttaaattgttagccctcactgaataggaaaaaaaaaccaggacaaagtaaaacaataaacgatttttaaattatcaaattgacacaggttagtaaaatactacctgttataggtaaagttatgggaaatgggcactctcgtgctgctattgagattggaaatcaacaagctgaattaaatcttaaatttcataaatttcgacccagtagttattttccaggtaactttttctgatgaagtaatttcctatatgtgcaatgatttgactgttgcttaatctaaaaaaattagaaatcacctatgtggtcaataatgaagatggattaaatatggtccatgtcattaaaattacttttaaaagactggtaagctaatgctcattaaaagtaagggcggggctgtgtgagatggctgacgcctgtaattccagcactttgtggagggaggtggattgcttgagtccaggggttcaagaccagcctgggcaacatggcgaaaacccgtctctaaaaaatttagccaggcatgctggcacgtgcccgtggttgcagctacttgggaaacagaggttaaaggatcacctgagcctagggaagtcgaggttgcagtgagctgtgatcgctgccactgcactccagcctgggcgacagagacctgtctccaaaaaaaaaggggcagggtgggggtggggaaaacagattataaaatgaaaacagattataaaatgaaattcacagtacagcatagatttaattatatatgcataggaaaacaggacacaagctaagagtgggcatccttagatggtggaattatggatgattttaattatttttgtttttttcttttctgtgtctggattttctttattgaacatgcaatatgtttataaggaaaaggaatttttaaaacttgagtttataagcttaagggaatataattggtgtagttttctagagtatagtttagtgttatttatcaatagcctcgccttttcctttgacttgataaatacacctccagggataagaaccataaatatctatctacagtgatatttatcatgacatgacttataatagtgatatactagaattgtcttaaatagaccaatggttaaatataactcttttttctagtggacttaaagcagatcggtgtagcttataaaaattatttaagaaatatatatgatgacataagttgcttatactatgatttacctgaagaaaaaatactttttgtgttattttttaatctttaaaataatagataaaacaatgggaagaaatagaaattgacccaaatgttgagttatctttttctttatactttcataaagtttttacaatggtgtaattattttataagaaaaaagttgtaaattaatttgctaattgatataaaatgatatttaaactttttttggtttatattgttattgtttccagggaactctgattcttatttttactgttgcattttttttccttgtatgatttgttcatgtctttgcccattatctgttactttacttggaaaagcctgtcatgtgagttttgaaaaattacacaccttgtgtaaccatcattacaagcacatataggacatttctatctctccaagaaggtcccttgtctcccttctgactttttattcccattgttcagttttgcctgtttctagactttatataatagaaatatacagtatgtactctttttgtgtctgggatgtttttgcttggcatgatgattttgacattcatctatgatattgcttgtttctatggttctttattttattattattattactatttttgagacaaggtctcattctgttgctgaggcttgagtgcagtggtgccatcatggctcactgcagcctcaacctccccaggctcaagtgggcctcctgcctcagcctcccaagtagctgggactacaggcacacgccaccacgcctggctagtagttagttcttttttattgtttggtagtatttcattgtatgatataccacaatttacttgtctgcttattgatagaacatttgggttgtttccaatgttcattaactgtgaataaagctgccccagacattgatgtacaagtcattgtttggacttacattttcatattgcttggataaataccaagttgtgattattgggtcgtatggtaagtggatgtttaactttgggaaacaggtggtttcttataaaatggttgtaccattttacattcccagcaactgggtatggaaattccagttactctgggtctttaccgatactgggtattttagccaatctaatggctgtgctgtggtatctcattgtggttttaaatagcttttccttgacgactaatgatattcagcatctttttatgtgcctattggccattggtatagctccttttgtgtgtctgtatgtcttttgtctcttttgaaaattggattgctttgtgttactgagttgtaaagtttcttaatatatttggaacacaaatcctttgtcagctgtgtattacagatagtttcttctagtccatatcttgccttttcatttgttccttcccttttaatacttacatcctctttctgtagtagacttgccagaacttttttttttttttttttttttttaagagttggggatctccctatgttgcctacgctggacttgaacttctgggctcaagtgatcctcccgccagtctcctgaatagctgggactatagatgtgcgccaccatgcccaggccagaaccttataacaaaatagttcaaacaaaatgaacacagtagataaccttgttttgttaactatttttttctacatcgtgtacaatggttttaaaattttttggataagttatataagtatcctattagtgttttcctttaatgttatttgcaatgtaattttaccagatgctgttttgatatctgtagaaatggatcctctttgtttttgttaagccattactgtgatatgttagatcattagaatatatttacttagtacactgaggggttttatacaccatcattttaccccagtttcttgtttattttattaagttgtatgggtgttgtgtttcttgtttccagtttctaggttcacagaaacttgtgaccaagaatatatttgacttgaaagatgaattgggtagtatgttcatcttcatattctcccagggctttaaattttatgttctttaaaaatctggatttagggtcaggcgcagtggctcatgcctgtaatcccagcactttagaagtctcaggcagcaggattgcttgagcccagcagtttgaggctgcagtgaactatgatcacgccagtgcacaccaccctgagcaacagtgaactgtctctaaaacaagcaaacaaacaaaaaacaaatgaaatttgccactgttattaactatagttactcctattgttgataaacaattttgtctatttcatcctgttgattcagttttctacctcttgaaatgtaagctttatgtgtaaatacatttttcttcttaaaaatttggtgtgaaaacattgccttaattaaatttctcaacatatagctgtggttaaaagtatcttatttttgttacagcctttttcgtttgaatatttatatcatctgaaaaaaaaattttttttaatgttaactacatgtcatcataatgcctctgctttttcagggaatctgaaatgataaagacgtccccctcatcagtggtactcatttaagtttctgagtatggtgttcccccaaccccaaggaaccagttttttgttttttaattgaaacagggtctctgtcctccaggctggagtgcagtagcacaatcatggctcactgcagcctcgacctcccaggttgaagggatcttcctacctcagcctcctgagtagctgggactacaggcgtgtgccaccatgcccggctaatttttaaattttttatatagattgggcctcccaaagtgctgggattacaagatgtaagctgctgagcctggccaggaagcagttcttaaattatcaggactaccaatgaatagatccttgtatttttccttaaattattttgttctgttttcctttgggtttgttttctaaaatcttagaattcattgctgtgtttttacatcttttaatgaacacattcacattacaccgtgaatactacattgagtcatttggatattttttaattttctttttcattgtttctaagagatagggtcttagtctgtggcccagcctggggtgcagtggcacaatcatagcttactataggctcgaactcttgggctgaagcagtccatctgcttcagccccttgaagagctaggactacaagcatgtgtcaccacgcctggctaatttatttttatttttatttatagagatgaagtctcactatgttgctcaggctgacctcaaattcctgggctcaggtgactgtctcaccttggcctcctgaagtgcagggattacaggcatgggccactgtgcctggccctgtttttaatttcctaatttaaaatgtgtcctttcatcatgtgaatttttattatatatttaaaatttaagtctttgttgatttctgcttttttgttctattttacttttggcatcatggccagaaattggcaagttttagacattagaaaaggtatgtttttgctgtttactgcaggaatcagatccaggtgttgaggggacctacagcttatataattttgaggaccctctttaggaaagaaaatacaagattatgcacatgtgaatatttgtttagaataagaaaaggtatctgtgtatgcgaggggtctaaaagcctaacttgattcattttgtgtttgatctatctctgctttaaaatatataattttggccccacgtggtggcttgtgcctgtaatcttagcactttgggaagctgaggcgggtggatcacttgaggtcaggagtttgagaccagcctgaccaacatggtgaaaccccatctttactaaaaatacaaaattagctgggtgtgggggctcatgcctataatcccagctacttgggaggctgaggcaggagaatcccttgaacctgggaggcgaagggaggttgcagtgagctgagatcgcgccattggactccagcctggacaacaggagtgaaactccatctcaaaaaaaatatatatatatatgtatatgcgtgtgtgtgtgtgtgtgtgtgtgtgtgtgtatgtatatgtgtgtgtatatacatatatatgtgtgtgtgtatatatatatatatatacacacacacacacacacacacacacatatatataaaatttggtgtatgtgccgggcatagttgctcacacttgtaatcccagcactttgggaggccgaggccggtggatcacctgaggttggcagtttgagaccagcctgaccaacatggagaaaccctgtctctactaaaaatacaaagttagctgggcatagtggcgcatgcctctaatcccagctactggggaggctgagccaggaggattgcttgaacccagaaggtggaggttgcggtgagcagaggtcacgccattgcactccagtctgggcaacaagagcgaaactcttgttgaaaaaaaaaaaaattggtgtatgtgtattgcatctgcattaattttagtcattactttgtgtcatgtatatattttttactactttacatactatagctgtttttcttctagtgtttctaagcttttacattgatttatacttttttgttgcctaaatattatttttactgttgcctaatggcatcttaaaattttactatagctcttgccaaataaattttaccatgtttgatattgtttttacacgtgtcttcctggcttgactaaatttgctacattattttttctcactctttttttttttttttttttttgagttggagttttgctcttcttgcccaggctggagtacaatggtgcgatcttggctcactgcaacctccacctcctgggttcaagtgattctcctgcctcagcctcccgagtagctgggattacaggcatgcaccaccacacctggctaattttgtatttttagtagagatgggtttctccatgttggtcaggctggtctcgaactcctgacctcaggtgatccgcctgcctcggcctccaaaagtgcgagaattataggcatgagccaccgcgcctggccatttttctcactctttactgttagccttatgtactttgtaagcactacagtggtagattttatttttagaaaatcctgtcaagacttttttttctctaatgaagccatttaactttgtcacagctacatttggtctaagtttggcttctttgtgttttttcctccatgctttcctatgtttgacctgtgtcttgtaagagacaacatccattctcattacctgccgtatggaaagaagtaaataaaaccttttcatccttgaattttttttctctattgagttgttacaggtgagaagtatatatgaatctgtgaagagttgttggaacctaattaaattatgtactgcacgtttttctttttccctaaagcatttagagtctggctaaataggggaaaatttatattgtttgggttatgttgtgtcaatttttattaaaattctggtagcagtcatacaaataatttgactttcacatgaaatcaagtgaagagaaaggggggtagagaaagatgctcaggcaatgtaagtttactagtacaaattaaaaggcaattttgtgggtactgataaaatgcttctgaaggtaacataaattgcatttgttcttaaacatttaggaagggcatggaattgtttttctttctctccatccccacttcctcccaatgtgtaagtagaaagattttttcccctcctcttaactctgaagaagacaacttcctttattttgcatttttgggtggtggttatagtacttgttttgaggtttgaccatcctctcttcagctatttttatttttacacaccacttgaagtgagtacactcagtggtattttaactataataatctgttaagaaattcatgtatgcatattgcatcttaaaactgttgttttgatttaattttaattggtttatgctatgtctgcttcatcttagtttttaaacaagtgactacttagttttccacagcagaacagaatagcaaaatcatattcttttttttttttttttttttttgagacagagtctcgctctgttgcccaggctggagtgcagtggcgggatctcggctcactgcaagctccgcctcccgggttcacgccattctcctgcctcagcctgccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccaaaatcatattcttaataggattgaaatgtttactttctttttgatgttataagtgatttaagatacgacataggagttttaactgcttgattgctcagtgccctgtcccctccccctcccaaatagaggacaacattttgctcttactggaactcttaattttgtcaagtcagctggtataaagatatagaacttttaccccttaaaattcttttactgatttaacaaatttcagaattggtgatacttgtttattttatgtttgtatatttacaatcttttctaaaacttcattagcgttagaaagcacatatttcctgaaatgttttagtataacaatttgtgtagttgagtttgatatgtgtgataactttttatttaaaataaaatttaggcatcatgtaaaatagttaacagtggcatacttcctggcatagaaattcaatatacaaaatgctaaaaattacacaatagcagcagcattttaaaagctatataacagtctagttacttgttttaagctgtcactatttccggttttgtgaaaaataaatatagcattaggtacatgccctgagattttcagatttgcacatattctgtggaagccttctttactactatttttggattccatgctatgggataataaggtcactttttagcaccattcaagaataaaaaaccaagttctctcaaaggggttctagtacacgtccatgttttgctgaatgctattctgtaatattcttaaaaaacatcttaaattcaaggaaggagatgagagaagcatagtgagattccagacttgatcctccttcaaaatgctatcagttgctgctcattccccagcctctactgcattccacaattggacagtattttatgtaatacttagagtttttacaaatcaagtagaagatacaatggaagaagacaccccttttagaatagcaaacaaaaagactacttctacacacttaaaaaatgtgtgttaaatttttttttacagtcttccatacaaaattttaaagcaaacattaaatttttttaagacaaagacttaaacagaaaagcatactatatttccagatctgaaaattcagattcttaacagtgtcaattctaattgttaatctacaaacttaatgccattctaaaataaaaatattgaaaggaagccgggcacggtggctcacgcctgtaatcccagcactttgggaggccaaggcgggaggatcacgaggtcaggagatcgagaccattctggctaacaaggtgaaaccccctctctgctaaaaatacaaaaagccaggcgtcgtggcaggcgcctgtagtcccaggaggctgaggcaggagaatggcatgaacccgggaggcagagcttgcagtgagccaagatcgcgccactgcactccagcgtgggcgacagagcgagactctgtctcaaaaaaaaaaaaaaaaaaatactaaaaggattaaaagaaactcccaacagtactcttgctgaggtaagtgctagtgcaagctcattttgtggtaagacaaggtgaattcaagtaacttctccaatgacaaagctgggaagtggtgaagcaaggcttcacatcagggtaagtttgagggctcagatacgatgatagctaacatgcagtaagtgtttatattattgtgcattaccattccaggtgaggtactatatattttctcaattagaatagcatcttaatgtaaaacttgtgaggctttgctaggaagaatctagagataatacaggctgtgcttagagatttatgaaccctttataatctctcccctcaatctcgcttttttccacatgcataaactagttatcccagcatcactttttgagtactgttctatgcttcccctatgatctgctcttctatttatatatcgaatttcattcatgtggatttatttttaggccttctgttttgttccatttgtcttttttgcctattcttgtgtcatttccattctaaatttcgtagagggtaggataagtttccctgctgtgttcattcaaaaattcattcagcacatatattggagacaactgctatgtgccaggaactttttaggtgctgggaaaatggcattgagcaaaacaaaaaaattctcatgactcttacacttataaacaatttcttggctattttcttgcttataaattttaggttcagcttgtcaaattctatgaaaaacccagtaatgttaaaacaaatttaaattgggtcagttaagggagcactgataccttgacaattctatccatgaagagaatgcttttacactcatatacgttttcctttttttttttttttttggcctctgtttaaagcttaattatttctttccctaaaggtctagaatatatttttactagagttagtcctgcatatcatatatttgctgttgctgttgtaaatggtgtcttttatttgacttaagctttctaatagctttatacagaagtggtatttttttttgctgtttattttttcgacaggttgaggggactatgtagacttttatatccaaataccttgctgaattctaattccaataattattatgtatattgtttcctgtgcagataatcatatcaaatatattcttaaaaatttgtataccactttattttcttattaaattaactaggacctccaatgtaatgttgaataaatatggtaatagtagacatacatacttgttcttgattttaatgagtttcactgtaaaaagtgttgtttgctatagtttttttttttttaagacaaatgtgacattttcttatcctttttccatatctcttatagtgtttttctttagtctgttcatatggtgaattatatttataattttaaaaaagtctatatattctgttcctgaatttctgggacatattggtcataatgtatatttttatatactgttggattctggattctgtttgttaatattttgcatatggactcttttcatgtatgtttattagtgaaattggcctgtaattttcattttttaataatgttcttgtctggttttggtatccagattatactggcctcataaaatgacttggggggtgtatttcctccttttctattctctggaagaatttgtgtgatactggatttacttgtttcctgaaagtttggtagaccttgcttttacaacttttagacctagtttgtgtgtgtgccggtggggggaagagggggaagtttattttattttttcttcctttattagtcatagtgctgttcaggctttctgattatccttttttttttgagacagggtctcgctctgtcacccaggtcggagtgcagtggtgtgatctcactttgctgcaccatccacctcccaggctcaagcaatcctcctaccttagccttccaagctgttgggactataggcgcatgccgctatgcttggcctagtttttttgttgttgttttgtttttgtagagatgaagtctcactatgttgcccaggttgatctcaaactcctgggcttaagtgatcctctcatctcagcctcccaaagtgttggcattacaggtgtgagccactgtacccagccttctaattattcttgaatcaattttgagtttgtatttttctaggcgtatgtccattttgtctgtgcttcatatttattgcataaagttgttcatagtattctcttttaaatgtctcctctagctgtagttatgttcactatagtctgtcctttagttctccttagcagtgtttgaagagatacgctttttagtccatctattgaatttttaccattaggttatattttttatttccataagttctgtgtgtttcctcttaagatcttagtggtcattctttaactttttattttttaaattcacatttgtcttgattggattgatggtcattttttatagcctcttgctcacttgtttgtgatttcatttatttttaacatttaatccggaatcttgatgggtatggctgataaaattttaacaatggttgttatgtacttccctaataagttcaagataaattagactgtgactactttaacacatagatatagatctggattgctgtatttagccaataacatacgtattacagaggaattacttgttggatgattaaggttttcttaggtaaataatttggaaaaaatgttatttgtgggaaatataggaagaaagaaattaaacatcaaggaagagaagcaggaaatgttgctagctgtgtcttcctagatggaatgtgtttgtatagcatttgatatttctttgtgtttttttttttgagacagagtctcctcacattgtcacccaggctggagtgcagtgacgctgtctcagctcactgcagtctcaacctcctgcactcaagtgatcctcgtagtttagcctcccaagtagatgggactacaggtgtgcaccaccatgctgggctcattttttttttttttgtatttttggtagagatggggtttcaccatgttgcccaggctggtctcaaattcctgagtccaagtgacacacctgcccctgcctcccaaagtgctaggattacaggtgtgagccactgtgcccagcatatttgatatttcctgatagcagttatcacctattttgttgggtatatttgtcttgacagttagattgtgatctcttttggggcaaacacttttattggtggtgttttgttttttatacagtgtctagcatagtaactgttaaatagtatatagtcaatagatttattatagctaggtagatgggattttaaaagtactaaacaaagttcaattgtagttaattataatgaactaatcattgtcatatgattacagtacgaggaattataccagaagccactaataactagatctggattaaatataccttttaaatgcattattgggttcaaaaaaaccaaacacattttcaaatgttgtcttcacctcactcaaacaagggtgagcttaaatggaagcaggggagcatttagtgataaaaacacagaacaggcaaaatttcagaaatgggtcagactttcaattagagactgaattttcagccagcaacaagccagggatagtggaaagggagctaaatctggtatttcctttattaagaaggatccatccaacctggctagaagtgatcataggtaggctaaagtggtcttaataggtaaacagcttccctgctctccccactcccacttgctcctggatgatcaaacacaaaacacaagacatggcaaaaataataacaaatgtagcccccaacccccaacccctatacaagaacttcagaagttttgacaatttttgatcattcttttaagtgagtataaagaatgagggactttcgtgccatccttgtagagttagttcccttccctgtcccaccaccatttcaccaagggaaatttattgagaacacctaaaatttgctgttgactagtcatgttaggggaaggaggaatggtatagacataagattttaaaatattgacgtgcgtcgtgtgtttacttatttgcaatcttttttttttttttgagatggagtcttggtctgttgtctagggtggagtgcactggccgatctcggctcactgcaacctctgcctcccaggttcaagtgattctcctgcctcagcctcccaagtagctgggattacaggcgcctgccaccacacccagctaattgttgtatttttagtagagacggggtttaccatgttggccaggctggtctcgaactcctgacctcaggagatcagcccacctcagcctcccaaagtgctgggattataggcgtgagccactatgcccagccatttgcaaccatttttttaaattgttgtgttaagttactataaaaattaacatttttatagttttcccacattttactgcatactactttatatgactttatgattgttaggttcttaaacaatgaattttgacttaagttcttttatatttttatttttaccaatccatcctatttaaaataaattaatagtatgtttaatatctttcagaaaagttctttccctgtgctttaattttaaccagttttagctaatgtttttgcacaaccttttctaaaagcaacaaataattgattaaggggaatctgggctaagctgaagcttaactctgaaagctgtgttaatgagtttccataggaaaaactgtctactgcttttattttgtttatagattgaaattagctaaatgaaagaataagtaaatgagagctgcttaaattaagacatccattaaaattttttgtcttgattactttcccgtctcagagtcaattgatctggcttttggtactgagcacatgactctagacaagcatgcagtcattctaggcatactgctatttgaaaaaacagctttaaaaagatgttagaacctgggaaaaaatatcttgctctcttgtggtttcacaggatgccaaaggtttagttgcttgtatgtttcactcaattgctttctgttcaatgaataaaatcagcaccgtgcattagaactttgcagactcactgcaaaggaaatagcaggaggtaaagtgacctcaaatgaatgtggctttttttgtggggtgcggtgggtgggcagtgctacaacttaataaacaaattgagttttgcaggaagaaaacctttaacccatctttatactctctcatggtgacatttttcttctgctatcattcccattctttaaacatttttacaatgattagttcattttaaacatgtaacatagctacagttgagttgtttagttgttttataacgtatatgtttttcgagtccatcagtaaactggaattataatcttatttttgttgttttgatcacacaacttttctgcgctctgaaaaatacaactgatacttacttctcttcaccaaaagtcttttaggtaggtttatcaccttttatcagttgagtgagtaagatattttgaaaatattttacaggggaagtagcagaaattctccatcatgtatggtaaacttgcagttatctgtgctcttagaagacagagggaaccggccgggcgcggtggctcacgcctgtaatcccagcactttgggaggctgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcactgagccgagattgcgccactgcagtccgcagtccggcctgggcgacagagcgagactccgtctcaaaaaaaaaaaaaaaaaaaaaaaagacagagggaacctgaatagttaatataatttttattgtagtacaggttttactcacataccttgggaaaagcttcttttcctgcttggcattattgccaaatgtcaggattgacggaggtgtatggggagatggatttgagaaaatctggacatgttactccatgaatctagagaaagcaggggcaatacatttatttttgttttctgaaggtagctctcattgtaatgatgtaatttggggcacagaattgagccagactgctgggaatcaatttctgctccatgcttactagcctcgtgactgggcaagttacttaaagtctttcctcacctgtatgatggagacgataataagaccacctacttcatggactgtgaggtttcaatgaattaatatggtaaagcacttagtgcctgacacatagtaaatgatagctgtattgttgccaagtcagtaagtgtgagtcaaagtatacagatatgtttccctgaaggaatttgaagtttaatacttaagttttgtaaaagtctgatttatatttacttttcaatagtccaaagtggggactgaaagaatgtacaaaatgtccgtgtttgggttatctttcctaaacactctgccttcctcaggaaacatttcttctgtctcagctgttccactgccctgctgagctggaatgactacagcactgggagacacaggtagtgctgcacctggctgggctcaggagccttcctgtgagagaagggttttgcttttcttatcaggatggttaattgaataggtgccatctcatccctgggcactcaaggtttttttttttgtttgtttgtttgttttgagacagattctctctctgtcacccaggctggagtgcagtggcatggtctcagctcactgcaacctctgcctctcaggttcaagtgattatcctgcctcagcctcccaagtagctagtactacaggcatgcgcaactacgccctgctaatttttgtgcttttagtaggtagagatggggcttttccatgttggccagactggtcttgaacccctgacttcaggtgatccacccgctttggcctcccaaagtgctgggattacagatatgagccaccacgcccggctgcactcaagtattaaaagaagtgaacatccatataggatttattaggatagttactcatttgacaggtatttctctagggtttacacatagaaaagccttcaggattttgcgaagacagggtttccttttcctgtataaaggacagctttagtcctaacagtgaggggaaatatcatgaaaatgattcctttattcttcctgctccgtttgaaaatgacctgattctcttttagaaatgtggcttattttacagttgtcctcttcatacatttatttacttatttagagacattctctcactctgttgcccagactggagggcagtggtgcaatcgtagctcacctcagccttgcactcctgggctgaattgatcctccagccttggcttcctgacttgctgagattacaggtatgagccactgtgctcagctcccctttgtacatttagagtttgcaatgatttgttttgtagggaaagatcaagaggaaaaactagtaagttcattcatcatctgcttcttgttgatagaggctacgtttcttaaaagtaattacctttgaattttgtttcccaaataatttagtgaaatgtcaatatgaattcatcttgccttttaagattttattttattttgggatggagtttcgcttttgttgcccaggctggagtgcaatggcacggtcttggctcactacaacctctgccttccgggttcaagcgattctcctgcctcagcctcctgagtagctgagattacaggcacccaccaccacacctggctaatttttgtatttttagtaaagatggggtttcaccatgttggccaggctggtcttgaactcctgacctcaggtgatccacctgcctcagcctcccaaagtgctgggattacaggtgtgagccaccatgcccggcctaagattttattaatacagatattctgcatctttacaggtctgtcttgcattttgcaaacacgtctgttcttggtaaggtgtatacgttttgaattctcttcttccataacttggatgattgagaatctgtggaactccacccaacacctataagggtagcagtgttaaatggcagtacattaacatctatgcctccatagtacctttttctaaatttactcttaccacacagaaactatagtatctccttcattctaaggcacacattaaaaaatttcttattttaacacctctgtaattaggtgcattttctaattgatgtcatcctcctgtcaacaaaaggtggttatttgttctcttgtcttgcctcctacttgactataagtagactccttgaaggcaggaactgatagtcatttatttttgttatttccaatgtctcatttgcagtagaacccaaagtttggtgaattacaatgtaacaattttcgggatatcttaataagtgttagttgaaatgagagtttcattaggacactgtttttggattgttttgaaacagggtcttattttgtcacccaggctaagtgcagtggtgcgatcatagctcactgcagccttgacctcctgggcttaagcaatcctcctgcttcaacctcccaattagctaggactacagaggtgtaccaccgtgcctggctttatttatttatttagtaggtagagacagggtcttgctatgttgcctaggccagtcttgaactcctgggctcaagcaatcttcctgccttaacctccccaagttctgggattataggcatggattgctgtacctggcctcatcaggatacttttgcagggggagatgtaaaaactgtaaaaaggagggcctggaaaatgctaatatacatagttaaatgctattcctacttttccctcctttgtaccccttctgtctttctcttttggttgattctcttcagactgatgcatacctcaccaagaaagcattggttttagcagatgtgagtgaagtaaaaagactaagaattttatatttttatttatgacaggctattttttgagcatcttttggatattgcactgtgcgattgtcactttccattatgtaaatgaggaaacagtcaaatatgttcagagacgtaaaattttagtccaagatggtggaagaaggaccaaacttcctgttatgggtttctgatctgggctttctgctttaaaatctcttctgaactacgttttttttgtctttttattagtttaaaattaatgtttttaatagctctgtggttttgagactgaatttttacattcttatcacagtaaatgtttgcttaaaaaggtggagttgatctggtctccctttatcttgcctctgagtaccctaaaatgtggatttaattttagtgctagaaactgtttagtgggtctagttgttttccttaattaaatttaagcttttacatgtgggtgattagaaaagtcttatccagaacctcagttggcattttttagaaatgactgccatgtagtttttttttagtagactttaagaactttagagttacagaaaacctgagaagatagtataggaacttcccatatatctgtcacctagttcctctattgttaacacgtatggtacatttgttagaattaatgaaccaatgtggatacattattattagctaaagtctatactttattcaggtttccatagtttttacctaatgtcctttttctgatccaggatcccatcaagataacacattacatttagttgtcatgccttcttaggctcctcttggctgactttccttgtttttgatgacccaactattttgaagagtactcattaagtattttgtagagtgcccctctattagaatgtgtctagtgttcttctcatgacaggtgtagggttatgggttttgggttaggaagaccacagaggtgaagtaccgttttcatcacattatatcaagagtacatgctgtcagcgtgatttgtaactgttgatgctgaccctgatcatctggctgaggtaatgtttgtctggtttctctactatgaagttgctccctgccccaacccttttccatattgtattctttggaaggaagtccttatgtgcagctcacacttacggaatgaggatgctgtctaattttgaataaacatttaaatagtagaggcttagtttaaaaatttacctggagttagtgagacttttgctttttataacaaaaaccatggctatttaaatgaaatattaaaacatgtgcttgcatttggctgggcatggtggctcctgtaatcccagcactttgggaggctgaggcgggcggatcacttgaggccaagagtttgagaccagcctggccaacatggtgaaacctggtctactaaaaatacaaaaattagccaggcatagtggcgtgtgcctgtagtcccagctactctggaggctgaggcaggagaatcacttgaacctggaggcggaggttgcagtgagccgagatcgcaccactgcactccagcatgggcgacagagtgagactccatctcaacaaaacaaaaactacaaaaaaaccatgtgcctgcattcaaagatttggtttggcaataattttcaagctatttttcattctcagtatttcaacatttgctattacatggcagctgttagatgttcctctttattttatggcatctaattgataattattttttgaaaaaaatgtaatggaaatgtggaagaacattagtcaagagctcttgaataaaattcgttaatattttgttctgcatttattgcttttctgcacttcttatttctgcatatattatttctaaaattgaggatttggttgatatgtaaattatgattagagaccagaacagtttaggacccaaaatgatcaagggaaagcacctcgctggaaacccccatgacaataaaactctccttgtagttcccatttgtatgtttcaattataaggcttatgttaaaattagatcagaatttccatcatagactctcaatttcatagttgtgtaagtgccatataaacctaattgtaaacaaaggcatttaatgatggacattatttgaacaatttaagatcaggttatttagctcacaggctagaaaatacatgtctagtttcacattttaaagttgagagattgtgaagatgggctttggttctaaaggtgaattttatagttttttctaatgattttccagattttctacaatgaagatgtgttgttttataacataataaattaaaaatacttgctaaattcttttttctttactgattgctcttgagacttactgcattgtaaacaaatgactattttagatgtgtatattaatttcctaggtctgctgtaacaaaccacctcaaacttggtggtataaacaagggaaatttattttttcataggtcagaactccaaaatcaagttgttgtcgtgctggttgattctggagtctgaggaagaatcatttccatgcctctgtcctggcttctggtgcttatcagcagccctttgtgctccttggcttgcttgtggatgcatccctccaatctctgcctctgccttcatgtggccttcctctctgggttattttctgtgttttgcatctcaccctcctttctcttataaggacaacagtggttggatttaggtccagggccatctcactttaataactgtaaagaccctatttccaaatacggtcatattcataggtaccaggcattaggagttggatatatcttttttggatgccaccattcaggccactacagtgagcaagcctcttcctgcatttgcaaataagcactatgaaagtacttttactaaatgcaataatagctatagaatctgacctatattatatgcatataaatgtgattcagagttacatgtttactttcttttcatgtggtttacaattgatgtggcattcttttactatgaattaggctgagcacatacagacaagctataatttgtgtctctaaatggtgtgagcagggtcttaaattctgtgaacatgtgctgtttagctcttgactttttaaacctacgtacttgggtatttttataagataaatgtttatagttccttttgatatgaatcatgtttgtctccacataaaagtttaaaattatccctagcgacctagtctgatttaaatttgtgtgccataagatattttataaaaacagaattgctggtagaatgaggttaagtaatcaaaagtaagactggttgtccttggtgtgaatagacagccactttcagagaagtgctggcccggcctccaggcatgtggtttggagggaatctctggttgagaacatttgctgctgctgctttcccattttgagatgaacttgatgaggaatttagttcttcgtattattaggaaagtaaaacaacagtgatacaggtgtgagattgcttttttgaattttattgtgccatagacctatatgtcttcactaaaacatagctccacaagtgccagaactggctgggtgcagtggctcacacctgtaatcccaacactttgggagtcctaggtggtaggattacttgaggccaggagttgatgaccagcctggggaatatagtgagacctcatatctacaaaaaaatgaaaaaattagccaggcgtggtggcatgcacctacagtcccagctactcaggaggctgaggtgggaggagcacttgagcccaggagttcaagccagcagtaagccgtgatcgggccactgcacttcagtgcgggcaacagagcaagattgtctctaaaaataacaaaaaacaaacaaaaaacaagtgcctgaattatgctggttttattcttattcagaaccatatcctagcttgtaggtattaagtacacaacaactatttgtcaaatgaatagtatatcatagatgctcttgaaatctatgtggcatttcaagacgtgtcttattcttttcaatggctgtttgctatgctgtgatagatatgctgtaattcatgtaactagtccgtgttctccccttagggatatttaggctattaagagtttttcaggccgggcacagtggctcacacctgtaatcccagcactttggaaggccgaggtgggtggatcacttgaggtcaggagtttgagaccagcctggccaacatggggaaaccccatctctactaaaaatacaaaaattagccaggtgtggtggcaggtgcctgtaatcccagctactcagcaggctgaagcaggagaattgcttgaacctgggaggcggaggttgcagtgagccgagactgagccattgcactccagcctgggcaacagagtgagactctatctcaagaaaaaaaaaaaagtttttcacagtaacaaagctaccatgacatatcttgtttgtgtgtgtatgtttatgtaactttcgtagtttgcagtgttaatttccttcattcatggctatgttcttgtgaaacaagcacattttaaaatatattattgaaataattttccagtataactgacctatattttcttaaatacatttaaagtacttttatgttgccaggcgcagtggctcgtgcctgtaatcccaacactttgggaggctgaggtgggcggatcacccgagatcaggaattcaagaccagcctggccaacatggtgaaaccccgtctctactgaaaatacaaaaattagcttggcgtgttggcacgtgcctgtaatcccagctacttgggaggctgaggcaggaaaattgcttgaaccagggaggcagaggttgcagtgagccgagattgtgccactgcactccagcctgggctggagagactctgtctcaaaataaaataaagtacttttttattttatttttattttttaaagacagattctcgctctgttgcccaagctggagtgcagtggtctgatgatgatagctcactgtagcctgaaactgctgggctcaagtggtcctcctgcctcagcctccagagtagctggattataggtgtaccccaccacaccgggtcaatttttaggttatttttttataggtcttgctatgttgcctaggctggtctcaaactcctagcttcaagcgatcctctcaccttgacctcccaaagtgttggcattataggcatgagccactgcttctggcctaaaatgcttttaaatttgtttctcctcgaatcagtgaaaaatcctttgccacagagttttgaaaaaagtatcagaagcagtgtgtatgcacacactgttttgatttcctctgtgggatggttcttggctaatccctttgaaaggaagtatcagaacctgtctgtccattgcatgcaaggctgggaaggaaagcagtagccacacaataggttacaattagaacactgaataagaaacaaggaagaattccttccatgcctaagagagatgcataaccttagggtgaccatatgtctacttgcctaggaaagtcctggtttatgcctgttgtcctgatgtaattattattagcatcctctttgagtcccagtttatcagtaacttatatggtcaccctacttaatctttcagttctttttttccttatctgtagagagagagcagtgcctggtatatagtaaatgtcatgtaagtgcttgctgtcactgttattatgattacttgacctatcagcaacccttatctttcgctccttcttaaattattttcttctcttggcctcctggctaccattttctttgttctcttcctacttttagctgctccttctcagtttccttgcctagatctttctcattttcctgacctcccaacagtgaagtaccccaggtcccagtctctgttgttttctctgtctgattcgtcttgtgacaataccatctatctcctgactcccaaatttgtcttcagccccaccttctcagtgaatcccagactcatttctgtaggtgtctaataagtgtcttaacagaacatgtacaaaaccactctgtattcttcctccattctctaccccaccagcctgttgcagcccaataaatggtaccaccattcttacagttaattaggcagaaaaacttggcatcatctttgagtcttttctgacagactctgtatctacatccagtttatctgcaaatgctgttggccctcctttggaagtaaacacggatctggccactttacacctccattccagtcacctcccttcaagctgcaattttcttttcatgatttattgtaatagcttcttaagtagtctctgatttcacccttgacctataatccagtcttctgactgcagccagtattacttttcatatgaaagtcagaacattttattcatctgcctcagaccctctagtggttttcatttcactttgaataaaatctgaagtcctcactctggcctgcaagtctccgcctgcctccctgttaattttctgaactcattaaccactctctcatgtttgttgttgtagctacactggctgtcttgctgttcttcagacatgttacagtactctcaccgcactgcctttaacttaatgttccctctgcctggaatgatactctagatcacagcatggctcactccttcagttgatccaggattcccttctccagtgtcacattgtgcgtggagccttctctggctatcttatgcagtatcatatcctcccctccaactcctgctgttgccagcccccttcatttttcttcagagttcctatcacctctgatgtattatgtttgcttatttattgatggtcaatacttcaagaaactgccagccctctaagagcctggggattagatcctcagctcctgacacaatgcttggcacattataggtgttcagttagtatttgtagattaagtggggtggtgagtgagcctagggaagattcttgtggcagttttagcagtttagtaatagaacatgtgctgtggaaatcaccccctttaattctagttttgcttctacagaccattctctgttctagaagaggtgagaaatgaaattggggtttaggatattggtaggtaacgggatagaggggagaggaagtgaaaatggaagtaacagtctagactctgggaagcaaaagttacaactagaagtgagttggttacctacctgtttatggggcacccttccatttctaagtttggaaaggaaaagagccaatttttgaatactcagttttagttaagcagtgtactgagtacttaacaatatcatttaatcttcacaatagccctttcaagtaagaatcattatgatcatcttttaggtgaggaaattgagacttaagagattaaataactttcccaagatgatacagcaattaagcggggtatgtaggtctgactgcctctaaaatacatgctctttacttcatagcacctgaagggggagtctgtgtgcagtagttcacatttcatgtggagctgtaaagtacagaaaatgttcacgttttactccttgtaaaaaactcttgaaagtgtctctcagctttgcaagtaattaaatttggtgtcagtgaggagtgacttactgcaaatcctacagctataaagtagcagaggtagggcttcaagcaaatcttcctcttttaaaatatgatattttgctgtattccacaaatttaaaacaaggaagtcctcgatagcacctataaattatatttggcatattgtaggagctaaacgtgtcataataaaattatatagctggaaagagtcttaaagaggtcatgaagggcaaacccctcatttataggtgagagccaggaaagaggtttaagagatttactcatctaggagcactgagctagttgtttgtatagctgggactagaatctagcttttattactaaagagtttatgtttaatctgtctaggtctttcgaaactcttgggttccttctttcattcatgtatttcaaatttgaaagctacaagaattgttttccttccatccatatctcctagcaacccagttaaacccacaggtaaagttaatcagtttcttgtgtatctttccagagatattttgtgcacataaagcaaatacataaactgtgggtatttaacaacatatcttgcagattgctgtatattaatgcatgaagtcattcctttttttaatggttatattcatattgaatgaacctttcgtaatttaaccaggcatttgctgaatgacattgtccttgctgaagcacattgtgtttccagtcttttaaagacatttcactatgaacaaccttgtacatatcatttcttatatgtgcagacctatcggcaggataagtttctggaattgaaattgctgggtcaaacagtatctttgtgtatttaaaaaaaaatgacctacttacacctttactcgtaacttacaaatggggcgtttccatttttaatgaaacgactttacttttctatttggcagtagcagtttataatttaaaaaaataatgaatcacttattttaaggggtaccaggatttttttttttaaactgtcgcaggctatgtgctatgttagtatggcaggttaaagaaagtataatggaaggagtattgcattggagttagacctgattggaatcccagttccactttgtgacctttggcaggttatttaactgctgagcctcaatggtctcatctgtaaaatggtgggcgctgttatcccagcttctcgggaggctgaggcaggagaatcacttgaaccagggagagacggaggttgcattgagccgagattgcaccactgctctccagcctgggcgacaaaatgagatattctgtctcaaaaactagccttaccaatacggttgtcttgaactattgtatttcatcacatttccccccgtacattttagtatatctgaaattgagatgcttcatagtcaaaggcatgtcatgagtgtattggtagcagtttttttttccctcttcctttttctgctttttttttgttgttgttgttttttgtttttttttgttttttttggtttgggggagggggcagggtctcctctgttacccaggctggagtgcagtggcacaatcactgctcactgcagccttgacttcccgagctcccatgatcctcccacttcaacttcccacatagctaggaccacaggcatgtgccatcatgccctgctaatttttgtattttgggtagacactgggtttcaccatgtttcccaggctggtcttgaactcctgacctcaagtgatccacccaccttggccttccaaagtactaggattataagcgtgagccactgcgcccggcctttttttttttttttttatcttggcacataaaataatgatggtcttacaatcagtgtcatcttagatttgatgaaaaagggtaaattcacatactgggacaagtgaactatgctagggcatggtataggctgaagctcagtgtgataggaaaagctcagggtagggaatggggtgttagagggatagttacagtgagggaagtttcattctagatcagcagtcagcccagtagaacagccacctagtgggaggctagtacaactgattgatggctcaggagcaggtattgcccaaaatcctgggtatgtggaattggaattgtggagagttgttggtgggtaataagacttcgccccacagttgagatttaggaactatgtactcacttatggcaggaaggctttataagaagggggctatgagagaaaatatttgcaaatcatctgggcacagtgatgcatgcctgtagtcccagctactcaggaggctgagatggcaggatcccttaagcctagagttcgacaccagcctggacaacatagtgggatcacatctctataaatgaaggaatgaatgaaaaccattgaaaaaatatttgtaaatcatatttctgataagggatttatatccagaatatagtactcttacattcaatgataagataaaatttaataaggggcaacgatttgagtagccatttctgcaaagaagatatacaaatggccaataagcacacaaaaaggtactcaacatcccactagggaaatgcacattaaaactgcagtgagagactattttacatccgtagggtgtctgttgtaaaaaaaaaaattctttttttgttggggtgggggcggcggtgggggataggatctcagtctgtagcccaggttggaatgcagtggtgcggtcgcagctcactgcagcctctaactcctgggctcaagtgatcctcctacctcagcctctcacatagctgggactacagttacgcaccaccacatctgactaatttttaaatattttgtagagatgggggtctcactgtgttgcccagctggtctcgaattcctgggctcaagtgatcctcttgccttagccttccaaagtattgggattacaggtgtgagccatcgcgcacggccaagactgagtttaataacaggtctaggtgaggatattgaaaaattggaacccccaaacactgctagtgggaatgtgtctgtgggttttaatttgggaattcaaggaatatctcttgagggttttaatttgaggacagtgggaagagagatacagtgtttttgtacttagaatgttttcagaagaaggctaaacccagggaaagctattggagtggggagttaggtcaggctgagaaggctggggtatacaagtggtaccccaaagacaagctttccctctatacaagttttgtttaggcctggctctgtcctctggaaaaggaaaagaaattctcttcccatttcttcttaggaaaaattaccgtgctttggaggttggaacttggggctgatactggcagggccatatccagtagtagcttttgtggtttggcctccgaatatacctgcaatttaggaaaaaactccaaataacttataaacagacttttgtcatagaaccagtttgtaagctgactttgtactgtactttctgctggcacataccaggcccattcatttgcaactaaatactatatgtgaggtaatacatatatattagctgaaaatgtatggaaggcaaatgaaggcacatggttgctttaggcagtctgagacaactggcaacactgaagacctcactaaattttgttaaaaaggaactaaaaggattactggatttagtgtagcttttattattctgcattagagttctggggattaaattatagacatatataattgtacatgttagattaaatgaaatactaatttcagtcaaaagctatacttcagtgaaggaatatcaagcatattggaaacatttgacaaaaaaaataagggaggatgttgcagggaacaaaggttctctgtgacatgacagctgctgctaaaaagtgacacaaggaggagcccagctctggctcacagctgcctgaagttgctgcagtcttctctagtgttaccagaggaatttgctctgctcttgttttagaaaatggaggctaccaatggctaactaggtccttattgtgcttggggaaattaattcttctttccccactgcagtcctcccctactttgagatctgtgtgcaagtatattacttagcttcaggaaagttttaaaaaccttgagcatgtaaatcgagttttatatgtcctgggacatacatataacacaattttaactggaactctaattcattttagcttcttttgaaacccaaaagacagaataaaacagtaggtgccaagttatcctcatattccaagaacttgcatagtgggtagccttaaactggttttgcacatgtagcccatacctacctctagggaataaaagtgttgagattattaagggttctaagacaatgtttttggaaagagctattagtatgttgtatgtttggtgtcctttcctgcttccacacgtagtggaggagaggagaaagatgcttctccttaagcccctttcatttaagccaaatgatgagggaggctccaatggagtcattctgagaatttgacatgtatcccctcgagtttggggaatgaaaggtttagtatacaaatctatggatcagtagccctgaggcagcagagcacagagagggctgtatgttagcactttgtacttagaaagacgttagtgtttcctcaggctgctgggtgaaaccagcttaaagccatctagaaagggacactgtgctcggccacctagaaggtgacatgaaccaggaggaaggtacccatggaaaccccagaggtggagggttggagttgtaaatggccaggtctcacttaagttctgggaattgagtatggagggccctcatgaaaaagttggtatgaacatcacacttaattggtgtggccttttgacacccccatagcttttcccactgcttcagttcccactctgaaggagccagagacagccttgttgtgggtagaagagatgcagagcagggagagagagatgatgacaggacccctcacatcccccagcccaactagacttctcagctccaccaaggaaggggagaagctttaatttagatgagtattgattactgcagttaagacagttattgaaactatggtgttcttggggctgaaggatatttaaacttttttcccccctttttgtggagatgggggtctctctctgtcgctgaggccggtctcaaactcctgggctcaagcagtcctcctgcctctgcctcccaaagggctgggattacaggcatgaactgttgtgtttggcctaaatatatttatagtcaaagaatgattttaaaaaattatgagacttgccttagatttcattcaggaacaaggaaaaactttcccacagaggggcttggagggaaagttttatgcttatacccattgagtttaactcagtatatcagttattcatacattcacttagacacatacatgaaaggataagcaattgtaaaaggaaattgtaagtagcaattatatagtatacattaagcttggtatatgtattttccaaatcacaacttattactaataagacagaagttgagaaaaatccaaactgttgtcactttaagggtaagagaatattgagattgttttctggttggagtgttgaaagcattgcaaagaaagcaagatgtgatttgggctttatcagctataatttattaagggcctactgtgtgtcatctgttgggctttgtactctacatagacatagagtatttttaacttttcacaacaatcctgcaaagttggtgtgattttcatttcatagacaaggaaactgaggttcaaacaggttaagtgagctactctagtttcccacagctggcaaactgatagaactgtgtccgggtctatttgacttacatctcagactccctcaattctgctgcctccctaggcagccccacacaccagagatacagtggtgggactagggacaggatggcttcagccagcgcttctgtcctggaagaggagagtggaggctacataacagtcactggggacctgtggcccttattagatcccgaggggcaactttgtgagcttccccctactccctgggagtgggagcagctccctgggaagcttttccttttctcttacaacttctttgctgccacatctgaagtgggcattggaatatgccttccctaaactagctgttcttgcccttttctgttgaggaaatggagttagagatgtgttagtttacccaaggactcaaacagctagcaagtaggatggcttctggatttggatttcaggctctccgactccagagcccttgtgttttcttctcatcatgttgtctccagtaaagatataaatgcatctattaataggaagcaagttaatgaaatctcattttggtttatcataatttaaaaaacatagtacgtgttttatggatagaagtaataatagggaaatgctgtcttaaactggaagggagcagagaatcacagaattttgcttctagaatgtttcatgacctgatatctgtgtgtagtgtgggggtaaggggtgagctgagcaggagctcaagaaggagaagaaaagaaagaaaatttgttagtcttggtttttggtgtgtgtgtgtgtgtgtgtgtgtgtgtgtgtgtgtgtatgtgtgtggtacatttactccttgttttataggccaataagggaatgagaaatttgaaattttatgaattttatttatttattttaatttttgaaagagtctcgctctgttgcccaggctggagtgcagtggcatgatcttggcttactgcaacctctgccacctgggttcaagcgattctcctgcctttcttagcctcctgaatagctgggactacaggtgcccgctatcacgcccagctaatttttatatttttagtagacacggggtttcaccatgttggccaggctggtctcgaactcctgacctcaggtgatccacttgcctcggcctcccaaagtgctgggattataggcctgagccaccatgcctggcctatggatatgtcactttcgatgggatcagtggaagcaggaatggaagatgagtgtgagtgtgttttactttcagagaggcagattagcaaagttatttgatgtttaagcactaagcaggtcactttacttctctgacaaagtccctgccctcatggagttcctttctagttcggtcggggaagaaatggacaataaaagtaaaaaataaaagacgaagtagataagatatatgtggtgttgagagaaaaggaggaagggagaaaagagggagggggaaaagagaaaaaaacctggaaaatattctgagcaagaaaaaacatcagccttctacatgatgtgtagtcttgagtagaatgaggtgaaagctcagggttaaaaaaggatcactgtctctttccttatgtgctaccaccagatttagaaaaaattaattttaatatgaaaactgtcaaatatatacaaaagtccagagaacctacaaccatatacacgttgcccagattcagtatttttcagggttttcctacacttgtttattgtttccgttctctcctttccttttcccttcccctttctataccctatggttttagagaactcctacgactttcctgagaatgatgctgtgctcagaactgccctccatttgtttacaactccccagtggtaccttagagctagcctatcctttttctatgcaagggtggtagacttaaccagtgtgctggattcactgagtttcctagaatttccagtaaattaccagtcccagggtgtagaccaggcaccactctgtggcagtgtttgggaactacactttcaccaatagcttggtgtcagaagaaagtgtgttgtcactccttaccactgaaggcggaagggcaactcacccctttttctctccttccttcttcttttcctccttaacgtggcttctttgaatggggagatactgagttggcagttctccttaggaggccagcccgagctcctgttatgcaatctagtggcatgtaagcaggattatcctgcttatcccagcataatattatactttggcattattaggggcttctgacaaacttacccagatcaattttttttgaggcgggggtggaaacagggtcttgctttgttgctcaggctggagtgcagtggtgccatcatggctcactgcaacctcatctttctgggctcaagcaatcccctgacctcagtctcctgcctcagcctcctgagtagctgggactataggcgcgtgccaccatgcctggctaatttattttttgtagagatgggggttgcccaggcttgccagacccgattttatctctgtctgaatgtgatagcttccctaatcctaaatgtttctccacatctcctgacaatgttaaagaaactgaagttcatttgcccatccatactaccgggaaggcatgctgccctttgaatgggagggtattccttgtcttttgactaggattcttctgcacacatcctttcatgtctatcaggaaacatgtgctctctccatcctccacccttcctttcccctcagtgtactcttttgagcccttgggtccacccttcttccctatccttgcctgaacctttactgtctagctcagtgcaatactgtgcttgcttttttttcctctttttttctctttctgctacagaacatcctttctgggctgtggttggtaactttttataatttcaggagagagactgttttcttttctggcaaattgctgaggctgtgttgataagtgaacgcatacatagttctgtacataactgtagtattaactgtctaacttctcttgccttctgaacaagcatggtattggcacttcatgctgtttgttttttggcttgggtatagacttaaaatgccccaatccttctcttgcccccagtaatacctcaactactggtggttgtataaaaggcactggactctgaagatagagaccttgtctttatggagtatctttatggagtacttagtaggtgcttcatacatgatcactgaacaaatgagtgagtgaaatcaagagagcaaggacaattggctgaagggtttcaagtagtgggaatgaggctttgcatggtgaacaacacagatcaaactggatggctttgcatactacataaaacctggagggctttgcatagcatgtaaagaaactatggaatcctgtaagcagcagggagccatttaatttatatgttctctagaggtataattcatatatgtacaaaaaagtgtacagatcttaagtgtacagcctgatgggtttttacttatgtaaattaactgtgtagttgctgctcagatccagagactatttccagaaccccagcttttgtcttgattcacaacgtttggataccaaatcccagaggtcgtgtggttggtctgaagtgtaactaggactggaattattacagctactcctgagcttagcaaatctttatacttgagtaaaaaacactaattcagaccatttaactgcatgacaaaaacaatagttattattatggttgacatttattaatcagcatgccttggcacttcatatgcattatttcattttacctgcttcacaggattttgttcctgtctctgttttacagatgctgaagattagacatgtaaagtgatttgccttaggtcccacagctagggaatagcagagttagaattaaacccacgacacttcatcacggggactgattacttattggtgatctgttgcctcaaatatctggtacccaagtttaacaaaaatgttgcctttttggtgagaggtgatgcctgtatttgttacctgcacacagtgaatgctcttagggatattctgacctatggattcttagaattttgagagggaaagaggtttttgattctatgataggcagttcccagagtgatgtttcgttggaggaggattgtttcaatgtggatggctctttacaatttacgtgtagccagtagatgatggtctctgtagacaaagtatgaagataggacacagcaaagattgggtgtgaacctaaatatccaaaaatcccaacaatgaatttgtcttaaaaattaatatgagtggaaataaatgcatgtagcagtatggcaaaattcttgtaatactaagattgtgtttcaagagttaagacatccaaagaaatgtccatagcgagtagaggtaaaacagtttattatactggacttcaaagttgcaacaatcttttatataacaatcaaaccaacaatcttttgtgcatgttaatatcttaatctcacaacgccaagaactgtcacatttaaagaattctagctattgtgcatggcttggcatttgtaaaaaatgtatttaacatttgtttattatattttaggccaaatcagtagggacagtgtagcacttttaggcatcagctgggagtagtcagtgaaattcaggttttacaagatataaaagcatggcatatggggaaacatgtttcaagaaatgaatcttaaaaagtacagcgcatgctttatccaatttgcttgtgaaagactgctgattcctgttgtttaaaatagtgggtgtagagaatattgttgccagtaaaatttatttactttttgaagtggcatgggtgccaaaaagtaagttcatgattgttttgatacctgcttttttttttttttaaggctagttaagtgaattgatacctgtttatttttaaatggtgatggagtggtggaggagatggcttcctactaaaagttactgctgttggtgaacatttcttttacagactttgttcaatacatcatgcattgaagtgaaacatcaaaaaacaaataggattatagatatggaattctgtgattaaagttaaacattttaattttaatttaaaaaaaatttttttaagagacagggtgttattctgtcttccaggctggagcgcagtgtggcatgatcatacctcactgtaacctcgaactcctgggctcaagcagttcttctgtctcagcctccggagtaactaggactacaggtgtacaccaccacatctggctaagtcttaaatttttcgtggagatgcggtctcaccttgttgcccaggctagtctggaactcctgggctcaagtaattttcacaaagtgttaggattacaggcatgagccaccatgcctggctttaaagttattcttaagacttaaataaaatgtggaaagtgtccttcaaaaaaaatatgtaaagtcatggtatcaggcagattaatatatctcctcccaaaaccaggggattcttttctgtcctcttcaagagtgcttgtttctgagtagctctctggtgtttgcataggtcgccacgaatgttgggtcccaagagccaggaacccttgcctgaagaaggctaaatactcttgatgctggttcctagcattaagctgtctccttccaaatcattccttcagattttgtaatgagccagtgggaaaatgggctttgaggaagtcagtccaaagtagatcaaaggagatactcagaacaaatggaggatgatgttggtgtcctggttagtgcccttctgtaagaagagggaaatgcactctctcagattattgttgttatcttttttaaacctttttcttttttggagacagggtctcatcctgtcaccaaggctagagtgcagagtggtatgatcatggctcactgcagccttgaccttctgggctcaggtgatcctttcacctcagcctcctgagtagctgattttttaaaacccttttaaataaaactgaaatgtaggctgagattcttcccttcttacttggatactttaactgtccccccccttttttttatggtaatgacttcggtagttgggagggtttgatcagagaagagaggaatagaatttaagataaaaaaacaacaaaagatgtcagtgaaagagtaagtttgaggttcctactaatgaaaaaatttcaaaatgatattttcttgtagtacataaggcagttgaaaggggaataagacaaagtgtgagaaaagaaaggtataagatgaaatgttccaggcctctttgtgttgtctccattttttccagatacttgacttcttaggactgatgattataatcaggttgctaattcaaataggtctgaattataacttactgtgttttctaatttttctagagtttgagatctagattcttaaccttaaataattatgaaaaaagttgtagatcttttacagtcttgcatatttcagatatgaaaatttagagatacctagtaccttttcttcacgtgaaggtgctcataagaacatttggtggggaattgtcatagagggtaaaccctagtacagtgaaaatgttttgattagttctggataagtggaatttgttaagcaaagttacattggtacattggtaggcaggtaatcataaattttattttattttttattctatttattttatttatttttatttttgagacagggtcttgtcctgtctcccaggctggagtacagtggcacaatcatggttcattgcagccccaaccacctgggctcaagtgatcctcccacatcagcctcccaagtaacagagaccacaggtacacaccacgtcggctaattttttaattttttaatttttttttaagagataagagtcttgctgtgttgcccaggctggtctcaaactcctggcctcaagtgatccttctccctcggcctcccagagcataggattacaggtgtgagctaccatgcctggccatgaattttaaaataaagttttttcttttcttgcagtcctattttgtaacggattatgatccaaccattgaagattcttacacaaagcagtgtgtgatagatgacagagcagcccggctagatagtaagtaaacttcctttgtttgataatttgcatatcatattttttaaaaaagtaagcgctgatgttttgctatgttaaataatatatttgaaatattagatgatctggaatattagcccatgtcatttataagttttgattgaagagtctgcataatgggtaatttaaatattcctcaataaatgaaaagtaaaacgatatttgtattgatcttgttctagtgaaactggtctcattgcagtttgttgaagttgattttattgggacaactggaaaaaacctgtcaggtctcaactcttcctaccttttggcaaaggttaaaatggatgaagtgaatatagaaaaagtttgatactgttacttagaatttatagcacagagactttagcaagtactgttttgtgtctaaacatcccccctctccacaaagaaagctctattcttctaatatgtatgattcttttatttacagagatcaaaagttacattagcacctgcactaagtatggtattgggggatagtggttataactcagatttctttcttgaatttacaggtatctttttcagttttttccatggaggggataaaacattcaagtgattttagaggtcacctgactccatctgattaaatgtgtttgatatttttaagcttctaattagtgtgctaatatattctaaccacaaagtcaacccatactgatgaagataaactctgtaactgtctgccattagaatatatttgcctttagtattaagaataaagtactaagaaaggaatgccatttctgtattataccaagtatgaggctctctagaggactcacattaattggtcttgcccttgtggggaagcagtttataaaaaacaagtataattacatttgttgttttttctttagttttggatacagcaggacaagaagagtttggagccatgagagaacagtatatgaggactggcgaaggcttcctgttggtcttttcagtcacagatagaggcaggtttgtaccatattagaatgtagatccactgttcttgtcaagatcactagactttattgagtttggactttttgtttttatagaaaaaggaaaaataaagtactaattggggcatgagacttgctgaattctgatacttgaccaaattgattaatttgtttttgattttttttttttaagttttgaagaaatctataagtttcaaagacagattctcagagtaaaggatcgtgatgagttcccaatgattttaattggtaataaagcagatctggatcatcaaagacaggtgagaaggaatttcactgttgggaaaccaattgtttataatcatgtgagtgaactgatagatttaaggaaataattgaaagtctagtaaaaaaaaaatacggtgctccatgccacttaagtgtttatagctgagtctggcacactgtatttacagaagtcacagcgggtgaaaaataaaaaggaagtagatttggggaaattaaaattccttattttcaaatagtttttcataaaattttataagactttataagcctgcaagtgtttaaactagctttattcgcatgtaataatttcttggattacatccaaaactctaacttagttggataatttcaaagttaccactaaaggcctaagttattcggtgttaatactaaattaacttcatgtagagaatggctttcatttaaattgcagtatttggatttttttctaagtcactttaatgactgaattttctgttaattctttacattggctagctctaacacttcagtaacatttaataaaataatatttttagtatttagtttgcaggctaatttattctcacttgtttctttacccacttactgaaattttattagttaaaacaattttttggtaacattgcacattcatcttttttgtaggggaggggaacaaggtcagttgtatattaatgccggctgttcatttgtattagtccattctcatgctgctaaaaggacatacccaagactgggtaatttataaagaaaaagaggtttaatggactcacagtttcacatggctggggagacttcacagtcatggcggaaggcgaaggaggagcaaagacacgtcttacatgacggcaggcaagagagagtgtgcagggaaaccgccctttataaaaccatcagatctccgagaacaggatgggggaaaccgcggatgattcaattatgtccacctggtccctcccatgacacgtgggggttatgggaactgcagttaaaaaagatgagatttggatgggaacacagccaaacaatatcaatgttatatggctttttttaaaggtcttttgtctctaccccacatctgaaatgtattgtttaaattgtttattttgctggtatttaagtattcttgtttttatattatgttgtgtttacagattcttaggattttgttggaaaagtgtaaacatcaggaaaaattggttgataaacagctttgagggcagctttctattttgtaactgtctctgattttagctgtgtacataaaattttattggcggcatacccaatttcaaacactgacttaagagaaaatgatatatatatatatatatatatatatatatatatatatttgttttgttttgttttgagacggagtctcgttctgtcgcccaggctggagtgcagtggcgtgatcttggctcactgcaagctctgcctcccgggttcacgccattctcctgcctcagcctcccaagtagcttgggactacaggcgcctgccagcatgcccggctaattttttatatttttagtagatacggggtttcaccatgttagccaggatggtctcgatctcctgaacttgtgatccacccacctcggcctcccaaagtgctgggattacaggcatgagccacaatgcctggcccaagaaaatgatatattatcttaatgctaagatttggaaatgtccactgatgaaacttggtatagaataaattttcctgctaaatctcgttcaaatctggttataaagttagagtgaaaaaatttgttcttcatttcaaatcaatataaactgtttgaaataattaagaatatggcattgcttacattataaacctagcatagacagttcatctattttttttagatttaattttgtttttttttaagaccatttccttgaggtttctaaacctgattatatttattgatgttgcccagtggaccctgcctgtggctcttctcagttctttctagtactagaaactctatatgtcattgcatctgggaaataatggcaaagtagatgtgcattgaaggagttctcttcctatctctcgctgacttttgcctcacccctatatgcttcctgtcctgaatatagaaataggatctttctcaaaccttctcatggtggtagctccagtaaaggaataggtaggagacctaggataggtggagatctcctgtagggtaggcagtggcagattagggaagggaggagggtgtatgcccactagaaccccaaagaggctctgccattatcagcttgggtctatatgagttatttttaagttgtctatacaccagattgaggatccctagcccaaaaatctgaaatctgaaatgctccaaaatctgaaactttttgagagccaacatgattccacaagtggaaaatttcacacctgatgtcatgtgatgtcacagtgaaagctttgtttcatgcacaaaattacttaaaatattgtataaaattatctttaggctatgtgtgtaaagtgtatataaaaagtaaattttgtgtttaggcttgggtcccattcccaagaaacatcattatgtatatgcaaatacagtattctaaaatcaaaaaaattccaaaatcccaaacacttctggtcccatgcattttggataaggggtattcaacctgtactgaagattgccagaatgtggtatgcagtttccatctgtctgcagacagtcaacatattgtggcactggctttgtttgtatatcattggattataatttttttcgtggaagtttttttttttactttttgtaaaagtaatagattctcagggtaaaaaagtgagagaacaatataggaaatgatttccttatttcagtcaccctaaagatacgtagtgttagcttgcagtaagttatttttatttatttttccatctaaaccatataaatagacataaattatgtatatcttgaaaagcttagatgtatatatatccaagggagaaaagcaagtgcctgaaatctgattgcttagttttctgctcatttatatggcgtctactctctgaaggatagacacaaagaaaagttttattcctccttatgctttttcttcctttgcacctgtactcaggcatgttgactactctcacttttaaagtcatgaccactaatctttatgggcctttagtgctgactgggaatcctacatttccctagtccacctatttcccatttgtttggataatttttacatactttctcattttcttcaacctgtaacactttcttctctttcctcactctcagctgataatgtgtatgttttcctgtttctgtgagaaatttctacatgtccttacctccatatctactaacatgagtgcacaggtaccccatcaagttcacttccctccacttacatggataaactgttcatctgtctatgatcaacttctccaccagacactggatcctgttccttctcaccaactcatggacattaccccagcaattgttctatttcagatgaacatttctgcatgatcattcccatcagcatacaacatgctacaatgtctcttatctttaaaacaaaaaaactacagcataaacttttaatctcacattcccctctgagtatattttttctgcccctctttaatagcaaaactcctgaaacttactttctctactttttctcctgccgttcttgattctacagacatcaggcattcagtgccactgtcagtatcactaattggacaaatgtcagtgacatttgacatggttgatcacttcctttttgaagcacattctttacttagctctgagatagtatttcctgctcctccagcctccccagtgtcctttgttggtactactttgtctccgtgtctctctaaagtgtcttgggctctggatgtgcaaagacaaacatgccttatctcccacccttagggggcatgctattgaaattgagatactatagcatgaaattgagatgctatagtagaggtttttaccttttttttcccccctgaaacgggtcttgctttgtctcccaggctggagtgcaatggcacgatctccgctcactgcaacatccacctcccgggttcaagcgattctcctgcctcagcctcctgagtagctgggcttacaggcatgggccaccatgcccagctaattttttatatttttagtagagatagggtttcaccatgttggccaggctggtctcaaactcctgatcttgtgatctgccgccttggcctcccaaagtgatgggattacaggtgtgagcctctgcgcccagccggtttttacctttttaacatctcttcacaattaaaggtgtccgtctataatgtcttgacacacttacgttgttctaccaagtcaacttggacaggccacggggatgctgtaaaagcttctttccgcctgttcagagatgtttagttttttgtcatctgtaggttctgagtaaccagtctggcttgctctctgttgccgacacagcttgtttttttctacctttgtcttagacttgatcatttgtagtttctttaccttctagcctattttcttgtagataataaatgccatttctccttgttctttgaatttgtgggtcagcactggccatttctaccactggctcctgagattctgaaccccaccagggttcagggatatcatccagaagaggctttgcttgcttgcttatggcctctgtatctgtggactgggttgcttctttcatccttccatccattcatccagtatttattgaacaccttttctaggcagtgatgatgcagcagtagacagaatagtcactgaggtttacgtgagataaaaagatatctgtagaatttgagtggttgtttagtattaccagccatctggtcccttaagatatgccagtcattttgtttattctgctaaaggtgtaggaagaaaacataggtaaatgatttgcttaactttgctaaaatatgaaagtaggtaaatataacaacacttgaatctgaaattaaatagcacagtatgttggcttagacagtggaatttcatgatatatctgatttcaagttccttgtcctcaactcagccctgtctagagatcaactgtctttgcttttttgtctttaccatctttctcctggcttaccttggttgttccctctttttcccctccttttagttgcttaattattaatcgttactattaatttgagaaaataacttattatacttaaaataatagatagctaagtatatcaatccagactcccatctgtcagtacttttgaccagtgtgccccctacagcctcctaggaaaaagaacccctcctcaaatagtagaggatcttaccacatgtggcgttatctgtgccttatgtgcgtctaaaagggtttagatggtgaatgtaggtgtaggtactatgagggtttctcggttttgacaggtcaattttgttcaggctttatcgttagcatatagaacagaggtatgcactaaataagtatttgttgggtggatgaatctgggtgccagtgagttaagacgttgtattaatgtgatgattctttttacataatagatgtttgtgaaaacaagttttgcttctgtaaacttcattaacttgacataactctgagcactgaaatgtagtttattctatttggaaatatgtagtactagatgagctcatacatgttattgtgaactgctgctgctacctgtgtttttgaactgagtcttactggaagcttccaaatgtagttctgtgaatttgttgcatcagatttgccctggttatttaaaacaaaacatgtctgggaagtgctaaaatctaccaaatcagaatatccaggagatgaggcttaatattatttggtatctttatgaaattatctgggttgaggaacctctaggaagtacttacttttgtaactttcagttttcttttgatttctaacttccacagtgctatggctctgttccggtatgttgtcctttttgtcttttattgtttgctttggtgatggcaatgctatttctacttagttaaaagtatgctgtgtcagctcacaagcatgtggttagagatttcttcaccagaaatgtatgtataaatttgttggctttgtttcctggaagacagtgatgtgaaaccatgctttaaaaacaaataaatggctgggcatggtggcaaacacctgtgatcccagcactttgggaggccaaggcaggcagatcccttgagcccagaagttcaagaccagcctggacaacgtggcaggaccctgcctctactaaaaataaaaaaaaattaggcatggtggcacgtgcctgtagtcccaactactcaagaggctgatgtgggaaggtcacctgagactgggaggttgagtcttcagtgagctgtggccatgccactgcactccaacctgggtgacagagtgagaccctgtcccaaaaccaaactaaacaaaacaaaaacaagtgaagcacataaccctagcagcaggattgttttatcatgtagaccatgaattaattaacatttcgtttttttcttcttctttttttttttttttttttgagacagagtcttgctctgtcaaccaggctagagtacagtggcgcaatcttggctcagtgcaacctccacctcccgggttcaagcaattctcctgcctcagcctcccgagtagctgggattacaggcccgtgccatcacacccggctactttttgtatttttaggagagatagggtttcaccatgttggccaggcgtgtcttgagctcccgaccttaggtgatccacccacctcggcctcccaaagtgtttggattacaggcatgagccaccatgcctggcctaactttttttaccctatataaggataggtgagttgctattcctgtttatgtgaattacattatgcatgatgggtaggacaaggtatctttttgaggaataatggagcaggaaagctactggaaaaattctaataagtacgtgtatttccttcccccaatcatatttaccccaacaaagtaagtagtttattgagatttcttttactttttgtgtatatatatatattttaacttaaggatgtacctatttggttagttgtacaccatttacttaacatgtgtttacttttttagctgctaagcatgcttctaagctttggatgtacaaagacaaacctgtcttaacttcctagcctcagaggacatgatgacgtggtgaaagaataagaaaacacaacgaaaaattttactgtggtattgttagagacttgtcagtggtaaccagatggtgtgatgggagctctgagaaggtgcttccaaaacagcaccaacacttagggggaagtttcattgctcagggcttgaaaggttagtgaggaagaatttgagagtgtagagttgagagagaagggatgacatcccaggaagaagaaacagaatttgtgacggcataggggtattttatatgaaggaatttcacatgtcaaattttcctaaaacagaaattgtcctgtctaaaattggtggttctgtgaagctttctgtgtttactcggcttccttccttatcgttaattgttcgggtaacttgatcagtttatatttcaaatgcatagccttgtggcacatacgttattttgaagagagacaaggtaaatttaaaagttagataaacttagatataccagtgctatgtagaacctgcccgttatcctgttggaatgccacagggcacaaacagttatgaagtagttgttggatatatgtatattggtgtactaaactaatgatactgtattgaggctgctaaatttttggaatagaatattaaactgggagaacaaattacctaaaacgtttagaaggaacaataccttgagctcaaacagggctaggaataattcatattctaatcaatcaaagtagaaaaccttatatttcttggagtattggatagtataactcagaagggttttgtcccagtagtggggcaaaattagccacactaaatgctgttctggtaccctgtaacaaaacctagagcatgacctgaaaggataatgtatttccaaataactgcatcctagaagaaagctcaggaatgtgtttaggaatacaaaatatctgatacctgatacgtaaaagtcccagccttctactcagaaattcccatacatataaagaagcaagaaaatatgacccacaataaggaaacaaataattaataggagcagatccagaaatgacaaagataatagaattagtggacagagacattaaaacagttattttgaccgttattttatgcaatcaagaaaacatgttagagacatgaaaggtgtaaacagatccaaatcaaactttcagaagtaaaactacaatgtctgacatgaaaaatgcactggatgggattaacagcagaagtcattgctgaaaatttccacatttgatgaaaaatacacacatccaagaagctcaacaaacccggagcacaagaaatatgaagaaaattataagatacattataatgaaatcacttaaaatcagtggtaaagaaaaaaatctgaaaaatagccagacggggggaaaagagcacattacatatggaagaacaaagataaggatggcaggagtcatcattgcatctcattgaacagtgaagccagaagatagtggtgcagaatcttttaagtactgatagcaaaaactatcaactaggattcattacctactaaaaatttatttcagaaatgaagatgaaataaagacttttcccagacatgtaaaagcgagataattcatccgcagcagatctgcattacaagaaatgtgaaaagatgtccttaggcagaagggaaatgataccaaatggaaatctgaaaatgaatacagagtaccagagatggtaattatgtggataaatataaattactcttaccataactgaatatttaaagcaaaaataaacgcattatgaagtaaaagttaataacaaaaaagagcaggagggagaaatattgttgttaactagtttgtttttttcttgagagacgggttctcactgtgttacccagactggccttgaactcttgagctcaagtgatcctcttgcctcagccacccaagtagctgggactttaggcatacaccactgcacctggctctgttgtaagattcttaaaccatacttgaattggtatggtatcatttgaattagactgtcatgaattaaaaatgtataccataaattctgaagcagccactgaaataacagatatatagttaattaaccaacaaaggaggtaaaatgcaatcataaaaacaactcagctaacccaaaagaaggtagagaaagaagacaactagaacaaagaatagataatatggataggaaactaatagcaagatgactcaactgtatccatgagcacattaaatgtaaattgcccaaatgtctcaattaaaaggcagatgtgttagattgaataaaaaaacaagatgctacaagaaatctactttaaatgtgaagacacaaaggttaaagtaaaaggatggagtaagatatttatatagctactttaattattttcatgattgcctggctagcaataatgaaaataattaaagtagctatatgaatatcagataaagatttcagagccaagactattaccagagataaagaagagtgttatataatgataaagagattaattcctcaagaggacataacagtcccaaacattcgtgatctaatagcttcaaaaatcttgaagcaagatgttaagaactacaaggaaaaatagacaaattcacacttaaaatcagagacttcaatacccctctcgataactgataggaaggtagaaagaaaatcagtaaggatacagatgacttgaacaacaatactgaacacaacatatcctaattgacattaagtgtaccctttacccaacaacagtagaatgcaccttcttttgaaagaagaatggatcataaagtaagcctcaataaatttaaaaggattttagtcagatagtgtgtaatttcctgaccacagtagaattaacttggaaattaataacagagaggtatctaggatatcttcaaatattgggaaattaacatattccaactaacccttgggtcaagaaaatgaaaagggaaattacaaagtatcatgaactgaatgaaaattagaacacaacatcaaaatttatagcatgctactaaagaagtatatatagagacatttgtagcactaaatatttgtattagaacaaaggtctcaattcaatgacctttagtttcttccttaagaaataagaagaaaaagagaaaattaaaacccatagtaagtagaagggaaataataagagaatgaagaccaatgaaatggaaaatagtaaaaccataaaggaaagaaaaactggcagagtgtagtggcttatgcctgtaatgccaacactttgggaggctgaggcaggaggattgcttgagcccagcagagcagttcaagaccatcctgggtaacatagtgagaccccacctctaccaaaaaaaataaaaaataaaaaccctaaactggctttttggaagatcagtcaaattgacaagactcttgccggaatgatcagataaaaaagagaaaagacacaatatcaggattgagagcggtatcttcactttagatccttcagatgtttgaaagataataaatactataaacaactttatgccaataaattcagcaagttaaatgaaatggacatattacttgaaaggcacaaactaccaaaattcactcaagggaaaaaaaaagataatatcagtagtactttatctacaaaataaattgagtttgttttaaaaacgtacctcaaagaaaacttcaagcccagatagatttgccggtgaattataccacacatttaaggaagaaatactactgattctgtacaaagtgttccagaacattgaagaggagagaaaattctttgcaacttatgtgaagccagcatagcactcagaaacccaaaccagaggaaagcataagaaatccacagtccaatatctctcatgaacacagatataaagattcttaataaaatattaaatagaatttaacaatatataaaaagggcaatatatcactcaaggagagtttattcctgcaatgggttgttggtttgatatttgacagtgagtcaatataattcatcatattagcagtctaaaaaggagaaatcatataatcatctcagtaagatgcaggaaaaaacatttggcaaatccgccatccattcctgataaacgccttatgcaaagggagtagtggagaactttgttaacctgagaaaggacatctacaaaaaaattctctaactgacagcacacttaatgttgaaaaactagctttgtttctaagatccaaaataggtcaagagtattcccgtcaccacttatgtcattgtactggaggttctaggtagtgcactaaggctggaaaaggagataaaagatatccacatcaaaaagcaagaaataaaattgtctttattagcaaatgacatggttatgtagaaatgcctgtggaatttacaaaagaactcctagataaatgagttcagaatgcttccagagtatgagatatacaaaaattatgatcctatttttatagtgttaaaaactatgtatcattgaaaaatgaccaaaagaacatgattctctatggttgataggttcttaaattttctttgattttttttttccccccaatttggcttttctaatttttcatcaggtgtttacttttgtaataatagccataaaaggtattgttttcagaaatataattttaagccccactatataaatgtaaatgtaatagagtttaataatttttagtaaacatcactattcaaatccttacatttaaaacatgtaggaacttacattcagtttatgttttcttattctgacctgccattttatacatcaatcagctatgccacctttccttgatctccaaaatataaggcattgtgagggcctgtgattgcattcataattcatttctccccacatattgatgagtgtcacctgtgtaccaggttttggggaatgcaatgatgaagagaccttatggcctctgaaacttacacttttctccatcctcacctcttgccattttctctctttgcttaatgtattccagctatgtgacgcttcttttagttcttggaaagcccattcactctcatggcctcacacattcagttttctctggcaaggatacttcttcacacccccaccctccacccctcaactccatactctgttatcttctgggcttaaatgtcacttcctcagggaagctttcgctcatctccctgacagggttgtatactttaatagcaccttacactttcccttcccagaatgtattactgttgtatttaatactttttgtgtgatctgtatttggaaatattgttgtaggctagtatttccatcacagatatgttcttctgcattgttctgcagaggtgggctttagtttatcttgagctgttaagtctgttgtttcaccttatgataaaacaacttggcctcttggctgaattattagcacaatctgtggccaggattagatggaacaaatccagttgttaataatgtaccataaacataactgttggaatttcaggtaacacaggaagaaggacaacagttagcacggcagcttaaggtaacatacatggaggcatcagcaaagattaggatgaatgtagatcaagctttccatgaacttgtccgggttatcaggtaagcaaaacacattctagatgtgtgttttaataaattactattaaatgtttttagtaaggatattttatatggaagtgattcctttctagggattaatgcacatggtgcattacaatttttaagtacatattctaggcacttctagaatataaaatataatttaattatgaagtataaagtacacataggattttgataagaataaatgctgcttccaaagggggtgatggtgtgaagatagtgatgacagcagctaacttttgcatggtagtctctgccagcttctgtgctaaacgtttttacgtgtattattacatgtaatcctcaccctcgcccaataaactaaatactgttttatcctcactttcagaggagaaaatgggggtacagagaaagaagttaaatagcttgttcaaattaagacatattaaatggcagaactggggctttaattcaaacctctgattccagagcctgtgctcctacctttctttttatccagctcatcccaggctaagagtaaaccaggtagtagagattaaataatcctgtaaggtgtgaagtataatgtcccacacaacagagaatttttctgttagatgccatagggggccttttggtttaaaaagtgttaacgggttccaggaagcttaaggtgttgggtgaggtctgatagaattacgaggtacgtttgtgggtgagaaagatgaagttgctttagtgagtaggatttgatttattattttgggtcttgatgcctggcccctgtttcatactctgctctgtagatctgggattctctgctagttagacagtttgataggaatgtgaagtgggctgctttttttttttttttttttttttttttttttggaaacagagtttctctttgtcacccaggctggagtgcagtggtgtgatctcggctcattacaacctccgcctcctgggttcaagcaattctctgcctcagcctcctgaatagctgggatttacaggcgcctgccaccacatccagctaatctttgtatttttagtagagatggggtttcaccatattggccaggctggtctcgaactcctgacctcgtgttccacccgcctcagcctcccaaagtgctgggattacagcgtgagccaccgcacctgggctgcgtatttattttgtatctaaggtaaattgacacctgagcgatgatcttctacttattagctccttgccaaggcattgtctttctgtggaggaaaaaaaagtgaaggttatagctttttcttttttagtagtttgttaaaaatcccagtcccatttttttttaatggtaagagtctcggttttataagatgaaaaagagatctggagatggatggcgatgatggttgcacaacatcatgcatatacttgataccatcaaattgtatacttaaaaatgattaagatggaaaattttatgttatatgtattttacccccctttcccattccagttccattttagtgttaagcaactgatgaggcagtgccttcttaaaataattatgactgccgttttgaaatgttgtcctttgttttggttcttaggatctctccttacccatcagtaattcaggaatgaggggagaagtagaggaggttttttgtttgttttgtttttaatgccaggagctattagatatattctaacatcacaagatctttaatcctcacaacagctgtgaaaggtaggtttccattattcccctctaaaaaaactggggctcagactaggtcaactaactttgtctaatactgaatttaaaaaatggcagaacacagataagacctgcatacctcataaggttaattttatattgcactctaatgatgaatctttattcttaaggataccttagagtcatggaatttcaaattgggatgggaacttagagattactgagtctagtatctcgtctgattcaggactcatccattaaagcagcttcatagctctgcttgtgctggtgttgacgcgtttgtgcccttttttggtgggggtaggaaagagagaaattccctcgttgaagtttaacactgaaaagcatacacacttaaaagtgaacttgtacaaaaaataacctgtgtttgtaatagtagattaccaagaaggcaattatattttagaattttttatcttacaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaa

SEQ ID NO: 36990 - DNA, 4851 bp, Homo sapiens
aaatccccctgagaggtgtatcggctgcttcagggaatagagcagatggggtgaaggtttttgcaaggcctttagtgacctgctttcaatttgctgcaattcttctgctttggctttttcctataggtgccagagttcatctgcttcatatttttactactgacgcatcttcctgtcgtatattcttagactgtggtgacttaagaatctttgggtcacctgttacatggtttctcctgccacctgtatggggaggagaagactggtattcaaactcaagcctgtttctatcttattctcattgatttttatgatacatagaaaactttgtttctttctgaaaatggcattttagtgattcattgttttctgtgggagaaagcttatgacctgctcttttctttttcccttccagagggaatctggaaaaattgcaatcaaaacatcatttctctaagaaaattttgggtaaccgaagttctggacaacaggtaaagtgtgtttaaactttggtggtgctgacaaatcatctgtaatctgcagaagtaaactgggagagggaggaggacaagttaaaaattaagtctactttgtgtcggggctttattggggatttcccatatattacctcatttaggtggtttttacctggatcctggatgtagatctgggaatctcagaaagaatctgtcctttaaaatgctgttttaaatggatttgctgttgattggatttaatgtcctcacagttcagtttagcaatcattttttaatgtctaccataaataaggtacagaagtataatttgtagattctgttatatagtaaaggggtacaatatttattgcaagaccatttactgggcttctaagtaaaaccaaaatctggtatgcgatgcagcctagctagggaagatcttcctagttcccttctgtcttttgttttagttcttaatgattgccagcagtttgtagctgtaccatcttcttaatcccttttagcacttgtctaaaatttaagtttcctaataaatcaccccttcacagtggagtccaaccgaggtgtcccctttatgttctcagtggtggtttttctgtgattggaccgaataactatacctgtgtgttttttaaatttctatctcacaaaattctgaaggtctcatgaaataatagtatgtgtaaagaacctaggtctggccaggcatggtggttcacgcctgtaatcccagcactttgagaggccaaggcaggcggatcacctgaggtcaggagttcgagaccagcctggccaacatggtgaaaccccatctctactaaaaatacaaaaatgatggtgcatgactgtaatcccagatactcgggaggctgaggcacaagaatcacttgaacctgggaggcggaggttgcagtgagccaagatcacgccactgcactgcagcctgagcgaaagagggaaactgtctcaaaaaaaaaaaaaaaaaacaaacagaagaaccaaggtctgagaaatatctcagtaaatagtagctacaagtttaccttttaaaccagaggagatatgaaagcaatccatactttctgggaccttgtggggccaacaggtgttgactgaggtgaattgaccttcttgaagatagtagagagtgagatgctgtttattctttttttttgagatggagtcttgctctgttcaagcaattctcctgtctcagcctcctgagctgctgggattacaggtgcacaccaccgtgcccgggtaatttttgtatttttgtagagacggagtttcaccatgttgaccaggctggtctttaactcctgacctcaactaatctgcccgccttggcctcccaaagtgctgggattacaggcgtgagccaccctacccaactgagatgctgtttattctaacatttgttccactgtgaaccttgaggttagatttcaagtattcaaagcagtagttcctagagatatcataattagtaattaaattaagatttaatatttgttgattttattttggtatttttccacttttatcagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccacc

SEQ ID NO: 36991 - DNA, 1195 bp, Homo sapiens
gcatttctctttaggttgtggacgaagtgtttatttatcatgcctgaacctgctaagtccgctcctgctccaaaaaagggctccaaaaaggcggtgaccaaggcgcagaagaaggatggtaagaagcgcaagcgtagccgcaaggagagctattccgtgtacgtgtacaaggtgctaaagcaggtccaccccgacaccggcatctcatccaaggccatgggcatcatgaactccttcgtcaacgatatcttcgagcgcatcgctggcgaggcttcccgcctggcgcattacaacaagcgctccaccatcacctccagggagatccagacggccgtacgcctgctgctgcccggggagctggctaagcacgccgtgtcagagggcaccaaggccgtcaccaagtacaccagctctaagtaattctaacgtcttcatacccaatcccaaaggctcttttaagagccacccactttttcagctatagagttgtaattacctgcatattttccgtgtttaccaccaacaggtttggttttatcctcatttgagggggttgctgctgtgtaggtctagaccacagttcttttgactggttgaaggaaaatgctatacttaaccgtagcatgtttgttttaccccaagtgctggttagaaggctagcccattgtgctgataagcacatttttcttatgttgtgctgtgatgtgtcccttgtcaaattggtttcataagaaaagaacttttgaaatatctcttttgctactgacatagtgtgagggaaaggaatgtcttccttaattccggtttagtcatcgcagcattggcgaatttagctggttaaaataatgtaatcaaattctttaaaatataaggaaagcaagacaagtaatgtgcatgaaaactgaaaaaatgtgaacacccgagcctggatgcagcactaataatcaacattgttcttggtttagttaaagaaaatttggccactggcaaaataccatttgggagtaatgagacacacccctaatcctaaaatattttcttgtcacttcctcaaagttgtttttgactttttttccttcagggttgacttcatatgtgttcattttattctaataagcaaaagttgtaatttttaagtgaaaaaataatttatgtcattctacttacaaatacaatttttctattctatatactc

SEQ ID NO: 36992 - DNA, 174162 bp, Homo sapiens
ggaaggcagaagcaatctctgccgagagagtcagccgagcggccgcgcggagaggaggggcgggcggtccccaggcgggcgggtgcagggcgcagggcgccgacctgctggagagggggcccgggcgcgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggccggccggcggcgggggtctgcggcgacccaccggcctcttcgagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacggggtgagtgtccggatgcccctcgcttcccgccgcgccgccgccatgccctctcctagcccttgtccccctgctgcctccgggcccagttgggaggcccctgcccggccccggctttgctacctcactcccgcgtcctcaccctccagcgccccactcccgccgcgctcgcagcctccccggtgcaccccggacactgggttctattagtacccaccgcccccaaaagccttgaggggtttccgtcgttcctggagccactccgggcgccctggactcttctccgactctgcgcacatcccgcacctgctcatttttctttcggacattctcttacccggccctgtagattccaaggcagctcccagttttccatattgttcccaacgcattcactgcccacagtccccacacaaacttctttcgcaggctcacaacatagtccctctgccccgtgccctttttgcaataatctgccagtcccctaagtcttagctctgcctatttaacagtagtggtgtctcagaacacacacacacacacacacacacacacacacacacacacacacacacacacgatccctgacatatttggcaagagtaggccctgaaggtttttattattttggttctttaacccagtggaattactgaatgatttatttaattagggtagggatggagtggatccatttgtttgatgctaaacagcctgagctcgcagttcccagggggcatatctctaaatggtctgaaatgagatttgcagtggttttcttaatgcaattcccaacttctctccaaatgccttttggcatttgacaacatttcatgcctcttcccctttcggttttcatccttgttttctctcccttctcccacgacctcggtagtcttctgcaatccagattctcagacttcaggtttttctccctctgcccctttcctctctgtcctataactagaagcaccttttggcatagacccatatcccagtttcctctttcccaggtccagcagcatctcaaggacatctacaagagggatacctaatttcaggggtctctgaattatatgtgggaaacatcgtctaaaaaagtaattttatccttattcatgcaaccagacccacactcatagaacttttctttaaggaaagtgtcttgcagatgtataaatgagtgttaacatctttaaaagcgaaactgaacaattccctggcatttgaattccctccttccttcccaaccctctccttttcattttctcatttattattaaaaacatttttaaaggatctccatgcttcatatttatctactataattcctccttctcggtgttgcagggatggggaaagaggatttttttaaaaacataataaaacgcaattgggagaaacagggccagtggtgttggggtgggtagtggaattgtgatttttgactccagtagacaatgatgctggatatatggggtttgatttatctctggctcctcacttgggattgatgaagtttggctagaatcagggagttgaagagaggttgacaaatggtctttcactcttctctgacaggctgttcctgtggagtgatggagaataacgagccttgggagagctatgggagctctcatacttcttcccgagccaattttttagggagtgagagaaacatggcctgtccaatacttgttgtgggtcaggatatttttgaagctacggttgttgatttgcatgggaaaattattatgtcttattatttcttgtcccactttaccataaggactcctcagcttcttacttcaatgggtcttctatgacaaacacactttattaactctaagagtggaatttattttaacagataattagcataggtcaatatatgcttaaaatagggtcaaattaaacctactagctgttataaaggacagatgacaaattaaaatccacatagaagcatcgactcttaaataatctgaaagtactacttctaagaggggtgggcatgggtgaagggaatggtggacatgtttcagaatttcaaacagccaactttaaccaatcttttcctcattttgttcaccttcttgggggcttatgctaaagtgaagtgaatagccataaggctggcttcaggagaaaggtggtctaaaagaactggataattataagcaaaattggtcttgaatgattgaaaattgatgagaatgtgcttgtctcctgatttggcatcctgaattagactcaggaatactgaacttggatcccaaaggctttggtcttttttgatatcctattggatactcataagcaggctagaaaaatagaaaactagaatttattctctttgaactgacaaatctaaccagtgggctgcattctctatatctgaaaaatcttggttttgattgaaaaagttaattttacaaagcaattttctttttttaaattaaatttcattttttttgagactgggtctcactttgttgcccaggctggagtgcaatggcacagtcttggctcactgtagccttgacctccccagattcaggtgatcttcccacctcagcctcctgagtagctggggctataggtgcatgccactatgcacagctgatttttgtgtttttactactcatagggtttctctgtgttgcccagtctagtctcaaactcctgatctcaagagatctgcctgccttggcctcctaaagtgtcatgaaccaccatgcccagcctacaaagcaatgttctaggaaaaactacagttactctttgattatgtaattgctggagaagaaaaacatggcatttctaaaatgatgaactatattacttatattttaatatctcataaagtttgaaatagacatttcaaacataaacatgtataaaaaattttataaattaaaaatataatatcaaaaacataaaattattttattataaaattattatagaatcaaaaacattataaatttaaacaacttttttaaaaatttattttgggatttcccatggagtgatggagaataatgagccttgggagagctatggcagctctcatactccttcctgggccaacttttttaggaaatgggagaaatataccctgttcaatgtttattgtgggtcaggatatttttgaagctatagttgttgatttgcttcaaactttaaaaaatttattataaaattatgggatgtaaaaaaatttattataaaactttgaaattttcaaactttcagaaaagcagagagatgagattaatggcactcataggcaaacatagaacatagattgtaaacattttcctatatttgtgtcatgattattttttgcttgtgtttgaaagtatattaaagaaaatgatattttacccctaaatctttagtacagatttctaaaaaataagaacattttcctgtatagttacgaaatcatcttttcaaacaaaataaaaaatggtttttttatatcatttattacccagtccacattcagatttcctcaattattatgaaatgtccttttattttttgagacaaagtcttgctctttcacacagcctgaagtgcagtgaaacaatcatagctcattgcagcctcaaattcctgggctcaagtgatcttcctgcctcagcttcctgagtagctaggactataggtgcacaccaccatgcccagctaatttattgtttttgtagagatggaggtcttactacgttgcccaggctggtctcaaacacctggcctcaagtgatccttccagcttggtctccctgaaatatcttttgtggctggtttgttcaaattagtttcttctaatcaagggacacacattgcatttgattatttagctcaagactttttttaacctggaaaataccctcactctttgtttatgtatttatttaatgaaattgattgttgaaaaactagtcagttgtcctgcagaatatttccccttctggaattttctggttgctttttatggtgtcatttaacttttcactctgttttttcctggttaactggaagttagttctaaaggcttttaggcctgctataacaaaataccaaaaactggatgacttataaagaacagaaatttatttctcacagttctagagactagcaagtttaagatcaaggagcatgcggttttgatatctggttaggaccaactttctggttcatagattggccttcttgctgggccctcacatagtgggagagactagctagctctctggggcctcttttataagggcactaattccaatcatgagggctctgtccttatgatctaatgaccgcctaaaggccccaccttttaataccagcacctttggggttaggatgtcaacatattaattttgggaagacatacacgttcagcccattgcaaggtttagttagattcaggttcaacttctttttttaaagactatttcataggcaataatgtgtattcacatcccatcattagtgatggtgagatgatcgcaaggttagggcgatcactgcctatctcctctgttatattcccccttgggtcaagccagtagtctgtgacgtgaactttgtaccatgtgtatattcagttatattctgtatcaatatttacttgattgttttagcatttattaatgatccttgcttgagttgattatttcattaggggtttcaaaatggtgaatttctaattctctaattctatatacatgttttagctggcatttttctataagcagaccattttcttcacaactgggttatttggctaccctgaaacatagttccttccgggaaggcagaacatatgtttatttctgtcttttaaaaattactggtgtttggagtgaagatttggtgagttaactacctccacaggtgacaaatgaattttgttttgtctcacttttgcttttttgaatatcactgtggatgcttggatttttatatttaatttgaatggattagggaataaatgagaagataggttttatctgtttctgtagtttttatgtggctgtgtgaacttacatttaaaaattcccagaaatattttaattcccctttaaagatataaactatgtcatactataaagcaaaagaaaaaccaatcatgtgaagagtaaatagtatctttaaacgaattgtggttaagcttagtttgtaactaattagttttttattttctttctacttttatctgcttcagagcctcttcagtggtttagatcttctatgtgtcaaattattctaatctcttaaaaagtttaagagctaaaatacaacacaatgactacaggaatgcctttgtccttttctgggtgggtacacctaaggcaatttctttttctcttctttgttctctgcttctttcttattcttaaatcatcttcaatattggacagatgtcagcactgtgcctgcctcaagatgtttctgactttttctttttctttttttttttttttttttttgagatggagtcttgctctgtcacccaggctagagtgcagtggcacaatcttggctcactagaacttccgcctcctgggttccagtgattctcccaactcagcctcctgagtagctggggttacaggcatgcaccaccacgcctagctaattttttgtatttttactagagacggggtttcaccatgtcggccaggctggtcttgaactcctgacctcaagggatctgcctgccttggcctcccaaagtgctgggattacacgtgtgagccactgcgcccggccgtttctgactttttctaaagtcttctttctctggagatgacattatataatagcactgttcaatagaagtttctttgatgatggaactgttctgtaatctgcattgtcccagccactagccatatgtgactactgaacacttgaaatgtggctagagcaactgaagaactgaattttgcattttacttaattttaattaattaaaatagaaatgcaaataaccataagtggttagtagctaccatactggacagcaaagacctataattcagcatttaaaatcgattttgttttgttttcaaaaatggagtcagactgttacaacccaaaagaactgtaggttaaattaaggtaaatcaccaaatactacatacacatttgggaaatccaaaccagattttttcatgtgataaccacaccctcttttgactttagccttggaggtaatggagtatggcagaaaaaaccctgtatcagcagctggaagactcaccttcttttcctagctctgccatatattgaccaaaagagtcaaagtccattcagatggttgaggggccttggaattttgtttttggttttcacatacaagttggagggcagatgcgttagcctcttgaaatacccagaaaccacttgtttcctcatctaaaaatcaggtatgacaggatcatttaattatcctggaaatcagatgaagcactgcatatgaaagcactttgtaacatcgatagcactgggaaatgtaaagaccttttactgaaatataaaggtgtatggtcaactgaatatatctcagataattatgatttgactgtatgtattgaatataacctgtagtgggccccttggtaaacaacttacagttttgttgcaagttttagccaagagaaaatgtatttgttgactagtcatgccctttattggccacatgatgagcagcaatgatattaacacacagtgcaccttgcagaattcaagaatgtctcagtgtcttgtgaactaggaagctgaaatgcagtggtatgcagaaggctggctcagtaggagccttgggagtgtcctccagatagatgtttgtgcaggttgtatttgattccagttggccatgaaaagctggttgctctaaagaatgagaatatacttggttttgcatttactagaactatctggggaacaaattcttggggtggaagaaagaagggagggagagaaagctgtgcttcaatacctagggcttctttcctggaatggatctgagaatctgggattgggtggctaatatctcatctctagaagggagaaagaactgggtggtgatggctttgtattttctactggagttcactacagaataggtgaatggaatgggctgctatgatccagacattagggaggacaggtttgtgatacattagaagacttgaatgagcccttctatgattctctcttccctctttctgcttccctttctgaatccccatccccaggttgtggaattagcaaatctattatgtgagcaatagcaaacttacaggagcccttggctccatctatctccctgtttgtgtcagttcattctggatgcttttagtctgtggtcttcattcactctttttatggggaagtaaaaggagtgggacagattatgagaacagctgggtcctcccagttgctggggtggttattttaagctttgtttaatgtgtccagagacccagatggcatttttaactaagctgctttattaaatcttgtgataaagcatagtgatgtttattgaaaaggcagacacacatcagcaacattatgcgtgaaacttgccctaagaattttctataaaacatctgttctctttgagccttttgtgaactctggaagtttgctagtttctatacagacttgaggacaagaagttggaacccacttttggagatgtccaagcataggtattggaatcattaatcctaaccctctcagttttaaggccccggatacccttctgttagacaacagtaacatgagcaagcactgtaataacatttaaacaagattatttggaaataatggacaagaaaaattagtataaattgtttggggattttaaaattaaagataaaaagctagggcttcaatgacctgtgccagcctatagccttaagagtcaatttgcaaacactcaagatttggccaatatgcctctactacttctacttaacacagtcaaagggaaatttttagattctttcatctgatttgactctcttagttatgaataagaggatatctagaatatatatgtgacttgttaaaatgaaaatccaccttctctgagtcttcaaatatcttacatatcttacatttttagtaacatcaacttttgaagtcatgtccgtagttgtatgaaaagaaaaatttcaggaacattcaacctcaaaagttctttttcttagtctgaagtcgtagaagcatttgacttttactttctctttttaagtttgtactagtaggtattttgtataaatataatatttaattattgcctttgtattctttttctctagtaaacatcctggtttttagctatcaatatgtagttttacatttagggatttctaatggaaagagaaaggaatctgaaatcagaggacaagagtttattctacttgaccaaacacatacgaaatactggaaggagagttttacaacaaatatttaatatctatgacatgtaaaaaggttttccaaatcaagaaaattcaaacaattcaatacaaatatcatcaataataacacatgaacaggtggccaaccttattaataaccagagaaatataaattaaaacaatccatcaacttgtaaaaaagatgaaattacccagagttggtgtaggtgatggaaaattgtcatgtttgtatactgttcatagaagttaaattgacataactttttggtcaggcaatttggaagtatatatctaaattaatagagtagttttctaataacctgggaatctcttaatctaagaatctttactgtagatttttctagaacaaatgtacaaacatctatgtacaagggtactcactgcagcattttgctaaggaaaaactcagaaaaaatctatatgttcaacagagaacaggtacataatttatgacacaactgcacaatatacaccactaaaataaaggatataaatttatatgtagtatgaaaaagatgtgaatgatagcttgttggtgaaaaacagcaatgactggaatattgtgtgtaacgtaatcctgcttttctgtatataatgtaggcatagaaaataggattgaaaggacatactctagtcaacagtggatatagcttgggtggagggggtgtataatggggaaggagagtcccttttcctatctattccatatacatctctggatttaaaagatcatacatgcatatgcattaccttcaaaattaaaatgataaagacaaaaggagaagctttggatttgaatcatgatactactgtttgcaacttatatgaccatggggaagtcgcctagcctcctagggtttatttcctcatttataaaaatagggaaagtaataatacttgtctacatatcttctagggttgttgggaggattgaatgtgataatgggttacagcattatgaattatttattcatataacacaattattataaaaatattttgctctgattaaaataaaagaaggacgagatcatgtgtgtttttgtcccagtagctttactaaccagaaagcgcctgctgatgtggtgatcacagttgctttggtgcagcttcctcttgacttttggcatttctccatgctgctagctaaggctgaggtggcgactgttgaaggtgtgagcttctccccctcccggcacacatttgtatgcgtactcacactcatgcacacacaaacacacacatgcacactctatcacagtacatgaggtggcagcagctgctccggcatagactttcacacaacataaaggacttttttggtgtggtctgtgcattatttcctgttaagcgtgagctgagtcagtgccctgcttttccatctgaaacctttctgaggctcaggctgtgttaagagcaaaccctctccccttcatgcccaccccatggccctctactgaagccagatcttaatctgctcatttcatgaggattttcaaatcgaatggactgggccatgtgagagattactgaaaggaacagaccaagcaggggctaagagactccacgctaatctgctgagtcgtctgaaaatgcacagctgtgggagctcacggtgctttaaagtactttggcaggatgtttgttcagggggcctgttcctgcatccctgctgaatgtttggttaggaggcataatctttttttggacaggatctcccaaatgtaaagtgatagatgctaatgtggaatataatacagaagatccagcttggatgtcataaataacaataaattgtttaatcttgctgagctgtaaatctatgattgccagaggtctttagttcactggaacatagtatgggggcaggggcacttagcaaataggcagttattattttccaaccagacagaaactggtctgatggaatttatctaaaaaggcatacacatgtattttaattaattgtgacaattactcagagaaaacacatggccctaaagaggctgaggggtttttttgttctacctataaatgtatatgtatattcacctatattctacctatgtataagtaagagaatgagtttttgttttggggatatatatttatacgtatctatacagatagatatacacatacttaatttctgtctacctattaaggtgcagtgccagatggaaagtatttttaagcatttagatagtttattctatagcatatgtgtgcatatagcccccccataaagctttgtctcttttctggatatatttaacaagaggctagaacagagtccaaaatgtcagaaatgtttgaacattccatagaaatgaaggaggtgtttccaaatgacctatgtttctatggcaataaatagaacttgtgctgcgttggatgggtcaggagtaaggaatataaacagtgtaagtatgactattccaggcagaaatctaccttgtaagaacagctttgtgcagtgagctcaacaacattgatcagttagcagtccggttcagtacaacattgatcaggtagcaagccggttcggcagtgccagtcggagacacagatggggacaatcaaagaagatgcaggtcaggacaaggatgcagacatgtacctgtcactaccatggacttcagcagcttcttagtgagcaggtttatgattaaagaagaaagacatcgttgatatgtaagcatgttacaattaatttgctgtttagttattagcaaactacatccagtttttagtttttaggttttttttttcttttttcttttttgaaacaggttcttgttctgtcatccaggctggagtgcagtcgttatccaagctcaccacagccttaaactcctgggctcagtggatcctcccacctcagcttcccaagaagctgggactacaggtgcacgccaccatggccagctaatttttcttatttttttgtagagatgaggtcttgctgtattgcccaggctgctcttgagctcctggcttcaagccatcctcctgtcttggtttcccaaagtgctgggactataggtgtgactcaccatgcctggcctacatccagtttaatttatactacagtgtgggtttagtcctcaaacatgtttttgttttacatataaaaatttgaggtaaaagaacatttttacattggtcaataatggtacatttaaacaatggacgactatatccattaaaatcatgttgtggaagaatattcagtgacatggaaagattgactcaagggcaagtgaaacgtgtcaagagtctgttaggtactagacactgtaaactgggtcttggctgtgctacttgcttacatcctccatcatgtgatcttttagataacaaaatcgagatacatagggatttgggatcttgcgcaaagtcacccaggcagtaggtggcaaagtcaattcttacattctttcccatcgaacaccaaaatctcagcttacctcagggcactcaactctgctttcttgacccacacccaggtagacccaatggacacttgtagctcttatccagctggggtggtcacctcataaaatggcaacaagtggagccctttcttgttctagtgagtcagactgtataccttaaagatttcagagcacttcctatgtactgaaatagcctcattaccaggaaggacatacttccaattttcaccacctccattttgcatccaaggaagattagatttcttgatcttctcaatgaaatcttgagaaatgggtgggccgattgaagaacaagacttgggccacacttctagatgcctgtgacttttcggcacttattcagatattaggaattgattatgaaatccatggtggtttgatgctcatgaactctcatccatctctccagcatgtgtgtaaagacttccagaggtacaggacgttgaggatgagctctcttacttccatctggtctccatgtaacaaatcatataactgcacaattatccaaatgcaaatgaaggagtcccttgatgtttggataaccacattcatgccttgagtttgttatttcttgaaattgcccttatccgtcacctgtttacccatggacaacactacttaaggactggcattctgcaacccatggcagcttggctttggggttccttccagtgttttgtttttgtttttaaccgagaagacaggaaacaggcatctttgtgtatatggcttgccacagcccttcgtagatggacatggtggaggctgtatggtcctggagaacacttcctctgtgtagcatcagggaagtttctgttcattgtgtcttcactctctccaattcacttggggagtgatagggattataacacagtgagcagaggatattggggaatgtcatgcttaattttcttttctttttttttcttaaatgacatttaaagctaaaagagaatcacaaagggtaagtctgatttaagacatttcacacatgaaagaaatcctgctttcatgcgtgttatgtcacaggaaaaactcatttagagtcaacattctgcacctactccgaaattttagcctgagggtttaaatattacctcgctgctctctaggactttaatttgagctaattagaaatggaactcatactaaaactagtttaggaaagaagctgttgatgttctgaagaaaaacagctgtcagaaataagatcattaaaaaaccatagttgtatatggcacaaaatgtaaaggaatagaaatgctgggagaaagcttttatagaatgacattttatctttctttggacactggtctaaggcatgtgaaagggcatattgattcccttggcacctggtatgctcatttatggatgaaaaagcccaatgacataatttaggtgaggtttaaggcttgatgggaggcattggtgccattagaaggacggacacaaagagttcttaagtaacggcatcatgggaaatgataattgcacactcctttctactatgtcttggtttccccaagcatttagaagtcatggctaggtaggaacaaatttatcatgagtctgtctgtgtgtttgggaatgcatatgcctcacagatgtgtctgcaggggtctgtgtgataatgttcatatatgtgatagatgtggaccctgggatctgtatctgtgtggaccctgggatctgtacatgtgtgtgagtgacagtggactagggtccactttgcccccttttccgcgtgggagttgaaggaaatgccccttaatggcagtagcatccacttgggtgtgtgcaccttctggaggactgggtgaggttgcccttcttccagccaaacccagaccctatggtgtgggacgttcagcggggagcaacagaatgccatggcttggtcctccctgggctgtggcctggatttcactcaggaatgaaagtcagatattgcctgcttcaatgctgtaaacataactaaggataattatgtaagtagaccatcttttccttgcaaggtagcggtctgctgcattgacagagggtagtatttctaggactttttcagagagtaaaatggtactttaagggataatctgctatctaaagatgaattttaaatgttggagggggttgtgggatttggggaagacaatagaataatttgtgtcatggttaatttaacaaagagtttttgtttatagaatctgatcttcggtggattttaacaaccctcttctttcttggcttttcagataaagatgcagagcctcagagaagttaaatgattgatcctatgtcaggggatagtcaagactcatacctatgccttttaacttcaagttgagtgctttttctttatacaaaagggctttcaaaagttatatttctttttatcaatgactagatcttgaaagccataccttttctgatggcatttatcctgagctaattggtagagagagggtgaacagaagagaagacatagacacgcagagaagaagacgtgaaaacagaggcagagactggagtgatgtgaacacaagctcggaaatatgtggaggcaacagaaactggaagaggcaagggaggatcctcccctagagcctttcgatgaggcagaccctcactgacaccttgattttgaacttctggcctccagaactgtaagggaataaattttaattgcttttagccaccaggtttatggcaatttgttatagcagccttgtgaagctaatacaaactttgtattagattacaaactttgtattcatttcctaggactcccataacaaattaccacatatttggtggtttaaaatcacagaaatttattctctcacagttctggaggccagaagtcaaaatcaaggtatcggcatggccacactctgtagatgctctagggagaatctgctcccgcctcttccagcttctggcagcagaatacattccttggcttcccgggtgtggctgcatcactccaatctttgcatctgtcttcatatctcctcttctttgtgtctattctagtaaggacaaagtgctgcatcttccgtgatggaagtggcccaaattaaccaatctaccaccacgtagctggctgatcatttggggaatggtaccataaggagactcagtgttggcccctgctgctggtagagtaggcactctgcagtggccatagccaggtcagccttggtgagtgaatgtccatgttgttgagcccatgcatagccttcacccctgccatcacggccatggtattacagcattcttgcattgctataaagaaatacctgaggctgggtaatttacaaagaaaagaagtttccttagctcatggttctgaaggctgtacaagcctggtgccagcatctccttggcttctggtgaggcctcaggagcttttacacatggcggatgacaaagtgggagcaggcatatcacacagcaagagtgggagcaagagaacaaaagagaaggtgccacatacttttaaacaagcagatctcatgtaaactcagagcgagaacacacttatcgtcaagggcatggtgctagaccattcatgagggactcgcccccatgatccaaacacctctcactgggccccaccgctaacactgaggattacatttcaatatgagatttggaggagacaaacatctaaaccatatcagccacttggctcatgagcccattggacaatgacaggaatggctgggggaaagccactcattgacatccacagaactggtcatcctattattaaaatcctcctctgcctaggtcaccattttgtgagtgtccataagggacacacatatcttcacaattttccatgtcttaccttagaagccccatcaccctctctttcacatctcctccagtacttatcccccagatgataggaccatgtccagcaatacctcttctctctggtattgatgggttaatgagcagatctcacataggtaaaatttccagatatctagaatttaatcttctggtaattctccaattataactaaagtatttcaggttgaaactttattcaagtgtaattactcactttaaccttcttaaacagaatgtatattaccttttcaaaaataactgaaatttaataagataaaaatgtatctataattgttcctacttaataactttacatgtttatttctgcatttttctaagtccttgccccaaagtggacataattttatactgtaatagcataaaataattttgcatttgacatttttgatttggcattaaactgtcgtttatgtttctttcgctactgcttaagaaaatgtgggtggttgtaataaataaacctgaaatgtaggcaatttttattgccttaaaaacaatagaatgttatttctcactcacaccatagtccaatgaggatgtccctggtgggcaaagactcttgtctaccaaatgggatggggacccagtttccttccctcttgtgactctggcattgcctagagccacatgattacctgtactgaatctgtagaaagagaaataagcagtgtagagatgatatgtttgttttctgatatcctcagcctagaagaaacacacattacttctgttctcattctcatactagtttatcacccattgtccaaatgcaccatgtggccacacctagatgcaagggtgggttggaaaatgtagcccctggctgggcagctgttcctcagcattgactctgtgctatggaagggcttcctaagtttttgtggactgctatcccagtctgtcaccactatacaatcttcataattttccctttaaatggctgagagaaaattttgaacaaaagctacaaacatttttcagattcttgattctccagacttattacttgagggcagtgactaaattatattcagttctatatcagaaggttcttccatattgccagtttcatggtagatactcaataaaataagttgaatgactacataaattttagcaagagcatatggaaaataatttatcatgactttgggtaatactataggtgtaattattgtcctttctctttcctgacttgattaatagcaccactatccattaagttattaaaggtagaaagctgagattattcttgactccttttctcactggtccagtattagttatttattgcagtgtaagaaattaccatgaaacttagtggcttagttggggcttgatgggggctggaggatccactgcaagatggctcagtcacttggctggcaaggtggtgctggctgttagcctcccatctgatcctcctctttccgctcctgccactcttcaaggtattttttccagagcagccgttcatcattcatttattttttcccattaattaattcaacagatatttattgtatacttaccatatgccagatttgttctaggttcttggaatatagcagtgaaaaagaaaacagtccttggatcttatatacagtggggaaataaacatataatgtagaaaattagatggtaatatgtgtgagcacatatatttattatttctcatcatttctatgagacaggagatgggtattctggcttggggactcacatgaggtcacagttacatgttggtattggtttggtcatatgaagtcttggtgggggctggaggatccactgtgagatggctcagtcccttggctggaaagttggtgctggctgttgttggcaggccttgctccctcttcacagggcttcttgagtgtcttcatgacatggcggctggtctctcccaaaataagctgtccaagagagcaggggagaagtgtccatgccatttatggcctcaccatggaagtcacacacaatcacttctgcaatatatactgattacccagatctgcatcgttcagtgtgggaggggaccacaaaaaggcaaaaatgccaaaaggcaaggacgattggggccattttggaggctatttaccacagcccctctcttcaatattccagtccacctgcatattctgttcatcctccttccaaaaatgtatctcaaaccaaatgactaattttcatttctgttggctttagcctagtccaagactctatcaacactcgactcgaagagtctcccatctgatattcctctttctgctcttgccccccttcaaggtatttctcccagagaatccattcatcatactttcattattctccattcattaattcaacaaatatttattgtacgcttaccacatgccagatttattttaagttcttgggatatagcagtgaaaaaaagtccttgggctttacatacagtgggaaaataaataatatggaaaatgttaaaggcaatatatgtgatccagaaaattatagcagggtgaaggaaataggaaacaatagaaaagttagggacttctggccatagtattatatagggctgtcaagggtgctatctctgattagcttacattgaaacagaaacccaaaagacagtagagggcaggtatgttaatatctgggcaagtattctaagcagaggaaaaagaaaatgcaagggccctgaggccggatcatgtttggtatgtttgaggaatagctgttctgttccgttgtggctggaacagaagaaggagggcgggagggcgatggagaatggtacatgatggaggtcagattatgtagggccttgtagactacaatgaagactttggctttgttttgggttggtgagggacaaggaaagctattggaatgttttagtgacttgatgtgacttactttttaataggaccatttgggctgctcagcccatgatgtttaaaaatgcaatcaggtcacttccactgtttaaaacctttcaatggattctggttgtacttagaataaaatctaagctcccttagctattattattatattattattaaaattgacatcctttattctctattatagcagtctaattccttcctaatatgtacctcactagtaactattattattattgcttatttgtttataatctgtctcctctgcttgaaaatatgtagcctggggatcttgtggatttccatactaaatcatcccaaggccactttgcttttgagctgtgtgtgtgtgtgtgtgtgtgtgtgtgtgtgtgtgtgtgtgtgtgtgttttgatctcttctgtatctttttttcccctgatctcgctgattgttatatttggtcagtgacggacctctagcaatgatggtgccagggcaactttgttgttgaactgtatgttaaagtttgttttggcttgtcggttatatcagtacttatcaaatgaattatctgggaagagaggagaggatcttattaaaatacaggttcttattcggtaggccttgggtgggccttgaggttctgcatttctttctttctttctttctttctttctttctttctttctttctttctttctttctttctttctttctctttctttctttctttctctttctttcttttttctttctctttctttctttttttctttctttctctctctttctttctttctttttctttcttctttctttctttccctcagacagagtctcactctgtagcccaggctggagtgcagtggcgccatcttagctcactgcaacctctgcctcccaggttcaagcaattctcccacctcagcccccggagtagctgggactacaggcgtgcaccaccatgctcagctaatttttgtatttttagtagaaatagggtttcaccactttggccaggctggtctcgaactctggacctcaagtgatctgcccacctcagcctcccaaagtgctgggatttcaggtggagccaccacgcccagctgaggttctgcatttctatcaagcttgcaggtgatgcccatgttgccagccctttgagtaacaagggggctttattactgagcttggctgaacattggaatcatctgtggagctttaaaactactaatgctgggctctcaaccccagagattgcaatataatcagtctagaatacagtttgagtactagggttttaaaaagcttcgtaagtgattctattttgtagaaatattgagaactactagattggatgatattgaatccaattttaaaacaaggtgtagcaataaatgttcttcagcgctgtgttgctgactttttagaaagtcagttttgtagctctggaaagaatctggctgcatccatgaatgacctccagatctctgcttagcatgactgggtaatttctccaatgtctccagcacatgctgtcacttaacagcagaaagagaattcctactttcaggagaaaagtcattcctgaagattacagttaaaatatgcccacaggtgatgaggttgtactaaatcagtccccttgctctctgagcttgttctaagttacaggaagcagaagaagcagagaagcactccatttcttttttcttgtaatctctagcatgtccacatgcatagtttctgagtcagtagcaaactaagaacttcttgtgtgattcaagctaacccctcgattatcagaagcagatgtttcaaactactgaagatcaatgaggcatatcctatttacaggttaataattgactactagatgcaggtgcaccaaatggtcttagagacattagataggagagacaatgtcagtgctccccctaccctgcctcccctaatctaaagcctactctgtttcttttatcaagttattggctgtatgttaacagagcctggggcactttcctgttgaaatggctttaatcccaaggaactggattgatttttttttttggatggtttagattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggaggtatgtggttcagcatatgccttaataattacgatttctttcctcttatattattatagtctcacagtgactctttgatgatagacaagcaaggtgcagaggacctagctcagaaaaattcagtgaggtgcccaaagagatccaacaaagaagtggcatgatgggctcatgaacccatttgggtggtctcttggtcccctgtactcttcagcataaactattgaatagttgatgcttatctgatatggaaggactctgaattttaacattaaaacataccctgaaggtcgttgtctaaatgaaaatgaccctcattttacacatgaacaaatcaaaggcctgagaggctgagttactgctgaaggccacagggttgatcagggtcagattaatgatttttagcccaaatcctggcctctctttttcctacagtgttgactttctctcaaaatcatagaattgtttcactttttcttatattcacagcaatctatagtttgggggtccttagtggagggggtgggatatatgtatggagtaaatttcttttaaaattgaacacacaaaaaaatagggagaataagaaatagataacatgtacccattatcttgtttttctattttgcttatctttttttctgaagaattttaaagcaaattatagcacgagaacatttcacacccaaatatttttgtatgcatctctaaaaaagaaagacacattgctgcatgactgtgctaacatacctaacaataataacattaattctccaatatcacctgaaaactaatctatagtcaaatttttcaataatccccaaaatattattatttatagctgttttattcaaatcaggatacatctaaggatgccatgcatttgcttggcaagtctcttaaatctcttttaatctagaacactgagtttgcatgaatgtgggtaggagccaaattttaaccagcaacagttaccattataaattattcctcatcccaggcaaagcagtgcagtctgaagggaaaacttattatctatccctccttgcagacgttttacacgttatccaaacaagaaagtgtattcatgttgaatatttaaaaaacaatattgtaaccacaaagcagaaaactaaaccaccaaactacaaaggtagacaacaatagaggaagaagagaacaaattatctacaaagtaaccagaaaacaattagcaaaatggcaggagtaagtcttttactatcaataataaccttgctggtacatgggttaaactctccaatcaaaagatacagaatggctgagtggatcaacaacaagatccaactagatgctgcctacaagagacccatttttaaactttaagaataggcatatattgaaagtaaagggatagaaggagatatgccatgaaaacagttaccaaaagagagcagggatgcctatacttatatcagataaaacagacttccagtaaaaagctgttccaagagacaaagaaggtcatgatttaatgataaagaggtcatcttatcaagaggacataacaattgtaaacatatatgcatccaacattgaagcacttaaatatgtaaagcaaatattagtggacatgaaggaagaaatatacagcaatataacactaataggggacttcagtactccacttgcaacaatggagagatcaaccagacaaaaaattaacaagacaacactaaatttgaactatacttcagaccaaatggacctaccaaacctacattcatccaacaacagcagaatatacattcttctctagcatacatagaacattctccaggatagaccatatgttaggccacaaaataaaccttaacaaattcaaaaagattgaaatcatgtctagtattgtttccaaccacaatggtgtgaagctaaaaatcaataacaagaggaatcttggaaaatttacaaatatgtggaaattaaacaacatgcttatgatgaactaatgggtcaaagaagaaatcaacagggaaattaaaaaatactttgagattaatgacaatggaaacacaatgtatcaaaacctacagtatgcggcaaagtcagttctaagagagaagtttatagcaataaatgcctacattaaaaaaggaaaaagatctaaataagtagactaacattatgccccaaggagctaaagaaagaacaaactaaacccaaagtgagcaaaaggaaggaaataatgaagatcagaacagaagcaaataaaatgtagtatagaaaaactatagaaaatataaataaaatcaaaagttggttctttgaaaaaataaaatctacaaactcttagctagattcactaaaaaaagcagactcaaataaataaaatcagaaatgaaagtggagacattgcaatagatacctcagaaataaaaatggtcataagggattattatgaacaattttatgccaacaaattggaggacctagaagaaatggataaatttctagaaaaactaacccaacaagattgaattgggaagaaacaaaaagtttgaacactccaacaacaaataaagaaattgaagaagtgattaaaaactttccaaaatagaaaagcctaggaccaaacggcttcatggctgaattttatcaaacattcaaagaataattattaccaacacttcttagactcttccaaaaattagagctacagggaatacttccaaacacattttgttaggccagcatcaccttgatacctaaagccagacaaacatattgtaagaaaataaaaccacaggccaatatctctgataaatattgacgaaaaccaaattcaacaacacattaaagaaattatgaatcatggccaagtgggatttatccctgacatgcaagactggctaaacagaatgaaagataaaaaccacatgatcatctcaactggtgcaggaaaggcattttagaaagttcagcattctttcttaacaaaaactcttaacactttaggtatagaaggaaagtttctcaacataataaaggtcgtttataagaaacccacagctaacatcataatcaattggggacaactgaaaacttttccacaatttagtacatggcagggatgcccactcttgctatttctattcaacatagttttggaagtactagcaagagcaatcagacaagaaaaataaataaaagtcatccaaattggaaaggagaaagtaaaataatctctatttacagatgatatgatcctatatatagagaattctaaagattctacacatgcacacacacacacacacacaaacacacacacaaatttttagaactaataaatgaattcagtaaattgcaggatacaaaatcaacatacaaacatcagtagcatttctatacataaataatgacccagctgaaaataatcaagaaaacaatgccatttatgatagcatcaaaaaaatacttaggaataaatttaaccaaggggtgaaagtatactgaaaactataaaacattgattgaataagacacaaataaatagatatcctgtgctcactgatcatggatcaaaaacattaatattattaaaacattcatactaccaaaaacaatatacagatttaacacaacccctatcaaaatttcaataacattcttcatggaaatagaaaagcaatactaaaatttgtttggagcccccaaaaaccaaagcaatgttgaggaaaaaaaagttggaggtaccacacttgctgatttaaaattatattacaaagctaaagtaaaaccaaaacagtatgatactggcataaaaacagaaacatagaccaagggaacagaatagagagcccagaaataaatcaaggcatatatagtcaagtaattttggaccagggcaccaagaggacataatggagaaagaaaaaaacctcttcaataaatggtgcctgggaaaacaaaaatgtaaaagaatgaaattggacccttatcttacactatacacagaaataaaatgaataaagaactaaatataagatctgaaaccataaaaatcctagaagagaacatagggaaaaagttatttgacattggccttggcaatgatttcttggatatcacatcaaaagctcaggctacaaaagcaaaaacaaataaatgggactacctcaaactaaaaagctttttagcttttccatttttcatttatttattttatgcactttaaaatctctgggtattcttttttagcatcttaaaatttatttttatatgagtgcctgtagatttgccgtatcctttaaaaaacaattattttaatatatattataattgtacatatttttggtgtgcatatggtgaaagtcattggagtggaagatatcagggagcttggaaattgaaaaggaattcagaagttgttgatgaactctgaagttatcagcatggatggttgaatggcatcatagacaactatctagagagacagtactttctttacttttggaaatcagtgtgctttggcattaaaactcagggacttgaaaatgatggacacagccaaagaatatagtatggtgcctggggtgtagggagtggagggagatattcatgcattctataatctggcaagcataaaataatgcaaaaacgaaacaagactacctattctttaagttttgtgaagggtaaaaaatggtaaggagtgaagaaaagggctatgtttatttctttgaggacttcacttttcccacacaacaagaaaattgttggtaaaatcttctgggctgtcttctctcccacttactagaataggactattgctattcttttttatgagcatgtattggaatacggtgatggtgctacactctaaggcagcgttgtccaacagaaaaatattgtgagtcacatacatactttacatttttagtagccacattaaaaaagtgaaaagaaacaagtgaaattcacattgtgttttatttaaactactatatctaaaatattattataccatgtcatcaatataaaaattattaatgcaatcgattgcattttctactaactcttcaaaatttggtgtgcatttacaattgcagcacacctcaacttgactagccacattttaagtgctcaacagctaaatgtgacaagtaactattgtattggacaatgcagttctaaggattgagatattttaaaaatcaagaaacaatttttgttcagtagaaagttacagtatagttgacaagtaagattcatacagaaagctatctatacatctagcgatcatttatactttagatctttcaatctacttatttgtttctcaaccttgttgcaaaaaaaaaaaaaatctgaaatggcttgcattaagatatacaaggtaaaaaaaaaaaaaaaaaaaaagcaaaaccccaaaaggtgaacaagtattgatttcatgttcaatttatttaaagtctaatactacttgtcaatttggtcttccgaggaaatgcatcacatatttttagttgagcttcattttggaagtgactagagattgtgagttggggaaaataattaacttaccctgctaagctcacacatcaattaggtagcagagctgggaatagaaagcatagtctcctcttctagatgcactggggaagctgcatgtaaatctggaatccctcacttctgtcaaatgcatatcctgtttgtgtctcataacctgaataaagctgattacgtaaccaggtttccctggcaggtgtgaaactatttttaggaaagatgtgtcattgcttagaagtggattaaaacaaacaaacaaacatatgggttgttagtctacatagaacaggtgaggctgatcaaatttcccccatagtggatgagtacagtataagaaatatcaaggctaattgaactgtgaaccattgatcattgtttagagaacaaatgaatctttttctgcctggtggaggaggatggtaacatttcactgcttgaaactcacgagactttcaaaaacatgtatttttggtgttcacattttaggtcctgcacccgatgttgtctcagacaaaatctaccaaatcagcaaaacgattgaggaatatgctatatgtcctgatctccgaatcgacctatctcgactaggaagacaagaatttgacctagaaaacaaattcaaaccattcagaggtaacagagattttattttgaagaagtcagagtaactatgtggatggggctgactggtttctgtagggaagtaaactcatgaaaattattgcattgttaatctcaggggtgactcgataaatgtgtgtaaacttaatatggtgtagagagaagacatgagagcagccaagatattcagaactggaaactttcaaaaaccacttcccaaactcgatatcattttcaacataggaaaagttttatggttgacttcattatagcattccaaaaataggctgtgaattgccaaaacttgtctaagcaattaaggtgaagatgctggaatgccttagttaagaagaaacctaacaagtcaatgggttattaaatttctcatgaaaggtaggagtttcttttccaagccataaccaagcttggaataattatgcatcagcttattgaatgcataattattgatcacctgccctataccaagcaccgtgttaggagattttacaaaggaattcagtaactatcaaatatatttaggcaagtgattcaaaaattaaagaaccaaaatgagattgtcaaaaatattatcttatattgtaaagcaaatataacttctacagtattcagaagatagctttttgttttatagattaattttagaccatatgacaacaacattaataacatgtatgtatacattttccccctgtattttatcatattgctttttcctagaaggcatagaatagcaatagatctaacatgttttacttttttagtgcttctataagcttgaatgcagtttgtgttaagatggtatcctcattttagaagtaatttaacttagcccaaaagaggaaatacctggtttgtgtccatgtgatattttagggatagagaaaagattaaaatggattgtgtggggggtcacagtatttgcccaatgttaccaaatctttcttgagaagttttgagtcagttgtttgcttaggtaatgagcagaaatttacagagagccatgatactcactggaagcaacagtgcctgcttttgctaatctagctgggagaatgcataggcatatgtgtgcacatgcatgggatggctggacaattaaaggcaaggggtacattatattaagcaaaatgatttcaatatgctgattacatatggttggaaggactaggcttatttttggcatcttcacaatttttatagttgtccgagagacccgaatcttcgtgggctctcattcaggctcattgctgcagccacattgctagttgaatgagttttctaaaaatgttactgataccaggagataggtagagagattccctggcttccaagaatttggagataatcgtttgggataatttatgtgctgtattcttgctggttcaagtgttgagcaaagcttgagttaattaggaacaaataattcctttgcatttcactttaaagtgtcaagagcatgaactatatgatgtgaactttcaatttttactgacttcttgttccctcgtttttcacatttgtttggtactgtgtgttacctattgtaaataccaaatgtatttaggcaagtggttcaagaattgaagagccagaatgaaattgtcaaaaacattatcctataatgtagagtgagtaaaacttccaaagtactcagggcataaccttttgtcttacagattaatttttttatggtggtaaaatatacataacaaaatttaccattttaaccattgttaggtgtacactttatacaggttaatttttaattacttcatagattattatgctcctcatgtaaaaagataatttaaaagtatccatgttacaaatataattatatttgaatgaacacataaattacattgacttaagtgtaagaaaaaatatttttagatatgtatttgatcagatgaaggaataatattatatggcatattaagatctcatccattaaatatcacacctggatttactaaaaattattgaaagtgggttggtaatatcttcagtgcaagtttaaaagtatttcagggtttcaaagtagtatgtatttgaaaaatctgaaaacaatatacgtaagtttcaaaatttagctatgaatttaaaaaagcagggctcctggacaaattttagcacctaaagaattgatttactacttcttggaaaagtactttctgagcattaattatacactgattgacaagtatgaaaaatgtattctgagctttttggtatgtcacataaatgaataaaactttttggattattggttactgggtggtgctagatactggaaagcatttgtgtttaatgagaacttctagatatttgccattcatttggaaattgggtgctagattgggcatgaatgagatttcacgcaaacccaggaatatattcatcaccaattctgcactcgaatctggtaggcacaatggcttttggaaaataggggtcactactgaggtcacttgctgatttgtttcataccagctgagtcagtctttggccagcccccacaagaaaggcaactggatatgccaaaatgcctctaaacattgagatgtgtgctgtgtgcatttttttgggagggaaagtgggagcaggagtaacagggcacatttttatcttaatttattcttgtggttgatattttccttgcaaagaagaatttataacttggtatcatttatacccattgagcacctgaaaagcttgtagtatcttgattgtgccctgatttgtgatttttgtcaacaaatgggcacttcgcttcccacatcatgtgcagggatatgatgggcttgtgaccagaatttcatgctcttaaggtagtgattctttttatgcttccaagtatctttcatgggtacagtcaatgacattttcctttgtttttctatctttagtggagatagtggacccagtggatatctatcttaacctccttcggaccatctttgactttcatgccatcaagggtttgctgactggacccagccaactgaagattcgcattgacgcaatgcacggaggtaagcttgtgattttctccaaatcagtgggcaggaaatattgagacctgtacacctgttgggtttcagaggttaagaggaaagttggattcatagatattcacacaacatgtgtatgttcagatatttggaatgctctggaaaacttcaggacccttatttctgtctttggatgtaaatgaaaacaaaagttgaacaaatgagtttgaggctatgcatgttcaagtgtggagtatagtaaaactgttatttatttgatcatatgcatggcatagtttaaacagtcaaataaatagttcaagatttattgtgaaaacaatctgtacccaactcctatcttcccccaatttgttaccttccagagttaaatttttccattttttcagctgtttcttttttgtatttatctccctatcattaaatattatgaatatacagacccttgttggtttttcagttttgagcattactgaattcatactacaggaactggagctgcagctctttttcaccctctccacccaccacccacctctccacccaccctttccacccaccagttagggaatcctagcatgcttccctaattatatcaccagtttggtaagatcattatctagtgtttacattaccacaacactgctgagccatgcaatatgctataattatatttcctttacagtacaactttttgatttccttggaaacagcaattatcttgttttctcattgcttgcttttaatcaagtatgtttaccactcttaatcctcaagctctccgctagtgtctaaatcttccttcacttcattttcctggagactttgatctgccccactctgccctggttgctctctgagcatgctgtcatcatgaaatctccctttatcaccatggtagtaattctttttacacatctcttatgttaaatgtcctgttccctggtttctttgtctgacaccttgatttactcgtacattttggaggaacacattctccaggaactcagtgagagaaagctcatggtaggtaaatattttgtgtattgtatatctgaaaaggccttttattctacacttgcccttgattaatatttgactgatatggaaatctaagttggatattatttttcttcagaagtttgagggcattgctctactgtgttatagctattatattaaacttgagaaatccagtgctattttgatttttaatccattgtctttcctttttcttctctggaagcttttaggacctttgacttatcttcagtgttcctctgtttttcaataatggatcttagtgtgggactctatctttattatattggacacctgatggaccctttcagtctgaacacttgtgtcctttaattctggaaaagtttttgaattactatttagtaaccattctggttatttttactactgaattgatcctttaattattctatttccccttctcctccccagtttttcatctctttattttgttctactttctgggaaatttccttgactttatcttccagtcctttagttctaccattatatttttaatttcccaaaacttttgtttgtattttccaaagattctctcttgtaaaaacgcatcctagttatgtttcatggataccatatctttttaaacttaggtttactgaggtataatttatacacagtaaaactcactcctggtaggtatacagtttgataagatttgaccaacatatacagtcatgtaaccactatcacaatcaagactgaatatttccatcaccccaaagagcttttggcagccctttgtagtcaaacctctccccttatccccagcccctggcaaccactcatctgctttctgcccccatagttttgcattttccagaaagttatgtaaatggaagcatacaatatgtcaccttttgcttcaagcttctttcactcagcataataatttcgatatacattcctggtgttgcatgtatcagtagttgttccttttactgctgagtacaattttattgtgttgtcgatataccacaatttgtttatccattaactggttaatgaaaattagatttctttttcttctagttgttggctattataaagaaagatactgtgaacattcgtgaacaagtctgtatgttttcatttgtcttgggtaaacagctaggaatgggattgctgagtcatatgatacgtgtatgtttacctttataagaaacggccaaatcattttccaaaatgcctgttccatttgcaccactggcaatgcatgagggctccagtttacctgtatcttcaccaatacttggtactgtcagtcttttccattttagccattctactctatcttgttaatctctattaggatattactgatatattttaaaaagttttcttttccctgtataatttttgtttcctccaggtttctctttactttttgtttattttcacctcatctcaaatacattcctcaaaattttggtgatccttggctttctggcatatttaagaatgaggcactaaaaatctgctgggagctctgagcctgctatgggtcttctccatgggccttactctaagggcttctggctaggctgttctgttctttcttgttgggctgatcatattcctcaggaaaagaactttcaggttcttgccttagcattatctggcctacagggaagacagctttgctttttttccaaatagtatgagcaatgtttctgggtttcagcctcattgcctggtttatattgtatgtccatctttgaatcaattgctctggctagaagatggaggacgctgattgcgcagacataggtcacctccttagccttggggaggtgggatttagccatacccagaccccatgaactgagatggggaagagagtttttctccaaacaaatcccaaatgctgtatccagaggaagaggaaatgtgtgctgggcaggcacaatcaagagatgttcactattggaggattgtgtgttgtattggtggaaaataagtggaaagcaatatctttcagatatttcagctaggaggattacatgctgttccacagatgtgccttatgttctacctcaggctctgttcccttgctcataatgttccttcgatttagatgggcttcccactctaaacccaaacacttgccaactttatattattccgtcaagttccaccagaaatgctgcttcttccttgaagccttatgtgtggttattgcttctctgaagccattggatataattatttcatcaatgtgcattgtttagtcttaccactgcagtcattcatttgcagctttgactcatcccactactagattacaagcccaggaatgtagaaactatgtgctttgcatcccttcaatatgatcccttcatttcctagcagagcagctccatattgcatactccataatgttcattgaactggaaaatactattccttggcatgtattttggtaaaatgtgcttgtttttatatgcttcagtggtttatagtgtttaattatatacttggcagagtccaaatgattgcagagacaaagaacattgctagagccctttaatgcttttgcatatattcagctaaaacttttaatacatgaaaagcaacagacaatgaatcattattatgtagctgatttctttctggcaaccttttagaaaaatttcaggtgaaaaaatttatggaactagatgactgaatacatcttctgtattcctaccacagtaactggcacatagtagatgctcaataaatagtagttcaagcaaatattgttctatattgtatctttaaaacgattgtaaatttatgtttttcttctgggttattaaatggtgtttcctgtactattcagaacaaaatactctggggagaaggttctgcaaatatttaatattgctgtgtatctatttttagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttggagctgcatttgatgctgatggggtaagtaggaaagctgtctgtctgctgaccctttgatcatataatgagccatgcactggaaagcagagaattaatgaacacatctggagctaacatgtatgggacatgtgtgccctaactggctctgcatctgcccttctgtttaatgactaagtattgcaattaaatagcgattacttttcttagttccagatttacgttatggcatacaaaggttgtttatttaaaaatatatattattccataaacctttatttatggctggtgttgttgaaagcaccaagttaagaaatcagctatttctgcaagaaccagtgttctctattatgtttgggagaaagaaagagttaggtatttggggacttctaaagcttgagccacatttcaacaggtggaacatattcctggtgtgtcaagattctgggcccttggtactcagagatttcgaagaatgtttcccatgttctctttggcctcattcaagttgttagattgttaaatataagatggcagtaaagtggattgtgatgattatgggaatgggctgctagcagatgcttctgtccgatcatttttacgcattccttcctacaggaccgttatatgatcctaggccaaaatggcttctttgtgagcccttctgactccctggccatcattgctgccaacctctcttgcattccatatttccgtcagatgggggtccgcgggtttgggaggagtatgccaaccagcatggccctggacaggtaagcaaggatgtcaccgtgaaaaactttatggtagacctttggcgttgatgtctcctttgttggttgctggcgcttattctcccctgctccatttgggaatgcgttgaaagcatgggaacacggtatagtgtactgggtagaagctggagaatcaggtggcctgagcttaattcttggttctgccacttactagctgtgggaatttagacttatttagtctctgtgcctcagttttcttatctgtaaaatgtggataataatagtggtatctttatatggattgtcatgaagtacaaatgaggtgcttcatgtagaacatttaacatggtgcctggtacatagtaaatactacataaatgtttagcaacagaacttattaacctgaaagtgtgtatgtataagtgagggaaaaaaagcatgggttttgaggtcagattatattatgttcaaatgctaacttatagccttattagcactgtacaaatagaaaaatgatacttcataggtttattgtaagaatgaaacgagacagtgcatggaaaatacccaacaagagattcactcagtagggctctaactaaccctattaggtttcattcttcttgctctatccatccctcttgtctatcaccctatattataaaacattgaatttcagagtctgacatgttcaaccagcacgtgttattatagaaacagtgtatgtgcctggtggaaagttagaaaacacaaataagagaatgtaaatatcatatcccctaccttgggttacctatgttaatagaaaaacttatattccttactgtatctctttctatacatatacattatatgcatataattaaaatacataatataatatacataatatatatacatatataatttatttgcctgtgataataccaaagacatcaaaaagcacattgcttgtaacctgctttttcttttccatcaacaattgccaactaccaattaataaattttggccgggcgtggcgactcacacctgtaatcctagagctttgagtggctgaggtgggaggatcacttgaggccaggaattcaagaccagcctggataatagagcaaaaccctgtctctacaaaaaattttctttaatcaaccaggtgtagtggcatgttcctgtagtcccacaccaaatgttgattaggataggaagcaaccagaactttcatacattgcaaacaaaagtgtagaatggaagacagtttggcagtttcttgtaaaatggagcctacagctgaccaacattccattcctaaatatttacccaaaaataatggagatgtgtccacaaaagacctgtataataatatacatagttgcatgattcataatggctaataactggaaacaatacaaatgtccatcaacaggagattgcaaaaataaattgtgatatatttatatatttgtatactacacaataacaagaaggaatgaaatactgacacatgcagtgggtatggatgaataaaaaaatattaaatgataaaaagccagtaacaaacaaatacataatatataattccatttctgtgaagtttcagaacaggtaaacatatatgtggcaatagaaattattacaatgttactgtatgaggggtaggaagaaggcaccgggaaacattctgaggtgacgggaatgttctgtgtcttaatctgggtggtggttacatggatgtacacacttttcaaaactcattgaattgtacccataagatgcatttcactgtatataaattttaccttatgaatgaatcaacaccatgaaaaaatagccacaaaatccagaagatgagattctatgggacaaattagctaggtatgatgacgcatgcctgtaatcccagctacttgggaggctgaggcagaaaaatcgcttgaacccaggagacagaggttgcagtgagccgataccatgccattgcactccagcctgggcaacaagagaacaagagtgaaactctgtctcaacaacaacaacaaaaaaatactgaagggccataacacgtggttctaaatgagatactacattgggcaaaccattcaaaaaagacattctggagacactgagggaaaatttcagtatgatcttagtttcagatgacataaaaattatttatttgtttattttagagaaagggtctcactctgttgcccaggctggagtgcagtggtacgatcatagttcactgtaaccttcaactgctgggctcaagcaatcctcccaactcagcctcctgagtagctaggactacacatgcgccatcatacccagttaattttaaaaacattttttgtagaaatgagatcttgctatgttgcctaggctggtatcaaattcctggcctgaagtgatccccctgcttcagcctcccaaagtgctgggattatgggtatgagccactgaacctggctacttttaatcttcttattagtatcttttaatgggcagaagttttaaattttgatgaagtccagtttatttttcttataattaatggattatatgattattatatatgtctttgtcaactacaagaaatttttgcttcctccaaggtcagagagatattttctccatattttcttctagagtcattgcagtttcaacttttacacttatgtctagaatgattttgaattaatttttgagcacggtataaggtaggggtcgaggttcacttatttcccttatccagtttttccaatcccatttttaaaaaagaattttctttcccctgaatagccttggcaccattattaaaaatctgttgaccatatatatgtagatctctttcagcattctctattctataccactgatccatttgttgattcgtatgtaaatattacactgaaattaggtgagcttcccaatatgtttttcttctttgtcaaattaaagggaaattatatattctaggtcccctgcattttatttcattttagaaccaacatctcaatttctaccaaagcctactgggattttgattgggattatgttgaatctatagagccatttggggagaatagtattttaataatcttgaatcttccattccatgaatgtggtatatctctctatttaggttttctttaatttctcttacatgtatttcataatttttaatgtagagatcttatacaatttttgttaaatttatttctgagtattttctttattttgacgctattatgaatgttttatgaatttaattttccaattatttgctgctggtgcttttttgtaaattgaccttgtattcttcactagaggggagaagaatcacctaccttttggatgcctcccactctacttgtctccctgaggtgatatggaccttaagtccacgatggtgaactaaactcagtttaaaattcttgcctagcagcaccaaagagtggtatgtgattccatgttttctcccatttacctttgcctacacccttcctttaaaaaaaaaaaagactccgtagaattgtagggaacaaagcaaaaatgggaccatttctagaaattgagaactcagagtcatataggatcctgagtgatatgtagggtatttaataatatgggagtatatttaacccttccacttatacagaatcttataatttagaaataatttgtaacatatcaactcacttgatctttgcaataattttatgaggtaattgaggtaggtattactctcctcatattaaagatgttgaaccaatgatcagagagcttaagtgacttgtacaaggtcacacagtgaattagaaattgactcaggatttgaaactaggtcttctgataatagggtactactgtatctgcccaataattataattggatcaaaagggtccctgataaaccagttgagaatattgtcccctgtgggctagcaaataactttccaaaccatggctaggggaggctggttttattctgacaacaaaaaccatttgtccttgtttcttgtggaaatttcccagtagttcttgatttcactttacccctccttctcaataaatctctgtttcagtcagaaaccagaggccttgcttagaaatttcacaaaggacctgttctgatatgtaagtgaccatttaaaaggattattcatgcttgctggttgggaatcagaattctgtggggctctgacttggtgatttgttctgggtatttgatctgttgtgtaggtcccaggtggattctcatgatggacactttataagcttctttcttcctaggtaaaatcaatgcagcttcaaaatttcgaccttgacagtggtttcccatatagcttattttttctttaattagtaaaattataggaatgtgcccataaatgccaggccctggaataataacaactgaggacacagttgagatccattaaatgacacacttgcctaaactcctgggattccagaataaggggaggcctgtacccttgaggctgatgaattattcagacaaactttcattgttcacagataattgtggctccccaagggaagattttcagtgtctttaatttctactcttacagtgtcactaaaacaaggattccatttagcccagaataatacagtttcagccttgaaaatggcattcttttggggctttgtcattctgaatgtgtctgatttgtggttgcagatgaatctgtgttgctgaaacattttggttcaaatgatttcagaagtaaaacacattgaaagtatgtttgtggcctgaggtccgtctccaccccatgtagaggtattaaataatcttttgtgtcatcatccttccataatatttatgaagcacccatctgtgcttggggctgtgccgaattctgtgcaaaacaaggcaaacacacacagcctgaagccctattcactagacatatttacagtctcaaacatggctagcatccttgaatacatcccaagaagccagatctaaaaagtatgttttgactatgaaaaaggccatccaagatccatcacccataaacagggtggtgaatggattagtgctcatctaccctctatttgctcttatgccacccctatggttcaccatttatccactcaagaaatatttattaaggacctcctatgtcctagacatggtccccgtggcagtgctttcagtctaatgcggaagacaaagaataacaagtaagggaaacatacagaaacacaaattgtaacacaggctagtggaaatgaacttggtgcagtactcattggtgggcatcgagcatcttgcttagataggagatccagggaaggactcttggaggagattaggcataggaccaaagatcagaaacaggtatctggacctgactgtgatgctgggattagaaatgacacccacacatgtgaaaacacttattcctcagaaggtagtctacagctatttgttgccaatccccaatctaaaatatgtactatagctttatcttgaacatactcagctgatcgttggaatccagacagtgttaatcctgcaagtatgcaagtatctactgatctctggtgatctcgattcttaccacgtcctttagatctgtgctgtttcatctcccagatcagtcatgatggatgacagtggtggaagagatagtgatgtgagcttatatgtaattactcagtctcccatacattgcttctgctatagaatgatgggaattattttgctttagcagataaatatgttcaaatgtaacctatattaacataaaagaaaaaaagaagaaagccctttatcctgtaagtttttgccctgaaactctgtatagctgattctgttaggatcaaggcaggaaagagatggcaccctcaaaaaggtcttactaaagagaatttagtaattgtaacttaataacctggtctaaggaacggatgaggttaaggaaaccaaaaaacacaagaaggaatggggaggtaccttagcatcagcaatagcaggaagctgttaacacccctaggactaagaagggtccaggggagaggtcagggtgaccacagcctagtgaggtctggagttgtgaaaagtgggctgtcagacaagagctgaacttggcaggggggagaaatgccccaacttgtctcttctcaccctccaacctcctgctggtgcctcctataaccaaactgcactggaagccagagggcagcctatggagttctgcctcctggggaagagaacagggcatttgatgaagtggggactttggggtagaaggggacaaaaagccaccagcataaatggcacaatggcccatctttttgcttatttctacttgcttatctcctagtctcaccctcttccctcttttttggacctcaggcatagagagttgagttaatcatactcatcgttgaacaatcctttaataattggtctgattgaaggctcatttcttattactttaaaaatgataatgcatttcttttctctctgtttgactgccccaccatagacaaccacaaaaaatgtgtttattgggtattgtgtatatattttttgcatatatttttacttaatgtgactagtactatataagagattgtatttgatttcttacctttttttccactaaagaccacactttaagatcctcttgatggctgtacatccatctaggttgttgcttcaaactgctgcttatttgtccatgagtgcatccatgatattttgcccttgattccctcagcaatgaacactcagactgcttctcacttcctatcacagtgaatactgctgcacaggcaccctgtggatatgtgtgagaatctcttcaacacgtgtattcagaagcagaattattgggccagagggggtgtctatacttaatttagtcaattttaaccaaatactgtcagattgcactccagaatgcccatctcttgcctgcttctccaaccagtctctaaattcctgcatcttcaaatccaggccaacacttcatgttgtctaactttctaatttttatccagtagactagatagagagtaacataccattgcaattttaatttttcatgtctcacattactaatgagcttaagcatctcttcatatgcttgagaaatttgggagtttccttttctattaattgcctattcctgtcctttgaccatttttttttttctatttagggttcttctttttagtctgatgaatttgcggaagttccttggatgatctagataccagacccgttgtcagttttaggcacttctaattttcatcttttatctttagacaaaattttactcctgagttcgatagccaaattgttatcagtagacagatctgttatagacaactcaaatttaacatgtataaatagcaacttttctaatttttcctgaaaattgtttttcctgtgtttagtctctgcatgagtcacctattatctaaataataaaccttggaataatccctcattccagatgtaccactaatcactgggttttgttagaaggatcccttaaatgtttttaaattgttatttcttctccattcctacatttccttttctactttatgttctcattatcttttgcttggactattgtaatagtcaataaactgttcccacttcctctagacttcctcttcttcatttcctcttctgtactgtcccaagggcagttgttctaaagcagaaagtcacgcattttcttcccttgtttaaaatgggttagtgggctttgaatgcctgcaggagattccgtctcctgattatacaacatgcacaatctcctgattatagaacacgcataatctcctgattatgaacacttcactcctgcagacattcttatcctgcactctaaacatgtcatgctgcttacagtttcccaaatttgatgccctcacatttctgtgcctttgcatgcacttctgtccctgaaatgtattccctttgccccacctcattccactttgttcttctttatcttttatggcttgagtcaagcatccccttctcagtaagtcctttgataccatgttccctccaccccaacagatatttcaaaaagttaactactatgagctatcaacatgcttcttttgacttttttacaaagagacatctggtgatactatctgttgattgcaaagaaaaatatacctgactaataagaagaaaatgaatggtgcataatgacccaatctcctttggatataataaaactatgcctgatttgtggttttcgtttacatttaggtgagtttgtaatgagttggatttttagtaatgatatgtgggtactgacgctcttagcaaatacagcttaatcaatgtgagatgaaaggaagcaactgcattgtagttatttcctagtcgataatgaactccccacagcctgaacttaagcgcaaggttgtttattccttgccctggcaaattgaatgaggactggattcattaccaaggcatttacaagacgcataaggtggccttcctttatggtttgtgtgttgacctactggaaaggatgctgagactggttcaagtctgtaattgtgtgtttctaagagttggtgtctaatgggaaagtgatctcaggcctgtagttggtaaaaagcatttatgtattaaactggctagagtgagaggaataaattgttaacacttaagactataaactgtaggagatttggagatagtggttaaatcctcttggaaatgctggatgcatcatcttttattcaatttttctgagccatcttgggtttctgctatctgagttagtcagaaaaacacttagatgaatgttaagtaacccaagtgctaaaatatatagtcgtcatcactctcccatgagaactgaaagacgaaccttttttggaagtcagctctcttttatctgctgtatttgtgaggactctttgatactcagattctgtctcgggaagggcattgtcgttatttagggtgtccagcagcctattttcagccctcccaacgatgtggcccttcttggtctaaacaagtcactttgaccagtggtggatggatccaatactgaaagaagctccttagaatcgccctgtctgattagggattcaaggctactttaaactggggtttcaatgccatccagtctcagtgccacccagtctcgaacatgtggcgtgctgttgttctccaacgggaacattaacttcatggcctgcctttgtaatctcaattttggtcttccgaggctacatttggttaaataacctctctcttttattccttgtgacttaaaatacttattcaatttaaaaatcaatcccattgattactgcaaagaggcatgaggtatatgttttgagctgataaaaatgttccatatcttgattacagtggtagttacacagctatatatatatatgtgtgtgtgtgtgtgtgtgtgtgtgtgtgtgtgtgtgtgtatatatttgtcaaggctcatgaaactgtacacttagaagtgatgaattttggctgggcgcggtggctcacgcctgtaatcccagcactttgggaggctgaggcaggaggatcacttgaggtcaggagttcaagaccagcctggctaacatggcgaagcccctgtctctactaaaaatgcaaaaattagctgggtgtggtggcgcaggcttgtaatcccagctacttgggaggctgaggcatgagaatcgcttaaacctgggaggcagagcttgcagtgagctgagatcctgccactgcactccagcctgggtgacagagtgagactccttctcaaaaaaataaaaaaagaagtaatgaattttattttatataaactataccttgataaaggtgataaaaataatcaaactctatttatttaaaaataaaacaaagcatctctcttggaacttcttttctgactaggggcaagaatcattgctctctttgaatgactctagttcccagcatagaggtttgtatttactagaccaccaataaacattggttaggttcaggtgagttgaattgtctctggaatcactgtttactgctttcctttttgtttgaaccaggacataaatatatagcctgcaatcttgtctttggaaaagacataacttacagagttggaggttttcagatatcagtcatcagtcaaatttattggtgatataaaagatataaggaaggtagtttagcccagcctaactctcaatcatatgctttgtgaagccaccagagaagtttggtgcttgacaacgttttaaaatgaaggaggataatgttaagtcatcttaggcctgaaggtacttctggagtgaaagagcattgcagttcttgtgtgtgctttatatttcaaaatgtattttgtagctctccccaccaaaaaagtcttaaaatggatttcagcttcaactttctagggtagtgttgagctgggtctattgaaatactgcttaaatgcttgctaaatatcactgatttcactttacctgtcatgctgagggaaagatagtatctaagatacatgtgcagggtgaatcaagatgctgcctgaaagttttgtgtgctcaggaaagcatttttatttacaagtgaactctattacagcagagatccccaaccccaggccacatagcaggtgagtgagcattactgcatgagtgccacctcctgtcagatcggtggcagcattagattctcataggagagcaaatcctactgtgaactgtgcatgtgaggagtctaggttgcatgctccttgcgagaatctaatgcctgatgatctgtcactgtctcccatcatctccagatgggaaccatctagtttcaggaaaacaagctcaggactcccactgattctacattatggtgtgttgtataattatttcagtatatattacagagtaataataatagaaataaagtgcacaataaatggaatgttctcgaatcatccccaaatcatcctcctcccccagtctgtggaaaaattgtcttccacaaaaccggtccctggtgccaaaaaggttggggaccactatgttatatagtatgttgtttgattgtcatacaaaccttcagaagtatttgaggcaggcactattattgacattgtatttacagaaaaatatgatgatgagatgttaagtaattgcccaaggtcacacagaataaattagtcaatattggtaccagattatctggctcaagcctcataatctcttcactattccttatttgtgagggcaggaaaagttctgattatactccgagtgaaagtcattcgtgtgggttggtgtgggggtaggggtgggggtagggagagagacctgtattacccccaaggtggtagatgacatcagataagcagaattaatttcaacccaatacatctgtaattttgacgttgaatatcactactgtttagtaaaactctgaaagaagcagtcctggctttaacttaagacttccaggaaaatgttgaccgtagttcaaggtaaggttggaaatttacatctttgcctcaggatctgcttgaagatcatcagcagcagctgcactaaaaagtatttattaggcttcggcagcttttctcccttatattctgggtaaagtgggttaagcaggtatgattccttctagaggttgttttgttttgttttgttttggagatgaagtcttgctgtgttgcccaggctggagtgcagtggtgcagtctcggctcactgcaacctctgcctcctgggttgaagcaattctcatgcctcagcctcccgagcagctgggattacaggcatgtgacacaatgcctggctaatttttttgtatttttactagagacagggttttgccatgttggccaggctggtttttaactcctggcctcaagtgatccacccaccttggcttcccaaagtgctgggattagaggtgtgagctactgcgcccagcctaagttttaaatctgagatagacaacactgatgaccagaaacataaaagatatcaattaagtacaatgagatcctctagtaaataatatgttagcaattggatatgagatgcccgagcctaggaaaaaatgaaaacaaatcttgtcagccctatctatatgccctacacaggtgagggtggaatccagacctgggaatccagtcatctcatctctgatcaggttgctgcctgacgattaaatttgtcatttggagttccaagttcttttagagtccctgatggcattggtggtttatattctggcatgagggaaaactccttgtaagttgatgcctgtatttaagaatgcaagatccaccaggactcacagagagatcatatcacttgggatctttgtgcagcaaattagagaaaactagctgaaatggggcctaaatagcaaaaggaatgtgttggcccacataactgaagtagattggcctcaggtgaaccgtgatccagcagctcacatgatactaccatttgacctggtattccctcttgtctgctttgccttagatggtatcactcttatccctaggctctgagcctctgactttctggtccaggtagcaagtgtctgcaggatttctagaccccatgctcttacaccagcttgtctatgaagatggaagacaaagcttttctttccaagaagaaactgaaaacatcaactcaagtcttgactttggttggggtttgtactttcactgactcattgattctctgggactatagaagatgggatagactgacagtcttaagcctccttcccctcattaggtagagctaggaggagggtcattccttcccaaactaaatgactaagaatgcatacatttgtcctccaaagcaagatctttcttttttccttccagaaagagtaactgcagtaattaggacccaattgatggcaaaggggtatgatctaggtgagtccattggggtgcagttctggagggggaattcaggaccttcttcttacctcctcctacccctgcaaatagtctgagactcactaataactgacagtggtattcaaattggaacagtggttcttgcctctgacctttgcatgtgctcaagtagccatctgtccttctttctcatcctctcctctttattcctttcttccttcttcccaccctttccctccatctctattcctccctccttcccttcgcttctccttcccttctccctccttccttccttccttcttttcttatcttcccttcctccccaccttgcctacctctcacatttccattttccaaaaaccttttttagccccttttgtgtgccaagcacactgcatggtactggatattcctgatggagctcatcttcccttccatgttcccttttcctttagcaaacttcactgccaacaaaatgtgttaatattctctgtgtaaggtgttctgctagattcagggaggtccgtggcttcagcgtgaatctcaaggatagagctggggagtgtttttaaatcatgatgacattgttcataaagattgtctcacacagattctactacctatattttggggtgggagggagagacagggaatgtagtttaagaaaagcaagcatttatgtctgccagtgtactcaaatgagctcatgtacgaagtgggacatggaactcgctgacctttattggcctctgcattcagactacctggggttgaattctaactcctctgccttctgactttatgaccttgggctgtttacctaacttctcagggtgtcttagtctatttttggtttcttataacagaatacctgaaacttggtaatttatgaagaaaaggaattcatttcttacagttatggaggctgagaagtccaaggtccaggggcataacaggtgagagccttcttactgtcgaggactctgcagagtcccaaggtagcacagggggtgagggggctgagcatgctagctcaggtctctcttcctcctcttataaagccaccagacccactcccatggtaactcattaatccactaatccatgaatgagttaatccattcatgaggtcagagtcctcatgacccaatcccttcttaaagcccccacctctcgatactgccacactagggatgaagtttcaacagaaattttgaaggggataaacattcaaaccatagcacagggtcttgtactgaggattaaattaggtatatatatatatatatgtatatatatatatatatatatatatatatatatatatatatatatatgtatatagtgcttacagcagtgccagtccacagtatgcgttcaatgaagttagctattattgtcatggcgatggggctttatggataagagagtgaagcataggcagtggattctcatgagtagtctcccgtgcttccacattaaggactaaatgttggccagtggctgtgctcaggccccgtcttccacatgtggatactagtgaggcaggggtgctttcttgctgtgtatattcacatttcagagtccatcagagcttccagaggactctgctgtgtgaacctcacatatctctattttatagtttttcagattactttgtaaataattattgttaattttctttagctttttaaaaatatgtattcatatattgagcctttcagttagtgacctaggaatagacgtacgtttttttggggtggggaaggggtctgtctgttgcctaggctggagggcagtggcacaatcacagctcactacaatgaacttccaggctcaagtgatcctcccacctcagcctcccaagtagctgggaacacagacatgcaccaccctacctggctaattttttatttttattttttgtagagacaaggtctcactacgctgcctaggctcgtctcaaactcctggactcaagcaatcctcctgcctcggcctctcaaagtgctgggattataggcgtgagccaccatgcccagcccctattgccttttgatccgtactttttgattaatatcctctaaaacacatgaaaattcactgttccctctgttaggtgctcccatagaacacatataggaccctagaagtcccatctctttagaaaaattatctttctgggaaaatacagagtttcttttataacacatctgtgtctctgtatgctggccaaaagcctcaaacccccaaacagacctgaaatgtttatccctaccactacttctgataataggggtttgactttgtattgcccacacatcccattaaaacatataatgtgatttgtgtgcatattgtgagcatttgttcattttataacctgtttagtagttcagccaaaagcagcaaaagtgaaataagagaaacatcctgagcaaaagaattgctctttgatatacctgtgcactggcatgagaggacagaggagagatttgtgaaagtggactcctttgttactaatataacaccggctactttctttaacaattaacatctcaaccccaatttatcattattatggctgtttttttgctttcataatgacttcagaaaaattcataacatcacctggagtccctttatctgcaaagccattagtcaatttcactggtactctagggagagacttgggaagtgaaaggtggacatttccccccagatggggtttctttacatgactcttatcaaatcaggtgggtgttaggagcctgagaaatgtgagcgtgaagaaatgtgaaatgtgagatttggataaggtcgtttggatttaaagaggaaatttccatcaagggccaactcctagaggagatcacagagcagaggctggggtgtggctgcaggtaggcatgccattgagccaaggtgggctgactcgaggaagagctcaagcagatgctttagaacaaagcataaatgtcttcttttgagaagtgtctgttcatgtccttcacccactttttgatggggttgtttgtttttttcttgtaaatttgtttgagttcattgtagactctggatattagccctttgtcagatgagtaggttgcgaaaattttctcccattttgtaagttgcctgttcactctgatggtagtttcttttgctgtgcagaagctctttagttgaattagatcccatttgtcaattttggcttttcttgccattgcttttggtgttttagacatgaagtccttgcccatgcctatgtcctgaatggtaatgcctaggttttcttctagggtttttatggttttaggtcgaacgtttaagtctttaatccatcttgaattgatttttgtataaggtgtaaggaagggatccagtttcagctttctacatatgactagccagttttcccagcaccatttattaaatagggaatcctttccccatcgctttttttttctcaggtttgtcaaagatcagatagttgtagacatgcggcattatttctgagggctctgttctgttccattgatctatatctctgttttggtaccagtaccatgctgttttggttactgtaggcttgtagtatagtttgaagtcaggtagtgtgatgcctccagctttgttcttttggcttaggattgacttggcgatgcgggctcttttttggttccatatgaactttaaagtagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaagaactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgacctttgtagggacatggatgaaattggaaatcatcattctcagtaaactatcgcaagaacaaaaaaccaaacaccgcatgttctcactcataggtgggaattgaacaatgagaacacatggacacaggaaggggaacatcacactctggggactgttgtggggtggggggaggggggagggatagcattgggagatatacctaatgctagatgacgagttagtgggtgcagcccaccagcatggcacatgtatacatatgtaactaacctgcacaatgtgcatatgtaccctaaaacttaaagtataaaaaaaaaaaaaaaagaacaaagcaaaaaaatgtgagtgtgtgactgaggtggtacatctgacttcgccattgattctcatcacttctcagggcctcgctttccccatctagaagggctgggatagtggctgttctgcaaagagcccccaggggccacattgcgtctagctcatagctctgcctccctagtaggatgcagcccttgtcctcagggttccaggcagtgggagctccggccaccatgcccatatttaggcagcaactagagagaggatgaagaagaagggcaaaggactacactatcttttaaggagattcatggaagtggatagttgacacttttgcatatatcctataggccaggacttaatgatgtggccacacatagctccaagggaagttgtgaaatgggagtcttcattctgaatggccacgagcatggctaaaaatgaggggttgtcttattaagatagaaggggatgagagttatagagggacaactagctgtctgtactgtgggtttagatgatgtcctaaacattcagtgtagaatattgcagtcttcaaagatgtaaaatatctttaatatttgatcgttaatttttttctttagactaaataatttaggatgctgacataaactatcatgatgatatttttgatgatggtgatgaggatgatgatgaggaggaggaggaggaggaggagaggaggaatatctaccagagaaaatactccagggtgtaggatatgacaatttacaacccaataagaaaagtatttttcccattttacaaataagtaaattgatgctcagagtgggcaaacctctgaggccaaaccaggtcttacctatggagtcatgatatagccacaaagattgggaacaaggtttttgggaagcaatgtggctctctgttgcaagtaacaaaaactgaattccaaatgacataaacaacaaggaaaaagttacatctcgtattaaaatgtctagaaagggcagcagcagaggtgggtaattcattgcctcagcaatgtcttcaaggaaccaggttctatcattctcaggatgtggtctttgaccttgatgagatttcctcatggaaaggccccagcagtgcaagctattaccctcacatacgatgtggtcttatggcagaaaaaagactgcctactgtttatgtgtctttttaaagtcagggaaacttttccagaagtcctcctgtgccatatttgtcctattttgtgtaaattcacctttgctgaggactaggtacctgaataaagtcatgattctcttaatatgaaaagcagtgggaatgattttgggtaggcaactgtcaacacctctaattcattcataggttatttgcccattagccgggtgtgcctgtagtcccaactaccccagaggctgaggctggaggattgcttgagcccaggagttcaagaccaccctgggcaacatagagacatacagcgaccctatctctttaaaaagtatatataaatatatatatacacacacatatatacacacatacatgtgtgtatatatatacacatatatgtagtgtgtgtattaaatatataatgtgtgtgtgtgtgtgtgtgtatatatatatatatgattttcccaatatttaaggacaatctagaattctagaattatggatatttccctgaaaatgtcattacttttggatgtcccttgcttattacaacttactcacttgcttatcaataaacatttattgaaaaccttctctgggtcagatagtgtacgaataatgaaattcatgcttactgtcaaaaaacattttatgatttagtgacagagtcagatatcctcagcaacatttacaaaacaatgcatggaatgccacaatagaggcaatgaggatgcttagaggaaaccacttatattggcctggggaatcggaacttgtggctgtaataaagctttcttctcttagattatgaatgttgctcatggggagcacttaaatgagctccctgagaacagggaccacaacttctttgtttttattttttagtctgagtgtagtgctttgactatagtagttgatcaatgtggtgagcagaaaaggtagcttccctacattacagctagtagtggtgtttgctggacttcagcaggtctttgtaaattcaaagcccaggctctctaacaccatacatagcactttgttactcacaatgaatggtttgctacagaatgctttctcttttctaatctgcttcttgtctgattgtcatgcaaacttgaatgggataataaatgtaaagtaattagcatagaagaagcactcagtgactattacctgctattattactttataatgtagtctgcattatttttcttcctttatttaaatcttcaactttgctgaattgcttattgaagaaaatgctgtctctaaacataacattactggcagctgaaagtgaaccttacacatgatgcttcatggtatctgagagtcatgaagtttacaaagacatttctggtcttattctgataaatatcacatgctaatatttcctacattcccatttactcagtgttccctacttcctaaatgagggaaaagcactgtcgaacagttgtcaaattttcttcacaagcagcttggttttccttaatggatgaaatcacccttcgttgatggatccatctgcacaggaatttctagatcatctcagggctcacactctgggtcccacctcctgctctgctacaaacggttaggtatctttatgcatcagtatccagctggccatagcggccctgtgtcagaaattatatttcctctaattggctaaagggaccattttcttaacagtttctttcttttatagggccatgtgctatgttccatttatatacacattctggaacacagtattccagagcatgttaattgtttagagataatggacctaataaatagaatggtgcggttaaggagaaatccagttgcatggaggtccttggtcttttgtgtggcttgaagaggttgaggatgctgatgtgttctttgggaagagattcacagttgacaggaaacatctgctttaatttgctccaacatcaacaagattgatgtggtaggaaacctgttgttactgtgtgagttccatttatcaaggcagggcttggcccgaaatcagggctatttggacaggtaccacaatgggtcaaaatatggacataacaaagcagcattacttgagagtatcatgtggctgtttctctatttaaagggagtcatgttccttctatacctgtctggctatcttcatttctttctatgtctttctctttatgtttttctttctcagcacatttccattcagggcctcaattacgagtgtaacagttctcaccctaaattctgcctccatatcctctctcctgggtaagaaaggctcccagtgatggtgactctcaatggagggaaattctccccaagggtttcccaaatattttcagaaacagctatgcaaacacacagactcacacacgcaagtactcaccaaaccttggagattatccactacccctaaggtatacctgccttttctggctaactttcagaatcacttacctagaattaattaaagatgctcttaccttcaggaaaactgccttggttttcattatttggaaaagtaaagtttgtatctgacacttaaaatatgcctctggagaactcaaagaattcaaagcattcttatatcagtgcatctgtgatactaatcttttagaaaattattacactgctaataaaatgtgaagtgtggattcatgccactgagcttaggttattgcctccactatttttgaaatgctagtgcccatgatgtcctgatgcaggaactcatctcttaacaaaacaacacagccatatacagaaaaaataaggtcctttttcacccattctggtgtagggtagatcaatcaattaaaagaaattgcaaaggctatatgctatggtttgggtgtttgtcctctccaaacctcatgttgaaatatgattcccagtattgaaggtggggcctaatgggaggtgtttggatcatgagatgaggacagatccctcatgaataaattaattgtgtctcttggaggtgagttcttactcagttcccatgagagctggttgtcacaaagagctggtatctccccaccttcttgcttcctctctctccatgtgatctctgcacatgccagctctccttcaccttctaccatgagtggacacagcctgagggcctcaccagaagctgagcagatgctggcaccaggcttcccgtatagcccgcagaaccatgagctaaatagacctcttttcttaataaattacccagcctcaggtattcctttatagccacacaaaatggactaagacaccctatcactggagtccactcagactaccaggtgagataaatccaggagcttccaggttctttgttcttgattctggcaatgggttcaaataaaagacaatgaaaggatatgctattggctactttgtcatttcatcttcctgcttcctacctaatgacctgaatgcacatgtgctcccgctgtcagtctccccactgtgaacaaccctcctttctctttacgaacctcctctgccctgggcaggctggtgaccacactgctctgggccagatactgtgcccagtacagagaggaggtgcacgaggaaatgataaggcacatctctgctttggagaatctcattgcccaagaagacatatagacaagtaaaccagttacagaaataatggttaaggtacactggtggtacgaagaagggacgaatcagttttgcctaagattggaggatgctgggcaaaaaaggcttcagagaagaggaggtatttgaagagtgcattgaaggttgaatagaaggtttagagaatcagaatttgcctagtgtacagaaagaaaaattgaaaggcagtggacggccatcagtagaagggtgtgaggcacaagttattgaggtacatgaagagactgacagtcatgatcattatgaagcattagttgaagggtcactgaggtacacataagtataccaatggtaatgctgctggaagagtagccaggggactggggaaaagaaggcaccatgttatgtgctgggacctcattcattcttcatgtcataaggagccaattcttctctggacttttccacattccatgcaaagtctgtctggcttcctgtccatttactttctggtcattcaaggcctaccactgtccggtgtccagttgctcctcatatgcagatgaaaaacctgggccaggtcaaagtctgaagacctagagaactgggcagagctctgggcagtgtgggatctgcccacacctctcagagagaggaactgaggtggttgttctgagaggcagtgagcagggagaccctgaagccaaaggctggcaggatccagcagggcagaggccagcaggggaattcagggaagagcctcagggctgacaatggggacacctgactacagtcaaggggattcaaagcacagcctggaacctggaggaatcccctggaacatggacacagaaatgtggacagctgaagccatgaccttgaccacaggtagggagcttgcagttagggacaggagccaactttacttagacataactcaaattcatgtcatttctgaaggaaatgaaatttccttcattttcacctggttggaatttattgctctctccttaatggtgcatagcaccttgtttatttatgctttgagtaattgtaatatgccttgttttatagtatttttatacatttctacttcaactcttgattataaatttgttaaggcagggaatatctatctatctatctatctatctatctatctatcttatctatctatcatctacacacactaatggtattttagctatagcatacataaatacataggtacattttgttgaattgaaattaattgaattaatcccatcctctttcagaatagaaattatgttttctgggagctagaaactattgtgagagatgttagtattgttgaaatttaaaaggggctgtccagttcagttgtggcctggtgtgtactgaatgacatccaaattctaagtaagtggaattgctatcagatctgagataaattaaccatgctcatgagaagatgtagagtgaggaattccttccacaaatgctctgcttatctgattattggttagccagtgatttcctgtcatccacaaaaaaagatgaaatagtaagagaaaagtaaatactaggtgaagtgctttgagccaaagggagtccatctaagaagtgatggatggctctgttgggattccggcagtagtgcatgatgatgttggtgtataaatacgtcagctcctttaacccttgggggaccctgaggcatgtgtttttcatgggcccctagcgtgctcatgcaggattaagtttcagttgcctactgtggtaattggcttgagaagcctatctttattaattttcttctcttccttgtcttatttctcttcttccctacctgtgttctcttcattcccttcctccctacaaaataaactatgtgagtttgaattcttctttcaggattcaagtttactcctggggaaccaaattaagactaaagaatatgtattctctttcttctcatttggcgttgagacattttaaagcctcaacaattttccctatataagcagttccaattatttgtgcctcacttataaaaagtaggtaatgagaaaattaaggcttgcagacaaatcttacacaattgcagcagaatatctcagaaatgtgctcaattctcgggctttctgtttggtctctttaagcaggcaacctcaaagaggtgattctagcttttgtgattatgtgtgattttgttattttacagcctactgctgtggaactctattgagaaaagacactgataaagctaataaaatatacatctgctacaaagaaaattttatctcaaaaatgctatttcctcttcagctctgaatgttgacagattttttttcctaacggggttcagtaggttggctggaaagccaagatcaaataccaacgggaggtgtgaagactggccagcctatgttcaacgagttcaccatccagctgctaagttctccatgctgataagacaaacactctctgaatcggatacgggcctactggtatctttaggaccatctgcagcacagctaggtaaagtaggcacaatttttaagttaggttttgcagaaggtcccatgaaacagggtttccttgtcaaaatacagtgagacataataacagagccatgtttggaggtcccttcattgacaatgggttatgccttcagctttcaggctgatcctgctgagaagcatatgtgattagccccaagaagctctttactgccccctagatccctgtcaaatctaggagatcttgagctgtacttcccctgggcccgggggacgtgtgaaatgcttgtgttgtatcttcattagtggaaatttttgatcaattatcctggatgatccatgtcatggaacattgagctgcgtatcctttcatttccatcattcagggtgatattcaaaatataggataggcatttttaaccccaaagtatattgagaagtaaaattaatgttggagattagtacattacacacctcatcaagcaggaagagacaagaaagcatataaatgcgacacaattctggggcaactcctgtcttcaaaacttatttgcttcagctatagccgctgaggccttactccttttcctgcctgtcttgaaagattgttctatgcggccacccagatttcttgggatctgatgctagaccttggaggaagtcaggtaaagctttctagctctgcctcagttggaccatgtctctcccctgtctctggtttcttgggctactttgatttcactttctgtgttatggaaacctctggcagtaactgttccctgtgtgccttacacttcaattgagatgcacaattgccaaagctctctctgataccaccagggagcagcgaacttaattcttctgtctttgatctctctcttgttttgctgtttctcccctgacaagaggctgagctgctttgggggccaccaagggccattctctccactttgtccttcactatatcacatccccatatgtcttcctatagtcacctgctggcgtgattccattttgtttgttgaatttgactaaaggtgtcttgagcttaggagtcatatcagcctgcccacaaaagtgtcccatttcactgggcaaatcaactagaatgttgttgtatttactctgtggacttaggaagggatcctctgggaattagccccatggggtttctgtcacctcccattctactttggcttagacaaggtatctgagttcagaacctgactctgttcctgcgctcagctttacagacaagtggtattatttttagcctgcagaccttttagttaacaccctgctgcattgagggtgtgagagagaagtgctttggaaatcagactctgttactgatagcttgtcctaaactgaaaaggcgacaggagaaaggatgctttgtgttcaagcagaagaaatctccgatgctgcagctgctgctgcagccttcccctgtgtttctcaccttgctgcggcctgctgtttggcaggacgacttgactggctgcgctgtggtttctgcgcctgtgatggctccttctgaatgccctctgagccctgggggtcttatcagctggctgcggcgggggtgggagatgaacagctcccttgtcaagcccgctttctccttctcctgggaacccctgccgggtcaccagcctaaaccccctctagcaccccatggcctcttgcttggggtgtcagagtcagagagagtaaggaggtgttgggagatgaagttcagagggtaaaatgataccgcaggaggaaccaggcttatgcgagctttatagtcggctgaaaaagagaatgtggtaaagatcaggtggcccgtttcaaaatggctggaacttttacttaatactttacaaggtgcgcccctgccccaaagtataggtggaaataaacctctgctttaaaatctcaacagaaaaatcagatcaaagaaatctggtgaaatacctttgattaaatgtaacacacaattgatctcaattccatagctgattattaatttttaattaggagtaagatacaggcaccatgatgtgtagattttgttgtctaagaaagaagatgaatagaagataatatgttttaactttttttttccaccaagttttaaagttctaagactgctggcaattttcaatgaatatatggggtctccatcactggccattttatgggcaaaacagcaaaacacaaataggtttaatgctgagctcccagcccttatctttgcttctccccctccatttccaccagtcaggtgtctagaaaagaagggcatcctggttgggaggaattggttgtggggaggatttggccatgatcagagtaggtactgcttcagaccgagctggggcattttaaaactgaggcagaagaagccatactttaggggtccggggaaagaaagtaggactaggatggctccacaattcctctgctgatcctctcagagacttagctttgcttagaagcattccctggtaaccagcatctattgctgtctttacttagcatttaaatgcccccagtctggcaatgtcagttatctcagagccaagacagaataattttgtggtagaaatcaaagaattttcagtgtaacatctagggcaggatttgtgcctcttttgcagtggatggccttttcccctcttgacagaattctgttagagcctcacattgttgagatatccccctcatctccattctacagagtgttaatgctgctggaagactgtctgttaaaatcagattcccatcaggctttgaatgctccctaccaaatggcgtagctgcctttgatctgtagtctcacttaaggaagcttttcaagtgcatggaaaatgtcttgaccccagtgtttggacctgtcactgcttgcacaccaaatcaaggtatcatcaagctgaaaacgtacacctagaggaattcctgctatttaatgggctcagccattcctgctgtattgatggcagtctcagctcagctctccctctgggggctccgaagaccctagagttatgttcctcccagcagcaaacctctgaggcttggtgtggctcaaagacagagtcagagctgctttgtcatctgtgattctgtgggttggaggagtagtcagaagtaggtcacatctgaagaaaaattctctgcttgtgatcttgagtacaactgaaggaaactgacccctttgaattcatgaagtaggatgcaaggttcatattatctatgaggactgtaaaaatggctccactgaccttgagcttattcgctcacaatgcatgccagttagatatgggtatttagcatgctgtattttaggaatattacatcaaatgtggaaatacggaggcacatggtaaactgtcacgtactatacaaatgatcattgtgatgacattttcttaaaatgggttatatgaagtataaagaattgagaggctgactattgccagcaattagtttagtatagccttgtttattaatctatggccagatgtggtaccttagagcctatagatcttactgtgcacacccatgaccttcagatgttcgtcgggagacacaacatagagcctggtcttggtgcttgaggaatctgggatgtcatacctgactctttgatgcattatttggataccttaatctctccaaatttccttgtttataaaatgaagatgtaaatgcctcaattgcctcatgtggtggttatgaaagctaaaataaaaatgcacagatggttttgaatgtgctttgggtcagtgaagtgttataaagtgtaaggtgttatgatgatcatagatgtaacttgggatgtatgctttgtccatggatggtttcttatctgaaaggaaaagctgatgaaagctaggtcgacgaataatgtgtgatgagtatatgtgtgcatatgcacacgtggacatgtaggtgcacatgtccatgtcagggtacatagtgttacaaaggggagacgaggtgtgtactgatcattttcacatttgcactctgccccgttcactgatcttcccctaatcggccctgtatctccaggagttccactgcataggcctctgcctagggcctgcttcttctctcacccctggtggctggctgggtcctgttgggtggctccagcctcagaggctacagcagtttcctgatgttgtttatctatagatggtctctcttctgtttggtgtctgagctcttccatcttatgggcaacggattctccatattaaattccttctgtttgaaatacttagagctggccaggcatggtggctcacgctggtaatctcagcatttggggaggctgagggaggcagatcacctgaggtcaggagttcaagaccagcctggccaacatggagaaacctgtctttactaaaaatacaaaaattagtcaggcatggtggtgcgtgcctgtaatcccagctattcgggaggctgaggcaggagaatcacttgaacccgggaggcggaggttgcagtgagcggagatcataccactgtactccagcctgggtgacagagtgagactccgtctcaaaaacaaagcaaaacaaaacaaaacagaaatacttagagctgattctgctttcctgactggcccctgactgattccagatgcttactttgtagatggatactagattaagacatgcatagtacaatttgtagagaagaaagataatgtagaatctaactttatactgtttataagagatatgtctaaaaaatgtgattcaaaatggtttaaaattaaaaattaggcaaatatataaaaaatgaagagaaaaaagcaaaaatcaaggtaataaaatgttaaagcaatgaagatcacttttatttattttaaataactatcataaatatttatgtattgaatgacagcatcagaatatataaataaataatttttaaatgtaaaaaaaaaaatttagaagctatatattaagagaccttactgtaattttcctaacttttgatagaccaagtagccaagtaggaggaacaatctcaacaataaaataataatttattgacctgaaaaaacatttagtagcattgattggctcaaaactatctatatggggggtttgcctgggaactccatttgcatagcaaacactcagtttttattcatgttgagttatattattgggaggagctgaaggagattactgttggggctaatgtccccatcccctacctcttggtaacaaaactgaccctcaagagtcactccttgtgtggtggttttttgttttgttttgttttttgttttgttttgttttttgtttttttgagaggggtttcactatgttgcccaggatggtctcaaactcctaggctcaagtgatcctcctgcctcagcctcccaaaattctggaattataggtgtgagccacctagccgggcccggtgtactttcttccccattcatctagaaaagtaagaaggcatattgttgatgaggtaattaaaataaattaattagcacaacaataagaaaataagtaatgtgataaaagcagtctgcaaaggcataattaaaaaaatttttttcccataggttattgggaaacaggtggtgtttggttacatgagtaagttctttagtggtgatttgtgagattttggtgcacccatcacctgagcagtacacagtgcatgctatttgtagtcttctgtctctcatccccttcccaccctttcccccgtgtccccaaagtccattgtgtcattcttatgcctttgcatcctcatagcttagctcccacttaggagtgagaatataccatgtttggtttcccattcctgaattacttcacttagagtaatagtctccagtctcatccaggtccctgcaaatgccattaattcattcctttttatggctgagtagtattccattgtatatatataccacagtttctttatccactcgttgattgatgggcatttgggttggttccatgtttttcctattgtgaattgtgctgctataaacatgcatgtgcaagtatctttttcgtataatgacttcttttcctctgagtggacacccagtagtgggattgctggatcaaatggtagttctacttttagttctttaaggaatctccacactgttttccatagtggttgtactagtttacattcccaccagcagtatagaagtgttccctgttcaccgcatccacaccaacatctactatatttttttatttttggattatggccattctgcaagggcgaaaatttaaaagaacacacaagaacctgaatttgaaagagtaaatggtggtgaggcacctttgaagggagagtgctctgaggagcaggactgaagagcttggtgttgagaatggcatgcagagctgacattaggttcaatcaggttgtttctcttcccctggaatggcagcctttgggaaataaccccaagagcacaaaatctctctctctctctctctctctctgtctctctctctctctctctctctctctgcctccctctttctctctttcttttgggggctgaggcccttgaagaccctttgcaattccataaatagtcagagacatccctcaaatactacaccatgttcctctgcatgggaaaagtgtggtcacgcatacacgtaactccattccctcccctcctttcctccttgcaatggaaggagcaggaagtggacaagaaaacagaacagtattagagaaacagaatgtacctaaatggggaagactgggctgaatttgaggaggctgagttttacttccaaacccacccaattcactactgctgtatctcttgacaaaataagtagacatagtctgtggccaattttcttctaacttcatctcagaactcctctctcctctctatgcatatctgccctccgcaagcctcagacctcatgatgaacgaggaaggtaaagcatctggaaaagtttcctatgaagagctgctgaaaaagcctgagatgttgtttagtgtagaaaagactcaactttgcatttcccacaaagtgtttcatggaacaccctttgtcttagtctgttccagctgctgtcacaaaataacacagacagtgtggcttatgaacaacagaaatttatttctcacagtactgaaagctgagaagtccaaaatcaaggagctggtgtgttgggtgtctggtgagggcctggcttcctggtttatacatggtttcttcttgctgtgtcctcacatggtggaaggggcaaggcagctctcaggggcttcttttataagggctctaatctcattcacaagggatctgcccttgggatctaatcacccccaaaaggtcccacctcctaaaatcatattattgataactagatttcaacatgtgaattttgggtcaaccaaagctatagcactactcacaagaaatgttaatgggtgttcttaaacaaggcagaagggttccatggacaaaataaatttggaaaaggatgaaataaatataaagcaagtttcttaacttcttcacttttcatagcttttgacagattgttgtgattctccagtaaggactacagaatgtagcatttcccaaacatatttgaccaatgaactaccatcccaggtgtacctattaatgtctcttaggggactagtgggaggttgcactgtttgattttaaagaacgcttgcaaaaccagacaccatgacttcaagttgcccttattagttagacctgtcttctgaggtccaaaattgacctccttcttcctttctctgaaattcatataattatatgattaaacaaatttctactaagacaaatttggtataatcctctagctcttcatttgttattcattgttttaaaagtttcttatttgaaataaacagttagataattataatgggagatcatcttttttgagggcttttctgtatgctctttctagtataagtcacctctttctcttttactgttccttggcaagcaaaaacacaagtttaggaacaagccagagttatcaaaagttctacaggagtgaggaaaaaaagagcaagaggaacgcaggagaggcaactcacttgatgacatggcagaagcatccaagctgctgaattgttttcaaaagatggcaggcagggcccacagtgaaagcatcccatctggttgtccaatccaccatgaaaggggtcgagagtggtaaggattagagtagaggagattcccaggagctattgctggtgatggagggatgtggagactttccattgtttatgtacattagagaagattgacttgaaatttcataaatatatatcttatcttatattccttaatgtacataatggagaaaaaaacccaagagagcactccaagaggagttgagtttggatcaaatcctatcctaagcattatcctattttggagttgagatacctacattttagaaatatttttaatccagaataggtcacatgctaaatattctgggtaaatggtgtttatttgttcattgttttttttcttggcatgtggaagagaaatcatcttgaatcaattgtgttcattggccaaacagtatgataatttgttaaattttactgattaatgatgcagagtcttgactttcattgtaagtaaactcaggacacaaaaagcactaagagatgcccaaagtggttttctataatttaaatggaaataaatttgtatcgaaagtacactagatttcacatttcacatccttttagttttagatttaaaaaaagagcgatactttctgacttctcagctaagatttttatagtggtagtggttgttgatatttggtgtgtaaaacctctttatgctgctttagctatatattttttaagctgactttactatcaaaagcacttgaaatttaaaaattatgtccatgattaaaaacttgcagaagttgcccagcaactattttcattccccagaggcagagagtataatggaaaggaggaatttggggtgagatgtctttcttgtgtttaaattttctactctgaacttggacaagtcacttatcttcctaaatcccaattcctcatgtatttaaaaaaaaaaaaaagaggatgtcacaatcatactgcctattttccaggattattgtgagtatccagtgaggaaaatatataaaagactcttataaccttcagatttcttacacatacatataattgtttttaacacatttctgatctttgttcatatgtatatatggtttcaatcacaggaccctatacacatttgtgttccacttttcatatctaatgttatagttgtgccataatttactagccctttccctattgatggacatttaaatggtttacagttgttccctattataatagtgcagtaataaacatctttgtacattcaggcttttgtctttctctctttattatttttttttttttttggccaatttctctgggactagttccagaagggaggttgtggagtcaaagtgaatgaccatttttttaactaacctgtcttttgagcttttcacttcatccaaatatctttcccttggtaactttcctagaaagtcacagagcactcaaatgccttcttgaagtcagccagaaagattcagaatctacatttggtggccatatttccattttcaggctctttcagaaccactggcctgtgaggcctcccctagactgcaaggcccttcaggacaagattgtgccttaatcatgttggcatcctagcatggcctggcttgtcacaagaactcggtaagtgattaatcaatggagctaaacagagcagatgcctaatacatgataggctccttatggtcacctgacttgccaaagcattcattcatcaaagagtttttaacaatgtcaggcactggtgctagaaactggagacagagaggcaaatgtgacacaggtggcctcatcagcctagcaagcagagcccccctggcagtggaagagcttagtcttgaatctgagaattccttgagaaggggtccaagagtggagttgaccttggcccatgtaatgtgattgcagggaaggcccttgctatgcctaaatattttaatcatctaccccttaatatcagtcattctgtaacacagatcttgttacagagatggaggtgacagaaggggcctctgcaatgttatttgacaaccatatcctgtgtcaaagaacctcaagctctgttgtctgagccaggatgtgagaacagagttccttgacccagcagggttagggagggtttccaaatcccctctggagcagaaaatccctgtttgatcctatccagcatcataaggccacctgctgtgggcatgaatgctggggagggtggggtctctggccaactcaggaaagatctgattctgggcttttcacttgtgtataaatgaatgtgtctaaacattatatgctttccatttgcctattgctggaaaatttgataaagggtgcagaaattgagcaaatagttctgcaaggggatgtagaaagttttccttggcctcagactctgggctgtcttgcaactagttccttggaagtctgtgtaatttacttaaggctggatgaaaaccaatcctaggttttccatgatgcctctggtagtgctggcttagcttgaactctgtgggcagagattgtcaaagaggcagctctgctctaaatttcttgttattgttctctgtggaaactcacagagaacactgacaagtttctgagaccctaggttgttttatgttgaacactgcactgttgagtaaagacttggagttctctttatgagttagaatgttgtggctttccttttataatgctctgtaaagagctctccaaatttggctaaaaatttatacactttatggctatccattgtggtacaaccatatgttcagtttagaacaaataaacacacttgaacttataaacagatgaaactcagtttggtaatatttataatttgttttaatttgaccagaaaagtattatgtgcccaagcctgtcacttagtcaatggtcatcgctgggactgagcactgtttctgggtgtcagatagaaacattaatgatttgcgagtttcaaatgtccccagggagacggctctagcactgttgtgttgcatgggatattggaggcaatttcatatgtgcacatatagttagaggtttgcgaggtgtttattttttggctacctgtagatggtttcattatcccaaatttgtattgatgagcaaattcaaactttttcatttcagttcctatttcaaaagcgcctgtgtctgttttttctttgcctctgttaactggctctgaggtaggcatcctaatgcctgtttcccctgagccaagatcacatcttgtgtttcagctgcaagctaatagcctgtcaggagtatggaaatatatatctgaggtttgtgattctgcatgggatcaggatttccaggagtgcctgttggagaacactctgctctgtgcttctcatgtcttaatgttggttcttaatgttaattcaaaccagctgtggcagacccagttgttcctagaagttgctatctctgtctttcacattctgcaattttatatgcacatacattctatgaaacttcatgaaatttctatgatatttgtgtttcggagaatgctccttataactctgatttcatgcaaaaagttactgccacataaatggggaggtgatatcaattatgcagtactggattcaaacatcaactctgttacttactagttgggtgagcctggaaaaatctcttaacttttatgtccttcgctttcttgatctgcaaaatgaagatgcaaatgatcttggtttggagtcttctagtggtctacagtatatggatgcaacacttttagggtctgctccagttacagtaccaggttataaggattgtaccatcttgttttaaaaatgatatgaagttaaactctgaagcacttagaacaggtctagcacataataaacttttcgtatgtattagttactacgattaccataaaaatctcaagaaaatattaattctctgcttcggatattggacagaactctaattaaatctgatatatgcctaccgtgggaagctcactttttttctgcattgctagagcaataaatacaatcaaatgttaaaaaaatcatcaaccaaccaaccaatcaacaaaaaaaccaatccagattctaaagcaggagaatggcaatcatattcaccactaacacaaatttcacaaaacacaagcttatatcaaagagtcaattcaaacttccaatttaatactctcccttcaggaagtgctcattactcttacagccttcaaaagacagaaactccccacctgaccatggtctttgtcaatgtttttggaagctaaatgaaataaatatgttttagaatgaaatagggggtgacaaatatccccctctgcaatttttcattgattcctaccaattgcagcatcttggattaagaagcattccttctatttgtcctgacatctggagaacaggccacagattttctcaggcctccatcctggagtttaacagctatcactatatggaaatccttcttagagataatctccactgatgcgatttacaacagttttcttcttagccactcttccatgctcatcctttgaatgacagccatgtatggacttgaacctcacagtcctctgtcgcacagggaagaatgccagtgatcttgaataagactcagtttttgtgttgctggaagaaggaacagtatctgggtatctgaggttggttttgtttcctttattttctcaacatctttgagctttgtttgaaatgcaaaacctaattttaaaaattctgctgttggatatatcatttgaaatgtagaaatactctgaaaaaataaacataattgaaatagctttcaactattaataattttaaaaatacatggtttcctttgtctcctctatggttttgaaatttaacaatgggatatttgtcatcattctgcaggttgagtttttcagtccagcgtagagtgattgtttctgtttttattttatttctaaatttttatgcctgcagtggatgtgcgtgagctatggccttggggcctaaacagctctgggtctcatggagagcgaaatgagtgcatttcatgctttcgctttccacaatgtttattctgttaaagtaaactcaacttatggatgtatcattggttgtaattataccattcacataaaaggtaaataatttcaagtaaaattagaatggtatttttgtaaatccttgtactttcctcactgactttcaaattttcctctttcctaatttcatcctaattttctccaggcccaaggacattaaaggcatccatcaacttttccggaatcaggtttctctggataccgtttctgatttggaggcttgcagccatttttttccaagcataaaaatggcttcaactttccatagtaagggaaatctcagtaagggaaatcatatacccctaagtatatgcattttaattttccatgtcttgtcactgttatgataaaaaagaacaacagagtttgaaaactttcagtgattgtaattttctagttagaagtttattttgttacatggttctttctttgaatctcagctgtcttttgtaattagagtattcatcataacatgcatcaactatttatattttctcaataaatagtccttagcaaccaattttgtgccttggtctctttaaagacagtcatacaggtgtcatacccaccttttcctctagaatatattataacctgaataaatcctgggccttatgtcaccaagtttcagggcagtgtaacattcaaagaaacaaccaaaagcaaatgaaactctaagttttgcttgcagtcctcagaacgcattaaaagagattcaatttacagatcctagccacatcgtctaaggttcccccaactccacttcctcactgtcacagcccatctggagcccttgttctccactgccgccttcccactactcgccaacactgtccacttttctttgcctcttgtattctgtttttctagtcctacctctttcttcgcattctcctgtttctgtatcacaggaacccaggagtcaagttggggtagacaaagaagagaagctgatcaggcaaagacaaaattatctttactgggaagtggaggccttgagggttcagagtgaggctgcaaatactcagatagtaatatttttttgtaatattactgtcaccaaggcatttttacaaagaacaccaggatttaatgcagctattaaagttcttagtttactttgttgaactttccaaaagaggcaacctgtccacagttctgaaggctgtggcaatggagtgtgccctcagagaaacctcaggagataaaatcacagtcttcttctagaatgatcttataacagctagaagggcaaaatacacttttaagagttggagtctattccatcttataaggatgggggatttattaggactctgtgccaagattttccagaatttctctctaggagtagctaaaggagggagctgtctgagaggggattgctggggacaatgaaacttgggtttgaatagcacttcatgtaagatggaaagaacatcatttctcacagcaaagtattaggggtggggatgggggtgggtgatcaagatcaatgcagtgtcaaaacctcagccctccaatctactcctggaatttttacagagtgtgagatgtttgcagaccaggaggctttcttgcatttatgcctcaggaaatgggtcgttttataattcttgtggggttctttttgttgtgttgttttttgtttttaaaaaaatccctcttcctatacagaatcactattaacagtggtatgtgacttttcagacattgtatgtgcatacatccccacacacacctttatgttgttttttatttatttgtttttattttttaattttttttttttgagacaaagtcttgctctgttgcccaggctggagtgtagtggtgccatctcaggtcactgcaacctctgcctcctgggttccagcaattctcctgtctcagcaacccaagtagctggattacacaggcaagcgccaccacacccagcaaatttttgtatgttttgtagagacagggttttgccatgttggccaggctgatcttgaactcatggtctcaagtgatcggcccacctcagcctctgaaagtggtgagattacaggcgtgagccattgtgcctgaccatgttttaaacaaaaaaaaaaattgacgttatatttacactttaatctgaaatttgcttttttcaatttacagtttgtcatgaatatccatgtcagaatatttaaatgtaccattttttttttgagacagtatctcactctgttacccaggctggagggcagtggtgcaatctcggctcactgcaacctctgcctcctgggttcaagccattctcctgtctcatcttcccgagtagctgggattacaggtgcctgccaccacacctggctaatttttggtatttttagtagaaatggggtttctccatgttggccaggctggtatcgaactcctgacctcaggtgatccgcctgccttgacctcccaaagtgctgggattaaaggcacgagccactgcgcctggcctaaatgaaccatatttttttaaacagttattttattccgttataccatgatggaatcttgtacacaataattcccctattgttcaatatataggttgcttccaattttgcactatatatacaatactgcagtgaataccctgctatgtatatttttgacacacctgccttagtgtttctatactattgatttctaaacttgtagtttctaggtcaaagagtgtgctttcaaatttttaattgctgatgctacaaccccccgtcttccccaaagttaaaaaccctttgtcccaaaagtcaggggacttaatctggattctgtcgctgtttagttattcatgttgggcaagctgcttcttcacatctctgtgaaatgaggaaagtggaacagaagatgacctctgtgttccaatgtcccatgagcctttacctttacaaattgatttgcccaatttcagagaattatttagggctgtttcaaaccaatatgaaaatctgctctttaaaagattgttgagagcggagctaattttttttctgattaagctttgattagtaaacaaatccattaacctcctataggattattttgacatattcaagctgtgactttttctttcacagttttttgaaagctgagagccaccactgagcaaactctcatttaggccagattttgttttattttgtccagttcgaatcagtttgatggctgtgtgtttatgcatgatcttaaatgttccccagtactgggacagggcacatttgacctgttggccgatgaacagatttggttttaatcaagttccaagtcagataacagcactcatgtgatagtgatctttcactttaaggccatgttttgttcactgaaccttgtaaaaatcaaatacataaataaaatgaagaggtcaggaaagatggtttggtttctttcaacctactgctttttgaaggctcagggccaaaagaaaaggaaagtagaatgatagggattttgttatttactatacttaactgaataagtctgcagatgtctggaactatcctgtataaaacatcctattcaccagttcctaagagaccctcaaagagacaattcgagtttaacgcataaaatatcaaagtgggccagacgcagtggctcacgcctataatcccagcactttgggaggcagaggcagatggatcacttgaggttaggagtttgagaccagcctggccaacatggtgaaaccctgtctctactaaaaatacaaaaattagctgtgcatggtggtgggtgcctgtaacccgagctacttgggaggctgagccaggaaaatggcttgaacccaagaggcagaggttgcagtgagccaagattgtgccactgcagtccagcctgggcaacagagtgagactccgtctcaaaaaaaaaaaaaaaaaaaaaaagaaaaagaaaaaaagaaaaaaatgtcaaagtgaagatttgaaatctgttcacagcaatacagatatggttgagaattttgcattgatagggtactttgaggtccactctgcaaaatattatttgtaaattattttgtttgctagttagccaaaggtgtgaaacctggtgttaaaattgtgatcttggcttggtgcggtggctcacgcttctaatcccaatactttgggaggccgaggcaagtggatcacccgaggtcaggagtttgagaccagcctggacaacatgacaaaacccatctctactaaaaacacaaagtttggctgggtgtgctggcaggcgcctgtaatcccagctactcaggaggctgaggcagaagaatcgcttgaacctgggagtcggagatcgcaccactgcgctccagactgagagacagcaagactccatctcaaaaaaaaaaaaatggtgatctctctgtgatgtagggtcctgactagagtgactactgcacaccacatataaattattcctacttatagttaaggtgccaaagactggtgttaatttgatttttaaataaattggaattaattaaaaattatcttaaagtcactcggaaacacttgcatcctaagtgggagagaaagtgatggccattctcctgataagtcctgcctgcctccaggcctttgctcaagctgtttcctctactaggagtgctgttctcacagctggttcctattcttcctccagttcttgggttctgtgccacccacttagagaggcctcccttgagcacactacctaaggagagcccctcccttttattctttatctcagtctcttgtttcctttatagcccatgcacatttaattttattaattttctgcatgtgtttagtttttagaattttaacagctttattgagatataattcacacaccatacagtttgcacatttaaaatatacaatttaatagtttttagtttattcacagatacatgcaaccatcatcataatggttggcaattttcatcgggtaaaaaagaaatcctgtaccctttagctatcaccccatcatacatccatcacctctccatccctaagcaaccacaaatctacttcctgtctctgtagatttcccttttccagactttcatatgaataaaatcatatactatgaggtcttttgtatctggtttctttaacttagcctcatgtttttaatgttcatcagtgttgtagcatgtatcagaactttatccctttttatggcttaataatatttcaccatatggttatagtgtgttttgtttatccatttgtccattgatggacatttgggttgtttatattttttgtctattatgaataatgctgctttaagaatttgtgtacaagtttttatgtgaacatgtgttttcttttctctgtatcctgtatctaaaagtgggcttgctgagttgcttatatatatttttggatgtctcatttactacagtagaaactccataagaacagggaccacatctgccttgtcactcttactgccacagtacctggcattctaccttacaaagtaggtgatttgttagtaacttggtgaacttttcggtaaactaacatgcattgcacctaccagacatctggcatggtgctggatgcctatattagatatggcctgaaggagttactgtgccagaaatgtcagccccagcaccaacatcctcacacttactaagggaactaacccggagacccacctgcctatttcacaccacataacttagctcccacagcaagacttcacccttgagccataacagattagcccaaaggtgggcaaccagcacaaatgtagcctattacaaactggtcagtgtcctttgaggtacagcaaaaagctctacccaaacagggaattaccaagcctatcatgtcttgtttttaataatcctgaacctagtaatttgaatatataagaagtaggtaagacttagtgggagtagtttacaggtcattggcggagggaagctggtaggtcaagatgatcgtggaagttatacacaaccagaatgatgagaaagcaggacccggaagataaaaaatgtacttatagaatgaagacgagcagccagagagaaggagtatctgggtcaaggtgatgacaagccaatgacaaactgtatacactccttagttctgaacaacatgaggctttttctctttctgagacctggttgtttagcatttcctgtatgtctttgaaggcttggcctcatgattgaaatttctgtgtcctcactgccaagtgtatttgtaccaaccacttcatctcacaaaatcctgccctgttattcaaggttacttgagttgaggcttttttccttgcaaccaggaaagctgatttttaaaattcgatattaactacattttacagaagatgaaaccagagctcaaggtcatgttttagtaaagtgaaggttgtggaattcagaaccagatttatctgactccaaggtccaagctttttaccctctaccatccacccagatgtatttcctgactcattcaggagtttaactttaattgtgatagcaatattctcccatcagctaagtgaaccagcttggaaataagtgtattaatgaatttcttcactaaaatttaaaaatgcctttgtatttatgcatagctaactcctgagtttccattattgataataattaagaactggtttgtatatgaaaatgtgtttgtagcatacatttggcttcattatctccatcagttcacatcactttgaaattaaaatcaaatgagatcatgacacatacctgtcagtgacatgcaaattaaaaattcttggcaacatagattaatgatcatttttgagatttttctctcttttattaattttctcctcttgttttattacatctgggtacttattgaaggaagagactctgatagaggatattgttagtggagaaaaggaagcttggcaactttcgtgaaatggtgtgccttaaagaggaaggaatttacagtaaagcctcagggagcccaatgcttaggcaacagtctacaagttggtgaatatctctttcagattggtgttgtgctttacacgatactgtattacaaagctgctaaacaacaaatggtttttctacagataggggatctctaggcatctcaaggataggaatcaatttttcaaagggacacacacactcacacacacacacacacacacactctcacacattttacccacacatgcatatactgtatatacacacccacaatactttgtagaaatgctgccagtatctctctagactaaaagtagtaaacattctctgcagttttatttttgaattatgttgctaacctttaaaaatggggatatttcatataaaaatccaagttgttgtggtattattgaaaaattgcagttctggcagtactgggcctacatttccctatagcaatatttgtctgaagctgagtggaggctgtttctaacagccacacaggctgtctagttcatcattgtccccataattctctgttgtcacatatccagctggctgctttaccacacatcacgtgcttggctcatggagacatttactctctgattaggaacccagagttcctggccaggcgaggtggctcatgcctgtaatcccagcactgtgggaggctgaggtgggtggatcgcctgagctcgggagttcagaaccaacttgggcaacatggcgaaaccctgtctctactaaaaacacaaaaaattagctgagcgtggtggcacacacctgtagtcccagctactcgggaggctgaggcaggacaatcgcttgaacccaggaggcagaggttgcagtgagccgagatcgcaccactgcactccagcctgggcgacagagggagactctgtcaaaaaaaaaaaaaaaaaaaaaaaaaaagatagaatctgagcggttgaaggtaatctgtagctgtttgaacatattttgagacatgactgtcaacctcagatgtgtatcaacatttcctgtggagctttccaaaaatctaccttttatctcccacttcccagctcccctttcagattcattaggtctacagtggagtcagggaatctgaatgttgaaaaagcttcccatttagttctgattttgagtaagatggagtaagcacacttcatccacggtcttccccattgtatgtggctataaagtctagacaagatgtacgaaacaagctatttgaggactctgaaaaagtaaataatagtagatagattggagaagaccagaatttaagacaccagtgaactgatgatgagtttctcttttgtctgtccagtattcttccacttgaacccaacatagcctgcaacctggaagcaggcatgaatgcagacaggaaagtcctctagttctgtttcgaggaacttaacagtcagagagagtctctgtgtgtatgttgggggaggagggagagattcctcatttttcattttgtttttttccctttctcttctttactctctgtgccatagctcccaaacaatccaagatggccaaaaagagcctaaaacttggagggaggaaagccttcattgccacttggagaagtggtggtcccaacagactagggagaaacactgttgcctcttttttcttctgttttcctactcattaaccccatttctttcaaaacgtgggtagactgagcatggtggctcatgcctgaagtcccaacactttgggaggctgatgtgggaggattacttgagcccaggagttcaaggccagcctaggcaacaaagtgagaccctgtctctgcaagaaaactgaaaaaattagccaggcatggtggcaaacacctgtgatcccagctacttgggaggctgtgttgggaggatttcttgaacacaggagggacaaggctgcagtgaactgtgttcatgccactgcactctagcctgggcaacagggcaagatgctgtttcaatatataaatatatatatatctttataagtctgcttatatatataaatatatataatataatatataaatatatattatatatgtaaaatatatatatattcactctgttctgccatatactctccatgtctgcccatatatatgagtgtatatatataacatatatatatatgacagctgtttctcagaagatgatcaaacagctacagattacccacaacagctcagagtctaccccagctcattctaatattttatataaaatattagacatgaacatatatatacatatatacacatgtgtatatataatacacatgcacacatatatatatatatacacacacacatatatatatataaatattagacatggaacgtgtatggcagaacagagtaaataaagccccaactttatttctggtcagagaaccaaaaagagtcccagggaagctgaaaattatcagggatatcaagaaagagggtgaagttagggaaaatgacttttaaagttttgtagaaactcctgggctcacctctgatctgggcatgaatagatctgaccctcaacagtatatacaaaacttgagaactaaactgcactgcaaagtctttgaaaactgaaatcatgttgggtcagtttaccaaaaagatccaacggtcctaaatgtatatgctcctattaggataattttaaagtacataagcaaaaatggacagaatggaaaagagaaatagacaaatccataattatagttgaagacatcaacagtcttctgtgagaaactgacagaacagacagaaacagatagatctgatggaaaatcagtaagagaaggaagtactgaacaccatctatcagctagatttaatttacatttatagaaccctccaaccaacagcagaatatacacttttttcaagtgcatggagcattcacccaggtagaccacatcctgggtcattaaaacaaacaaactaactaaatgtaaaagaacggaaaccatgcaaagtatgttccctgaccataatagaattagactaaaatttaataacagagagatagcaaggacatctctaaatgcttggaaggtaaacaatatgcttctaaataatccatcaaagaaaaagtttcaagggttattgtagatgtcctttatttggctgaagaagttaccttttattcctagtttgaatggatgttgaaattttgtcaaatgattctttgaactaaattaaagatattttaaattaaattaaaatgaaaatacatcaaaatttgtaggatgcaggtaaaacattgcttaggagggaaattctttaatataagcattaagagcttatatttataagagaaaggtttcacatcaataaactatgcttctactttaataatgtagagaaaagagaataaataaacccaaggaaggaatggataaagataaaagtagaaatcaatgataatgaaaacaggaaaacaatttaaaacaccaatagaaacaaaagctggttctttggaaaagtaaataaaattgataaacctttagcaagaccaacaaagatgaaaagagagaagacacaaattataaacatcaggagtaagaatactactgtagaccctttagactttaaaataatactaagaggacactacagacaactcttcatgaataaattcaacaacttagatgaaatgggccaattccttgaaaaatacaaattatcaacactcacccaacatgaagtaatttgaatatttccatgactattaaagaaattgacttcatagtttaaaaccttccaaaaaatcctagtgcaaataaatatattggtgaattattgcaaacattaaaaaaattctaaataatatcttccagaaaaaggaagaagatggaaaatccccaacacattttatgaggctagcattacctgacactaaaactagacaaagatagaatttttaaaaaagaaaaatataaactgatattccataaatatagatgtaaaaatcattaacaaaatattaacacaatatatctagcagtatataaaaagaaaagtcagtgggatttactgggaaagtgaggctgttttaatatttaaaaatcaatcaatacaatctactttattagcagtttaaggagaaagaccacatgattacatcaattgaggcacaagatcatttgacaaaatttcaacatccattcaaactaggaataaaaggtaacttcttcaaacaaataaagagcatctacaataaccctacagctaaaatcatatttaatagtaaaagactgaacacctttcccctaagatcaggaacaagacaaggatatccactttcaccactgttattcaatattgcactagcagacccagccaatgcaataaggcaagaaaaggaattaaaaggcatatagggtgaaaaggaaaaaaaatatggattctattcataaataacgtaattgtctacatagaaaatccaaagtaatacacacacaaaggtcagaggatacaaaatcaatactcagaagtcaattttatttttatatactatcagtgttcaattggaaactgaattgaaaaaagcaatactatttagattgctcaaaaattaaatacttagctgtaaatttattaaaatgcatacatgatcgatatgctgaaaactacaaaacattaatgaaaaaaagtctaagaatacctagaaggagagacatacaatgttcatgatcaacatagtaaagatgtcatttatttataaattgatttatagattaatacaattccaataaaaatttccacaggatattgatagatataaacaaactggttctaaatttatattgaaaggcaaaggaactagaagaggcagaacaattttcaaaaacaagaaagctacaggaatcacactttatttttttctttttttttgagacagagttttgctcttgttgctggggctggagtgcaatggcaccgtgttggatcactgcaacctccacctcccaggttcaagtgatcctcctgcctcagcaggagccaccaccatgcccagctaatttttgtatttttaatagagatggggtttcaccatgttggccaggctggtcttgaactcctgacctcaggtgatctgtccaccctggcctcccaaagtgctgggagtaatcacactttctaattaacagaaagcaatgtgttattagcaaaggcagagataatgaagcagaatagagagtccagaaatacacctaaataaatgtggctgactgatttttgacaatggtgctaaagcaattcatatgagaaggtataatcttttcaacatatttaaagagttaaaacagttaacccaattaaaattatataaaatgttttaacagatacttcaccagagaggatatatggatgtcaaataagaacacgaaaatgtgttcaacatcattaaccattagaagatgcaaataaaactgtgatgagatactgctacataacaattagaattgctaaaataaaaattactgctaataccttagtgttgatgaggatgcatatcatctagagctgtcatatagtactgatggaaatgccaaatgggccactctggaaagcagtttgtcaattgcttataaaactaaacagatgcttaccatatgaccctgtactcccactcttattctatagctacagaattaaaactgtacacaaatatttatagcagctctattcataatagcccccaaaatggaaacaactcaaagtccttcaacaggtgaataataaactgtgatatttctatacaatggaatactactcagcaattaaacagaagtactgatacacacaacttggatgcatgtcaaatgattttgctgaatgaaaggagcccaactcaaaatgtcacatactgtatcatcccatttgtattatgctcaaaaagacaaaattatggagacaaaaacaaagcagtagctgccaggggctaggggtggagggaggtgtgtgacttcatgagggagtttctgtggttgatggaaatgttatgtttcctgattgttgtgctagttccatagatctacacatgtcaaaatttataaaacagaacacagcaaaaagtcaatttcactgtaggttaatttaaaaccttaaaatatatttcaaagcttccctcttaatcctaatgtgctgtgcagcttgcgtaccacttctctggagcaactaccaatgctagacctctttatcaactctcctccaaaaagttagaacttattttggagaatcacagtaaagggcaagtaacttgcagcagaagatagacggtcatttcaaagcaagagcagtagagagtctgagagtcctttgttctgccaagtcaaacagaaaacataaatatttgtatagctttgtaacaaaagagcaatatgggttttggcagaaagacctcttaatcgcatttaagactttaaagtaatggagccctgctcctattatgtggaaattgcatgcagatgtagtgtacatcagggatcagggtcctgtctgagggagacaatgttaaaggtaaaacccagactgacaaggagggcaatctgtctacttgtgcagatatggtggagcccatttgctttttggcactggatcttgaggagattgcatgtgctacttagaagagtctctctctttctttctttcttttttttttttttttggatcactttgcagttgtgagttcatgactttctattttcagttgcacagatagccttttagttcaaggatggggtgttttgggatcaaagacagaaatattgagctatttggaataagtagagtggtgggcattgagggagactgggatttccagtactgcctcatccccacccatccaactgcaagtctcacatcctctctgcttccaaaagggagatatttgaccctaacttctctttccataggattcagtcaaatgctagtgcatatggttatgatataaggaaatgggtcaagtagaattattggggtgctagaagcaagaccaattttagattacttaaaaggaatgcaatggaaggataaggagtaacccagaatcaatgaaaaagctggtctcaaaaataataggaacctaggtggtaggaattatgtatgggcaatctctccagagaattatcttccagatcaaggaagaaatgacatacatttcccccattctcacttcactcaagattcagcattttcttagtatgagttgagtcgcatgcccactctttggccaggcaagaggagatcaccttgagtgacatacactggggaggggaaaagttctacaaaagtaaaccagtggtctcttgtcttcagcaggggttgggtatttgaaaggcagaaacaacagctttcagatcaccatggtgggttattctacattttaaactaaacacccctggagggtgtacagataagcaaagaaggggtacaggaaggagtggaaaaggtggtgggtattatggcagaaagagcaatagttttggaactagacctggaccagaactcccacagggattggccttcagctggcattacgaccccagggcaagtcagttactctgcctggagctttgctttcttcatctaaagactgaagaggctgaactagctgtcccctaatatccctttttgttacaaatcttaagaaatatatactttgggtctagggccataacttaatttcttagctgagtataaaactgtgttaaactcaataggattttttttttaatgcttatagcagtggtcttcaaatgttagagtgcgtaagaatcttatcaggattagataggtggaaaaaaaaatcccttgtaaaatgcagatttcagggccccatccccagagattctgatccattctttctgaacagaacccaagagtctgcatttttaaacaacgttgtcaggtaattccaatgcaggtgatcaaagctaaagacctgcacaccatctgtttgattcccagtccctagaaggaaaccccatccattggagctgcaagcacttagaaaatgtttaaagttgaacaactggacataccctttgaaagctccctcctaggctccctagatagtgtgaggatgcttggaatacagcagacaccagggtagccaggggctccaccgcctgcatattgggacacaacgtggagatcttgcattctctccttacacttgctcactcactctgactcaagtgtagccattcaataaacccaaagggtagagagtctgctgtgagtaccttgtgagttttccttattgttctgatcgtatgaagaccttaaatagaaccttttcaaattctatgtatttgggctcagcagtgcctgctttagtaaatttctggttgtaagaagtttaaccttcaggctaaacatttacactaaacacctctcatttggggagttacactgaagggagtgttgtccattgttttcttacgtgtagttatttgtgctctaccatgtatctggggatctccaagtgccttttaaaagtaatcagtttcgcatcaaggtgttccttacagacatgtggtttacaaatggtgaaggaatattttttatgtgtataaaatgcctgagtctttccctgtccactaccttgtatgatgctccattaaaatgtagcatggatgccaagagttccttggctttttgaggcaagatagaagagattggtcatttggcccagtatgtccttccaaatatatccagaggcctgaccaaatgaaagtgaattataacaagggtgaaagtaatttaaataatgtcacaacttatactcagttacatccaaggaaaccagttgtgtattaaaaccaataaatagtaatttaaaaagtaataattcaaggaggacattaccacaatgtttgaaataactatgcatattatatggtttacaatgtgcaacacactttcccatacattctcatttcatacaccctcttgtcttcgttgcgtccaaccttaggatagagagtgaatagggaaacttggtctatagcctctaacaacatgggcaaggcccattagggagaagaactctttgtagaggactgatcccctatttctttctgtgttctgtttaaaatgaaattgttgtctctgttcagaagcctgattggttgtgtacgtgctgtgcgtgtctctgtgtgtatatgtgtttaatggggaaacgaaggctaggaaaggagggagataaatttatgaaggatgaagtctacaggtttttattcttgctttatttttcactttctctaatactggggtggagaagctctgcatatactttggcttcatgaaatgttgacattcgagagaggaataaaagtgtttattctctagagttaaaaagaaactcaactcatcaagtgtgtgttctgttccacttggtcttataagtcatttgccagcaagatgagctttatatcgtctctctggtaaaacatcctcccatctcctgatcggcattcctccactcttttgcttcataaattagaagggaggatgccattgtaatacttgaccttataagggggaagagtggcccagccgttccttagctctgccctcctgtcagaactgtatacactctggaggccttttaagggaacgtggtgcgtgcagggaaaacatcccaaggcagaccatccattttctttgctactgcagagttggtgcctgcaagctctgtgtgactctgaagcataaatcataaggggttgctggtgccaagccggagggagggacatgtctgaggatcatgctcactgccaaatgcagccgacctcttagttttcactaaaatcccatctcaccactggccttctgacttttagtgaaaatttcacaagttgcacatcctgacattacttgtacttgcctccctgttgtgaattataatgatggctgcagagaagcaaccactgcctccttaaggtttcagtttatccttcctgcgctgtaccattcacttctgtacagtgaggctcgagtttggagagagagagagagagagctggctttgaaccacagggcttttttgtactagctctgaggccttggacaagtcatataacctctctgagtctcaatatcctctattaagaatggggaggataaaggtgataacatccttttatagtgtttagcacaatgcctaacacatagtaaatgctgaaatgttagctgttattattattattattactactagaagaaggctatagttttggtgtttgcagcaagtatttcctacagttccactatttcaatccagcacgctttttataaacaattttttataggcaaaacatatccagaaatacccatagaggtccctaagaacatcttggcatgattcagtgtacagagaatgggttctggaattggacaggacagggcctgactccctgcccggccacttaccagttcatagctttggacaaactatttaatctcttggtaattcagttttccagttagtagtctgaggatactggttgtttaaatacaggcatttgggttgccaggggcagaaacaaattaaattggagcaaagaaaaagaaagggtttgttgcaaacctatagaaatttcactgaaataaactatggtttattttacaagatggggaagagggaagaggaaaaggggctttgaggggaggaggggcttctacttgtaggcaaataggttgtcttctccagtagcttctaatcctagactcacttccttctttgaaatccacctttttgaagtatatttcccagtaaacaaaagtctgcaggagaggctaaaaatcacagaaatgtgacagtatgtgtcctccaaaggtatgaaccctctgttctgggacaggtctagcagtagcaacgctcttcccagggcacccaggtagccgagtcacccagggaggggttgtttggggagacacttagggaaggctgcgtgtagcctctcttgagacccctgcaccttcatgcacagcctgttcccacttagaggcttccacccagcacccaagagtcatgctaatttcattaacaaacctgcattaaccaggacctctcttctcttctcagttagctcaggggttctcaaactctttttctgtgtgcagccaaagtccacttgcagcaggagcaccacttgctacctgcagtgattttcaaagcagctggggctctgtatattagaatctcttcactcctgagtttttgataatccttcttacgcccattggaatatagtccagagatcattgttcaatcaataggcacccctcaagccctgttcattgccagaccctgaactgagttgatattcagagaaagacacagcccttgtcctcctgaagctgctggagatgcatgcaggggacagcatagtgtgaaaggtgttgtggcagaaatgctctaggtgctatgggacagcagattgtgggctgattgtgtctctctggggaaccccaggaggggcctctcattctagacttcttcacccacttgggctactatagtaaattaccatagactgagtggcttataaacaacagaaatgcatttctcacagttctggaggctgggaagtccaagatcaaggacccagcagattcagtgtgttgcaagggcctgcttcctggttcatagatggctgtctttttgctgtatcctcatgtggcagaagggtcgagggagctctctggagtctctaatgtaagggcactaatcccatttatgagggcttcaccttcatgaactaatcacctcccaaagcctacctcctaataatatcacgttgggggttaagatttaacatatgaatttggagtggacacagacctttagtctatagccctggggctctagctttgcttcccagaagctgagactgaaaggacaattaagactcagctagccgaagtgagggaagcagcatcaccaagccctggagggcaaaaagaatggcttgtctgggaattgcaagcctttggagtccctggaaagtaaaattgaggagtatttcctcaagagaggagagattcttttcctcaaggtgaacttcagctatgggtgccctctgatggggaccccatggtcagagagctttcaactcacacaggcaccttcccctacccaaggtaaggatttctgcctgttaagtgatagctgcatttatggagtgtttatcatgtgtcgcaactgcccccatctctgcctatgagcacgtgaaggcttgtagaaaagcagtgacttacccaagtccccaaagctagtgaaaggtgggcatcaggatttgaacccaggtttgtctacccaaggagccagagcttgtttcactctactgcacagcctctttaatcttagatgcaggaactgaggataagagaggataaatgactggcttacaagtgtcgcagaattaatagtgtaagagtgcaacttcaaaccccagtctgtcagattttaaatccagtgagatgcttacagctatgggggtagggtggggaggacaattgctttgcttacatttaagagagatgtccaggggaggcaagagttggacctcagcctgctggggtttgaccagtatagtcagcatgctcacatggtagactctcataccagcaccaatgttcaatgtcagttcaagtgtgaaccccttttgaggacctcttaaacactgtatgatacatgaatcaaaattcagctattaaaattgtgaatagagatatacaattgcatatgttaattgatcattgtcatttgtgtacagtttgtcttaactattttaaacttgcctaaaaacaagaatctctagaaataaaaaataaaaacaaaaacaaaaacaaaacaaacaaaaaaaccactgcttttaagtactgacacctgggctctaaccaagacctgtaacccagaatattctagcaaagaggcccaggaattcacatttttaattagcaccccaggtggttcttattatcaagaaagtgtaaaaaactttaacctcttccgaaggtgaatgatcaagtacctccagctcccccaactcagaatgttttacagcttgccaaaaagagggggaaacactgtccaagcttgtttgctaggttaggcctttaaggccactatctgggaattccatatgtgtaatcatactgtaagtttaataaaagtttacatcatatgaagtaaatttgccacttttatttggattggatatgcacatttggtttcatgaggggggaaaaatccactgtcatatttcatccagctagaaaatatgttataagtgaaggatcatttctcttttctgactcttggaacattgtttcaagattttcagagaaactcagtcaatagcttagtgctgggttagtgtgctgggattgcatgtgtctgtatctcatattcgaaatctgcataattaactgcattggaaattgacagagaaaatgtgagctgactgagagaattctgggatggaatgttcggaaataaatttgtagaaccttatgaaagcaaaaacaagatatgcagaatattgtaggaatggtggaggattcttcctgaaaccttattgtgcgagaaataacctaaggtcctgctgagttaaactatccttctgtgtccccaaaatacacagccacctacccacttgaacatccatacacaaacacatacaagcatacacacacatacacacatgcattttatccctcattggcactttcaaccccttgcctaggactgttgatattcatgaacccacttaaagacctgaaaacaattataagctccaaaatgaagacatccgcaatgccaacacgattaactgcgtaattgaatatgtataaaataccacatgttgtcactttattcttaaatttaatattcaagaaatcactataacactttagaataatttgtaggatatattttcttcttttgaaaggtttccagagtgtgcgtgagcaatatcattgccaatagttaattaaatgagtgacttgtagcctcgtcatttcaaaagcaaaattataaaaattctttcaagttcttttggagcaaaagtagatttttatgtgagatgtggacatattttaatatttttggtatgatatgggatggggcctcataaacacacattcagagagtttaccaccaccgaatgcttttgcacagggcacacaattggaaaaaataaaatatgccattcaaagttgggtctttaacagctcaaagatggtgaaaggctttcagggcctctctccattgtgtgactgtctctgaagggtgtagtctacttcctgctacaccagaattgtccttagggaacttgaggacagtagattctactctgcctgaattcaggtgaggccaatggtgagctgctgcatccagttgcataggatgtgcactgtgtaagggcaccacataccaagggggcattattcccattgcaaacaccctacacttgaatatttattatgacagcgcttcagcagatggcattaaagtgttctgttctgagaaactcagtgtgctacaatactttttaatagccataaattactggatcttgaagaagggatacctttagcacaaaaggcacagcttgggcttcagccctggcctgacagagagagaggtattcctcctgctccattcacctttatctccctccactgtaggctgtgggattttgacctaaagggactgctcaccaaccccctgccccaccacaagactgtgcccctgaagcagttccaagctcagaagccctggagtcttccattcctaccagccctttgcccttctaccaccagcaggcttgcttgttttctggcagttagtccctgaagtaaaagctccctgcccttctcttagtaggaagtttctcctaagcaccaagagcccctacacggaatggaaccacgcagaccaacatggcccttgcctcagtctccagagaaggggggagggtcagttaagtggccttctcatctccctggggagtctctgcttctccagttgatctcaggaacttcctgttctcaccaacctattttggtctctgtctcccatagacgactagaacctctgagagaggatcggtctcagtgcaggtagcactgcacgggtgatcctgaatgcaaacagctgctgttcccatctccttcctcttcccctaccacatcctctggatctgaaccccagaacaagactgctcaggggaacagagaacatgtcactcagataccaaacagacgtactgtcagccacattcactagccatgccttcagctgtccccactaggctagtcccagagtggatgctaaggcagggctgcccttccctgctgagttcagagcttagtgcaaactaggacctggaggaggggtatctctgcttccaaggcatcaccttccaacatctcctttctcaaggctctttggacaagacatcttgctgggaatccttgatgtgagttaaaagcatttaacatagtccttcttctcccttgctcttcaaaagtgttcagtaggagtaaattcccttggaccccaccactatcatagtcctatgaagaaaatattggttggtaaatcttagccagcattttcccatgtgtgctgaatgaaaccaccaactccacaaggtgctctgtgtaaatgtgagaaatgtatactctaccctctttgtgaagttttacaatgaaatgagcatttggttttgaaatatcctgccaaagtagagagtccacttttaccatagtctcttaccttttcataataaatttatagcactggacttggtaaattaacatataaggttattaaccttttcagccaaccctttgtatgtaattcctttggaaattcatccaccatcgcttaattttatcttaaactttctggtttggttttgttttttgagacagggtcttgctgctgcccaggctggagtacagtggcataattatagctaactgcagccttgaactcctgggctcaagcaatcctcccatctcagcctcccaagtagatgagactacaggtgcacaccaccacagctggctaattttagtattttttctttttttgagccaggagttttgcctagggtggtctcaaactcctgggctcaagctatcccccctccttggcctcccaaagtgttgggattacaggggtgaacatgctgtaatctccctccttatctcaaactttcaatcatcccatgtatttgcttccactggtattttaagaccaagttctggaagcacctttatattaatgtaggaggagtccatgttctgatgggccccatgaagtttgcatgaaatgagcaagtgtctttaagcacttaccttcaagagactaacggattagagaaggagttaggtgtcccagcatctaaggcaatatcctgtgctgagtgtctaactcctggggtttgcagtggcagtacaaagagaggactggccagataaacctggaaagtaaggaagcggcctaagtccaggagggggtggatgaagagtgtactggtgtctttcattttccttcaagacctccactccatctctttctctctgctccccgtcctgtagactgacctatagggactatcaagagatccccacccttccctccagattttagttgggcttgggcaattgggagcactgcagttactagacagaaggaggagaatgcaagcagggatttctttctctccctataggatttccataggctggaaacatgactcttctgaaggtcaaggttcctgccaagcagccctatccacacagatctgtccctggatttcagtaatgaatctagggatgggacgctggtagccctgatgttacttgccctctccactagccacacctgtgtaaacagttcctgtattaaactctcaaactactcagttttgagtgtgccatcaattctgttggggacctcattgatacaaggagtatccctacctaagtgaacgatgtgtgcaaagaactgaagtggcctggtgcttgaagggggctccatctcaaaaatagtttgttatggcaggatgatgccgcagtaggagagttcatgaggccgatcactcttgccgatgcccacggagtgctctggggatccagggctcccaggcctcatcgcatttagtccccactgagtaaggagacatattatcattccattttgtaggtaaaagatccaggcttatggaggttaagtaacttggccaaggttgcactgcaagaaggggtggagctgcgtggggactgagagtccctactctcctccgtgctaagacattaaactggattccacaggcagcgcatgtttgcctgcctttcctgctcactcagccttagcttttgctgtaaaactctcacgtcccacaaaagaacattgacctttccaatattccctttcctcgtaactatgtgtcattaaactgaagtgtttctttaaaagacattagagcagaattagtatggcatgacctttccttatgcttcctgataaaattaaactcaaacctgggtgaccgaaggaaaccctgggaaggtaaatgcagtcttgaagatggttcctttcaggcagggtggctgcctgtgcatcccttgatatatgctcgtcttctcggaaccatgcagagagagctgcctgtgacctgatttggcttcataggaaacagcaacctgcgtcatccattgggtcacagatcagagttacacgatgaaatgaaacaggtggaatgtggtgttcaatccatggtattctgaacccaccatggacagctgacactcacattcccaaagggaatgcaaagttttgcatgttgccctgctcagggcatctccgcctggaatcggtagagttttggccctgagagatattaatctattgtccaaaaaacaggaactccctaaagagagccaaaaataagaaccatacccaggactgatgaattcttttctgtgatattggtggacaggttagcaggagaaaaggaaggggaaatgttcatagtacacaaagtataagcatcatctcttagttaaaaaaaaaaaaaaacaggaaaggttttgagttctattcatgtaaataaaaggcactaagaatcttgggaaatgtccaggctaattaattacagttggcttcaggagcatgcacagacttgccttctgccatcagaggcatagttatcggggagggtagatcttccaagttcctccacagccctggtggcattggtgggttctggctgcttctctgagccaggtggtggtgtgtctcttcatttagtctcattaattcttcagtgttgcaaatatctgaaacctgttattaaagagctggaacgatatcccactaggttttcaatatggactattgatgaagaaacagtaattggaatagcaggggtctgagataatattgcaagacaaaagaacatacaatttcttttttgtggctcttttgcattctataatttggtggccttggactatggctgtttgtcgctgtagaaataaactacagcttgtctagtgcctttctgatggataataggttgcttctgatttagctctatttctctttcacatatagtgtggtaataaacatccttgaacctcatcttcttgtgcgcgtgtgttcaagtttctctaggaaagataccagagaggggtttgctggattatagggcatgatcaagtctactaggaattctcaaacaactctgagtgtaaagtgagtgtaccaacttataatcttgctgtctttttttttcttttctgttttcccatgatacttcaccaacatttggtattagattttttctttttttttctttttttttgggggtgggggggtggcaggagggacagagtctcgctgtgtcacccaggctgaagtgcagtggcgagatcttggctcactgcaatctccgcctcccaggttcacaccattctcctgcttcagcctcccgagtagctgggactacaggtgcctgccaccacgcctggctaatttttttttttttttgtatttttagtagagatggggtttcaccccatcagccaggatggtctcgatctcctgacgtcatgagccgcccgccttggcctcccaaagtgctgggattacatgcaagagcactgtgccctgtccttttttttttttttttttttccttgaaacagaatattactctgtcacccaggctggagtacaatggtgcaatctcggctcactgcagcctccacttcccgggttcaagtgattctcctgcctcaacctcccaagtagctaggattacaggagcccaccaccatgcctggctaattttttgtatttttagtagaaatggggttttgccatcttggccaggctggttttgaactcctgaactcaggtgatctaccctcctcggcctcccaaagtgctgtgattacaggcgtgagccactgtgcccagcctctttttttcttatttggctaatgtgatgcatgtgacatgatacctggctgttattttaattttcatttccctgatttactatatattttcatattggccaatcagtcttcttcttctgtgacttgcttaggtcatctgagtttttcttatcagtttgtaggacttcttcatttagattagccattaatcctttgattttatgcattgcaactatcttctctcaatctatggcttacttcttttttttagtgtctttgacaaatagaaattttataatttttaatgtgattacgtttatcaatctttttcttatatttagacccaacttatagaatattctgcccattctttattcccccctcatagaacatgggacagacagtgaggtccctgtggccttgctgaaacagaatccaatatgaaataccatagcaaggaacaggtatttgctttgggaacactgataatgccattgtatttcagtggatacccatgcctcacagaattactctgttactcatagagtagtgaagcagcattatacaaatactagtcttctctgttctttcttcttcttttagagtgagtatccatttatagttgctgtatattcatttaatgtccagtgcctagatgtgtcctttccctcatgtcttatgacatagattcaataagatttctataatactatctaagaaaacatgctaattggatatagaaaagagaacaaacaaaaatagtttaagagacataaaaagctttgttttacagaaatgctttatctcctgggttggagctgtcatgtcagtaattatcacttttagtttataggagtgaatgaactgattttaaatcttccaagagtattatataagtcatttttttttaagcttcagtaagaggtctgtataacttggaaaatacaaagcaaagcaaaacaaaacaaacagataagaagatgattcatgtcttgctagtctgggaacaatctcatggaagcctgaaggatagctgacaattagctcttgactatctctcaacttagctggagcacttgagacttaaaattccccagccctagaccctcggcaatgtattttctttgaaaataaccagagccaggaacagcttacattaaagtgctcaagcatcaaggctgtaaacacagacagttgttaattccccagatgtaggggtccagattatttaacagttgaagagagtgaacctgtggtagtttcaattttacattttttttttcttggatctttggtcaatttcctaaagccaagtttttcttctttcaattaaagttaggattttcagaaatctgcctgcctatgttgcctaacaaaatttaagatctaactgggaagagtcctcttcttttccccatgacacctacctaaaatgaaagtggagaagcttctaggtaaagcggcaaaggcccatggggttggggtccacctttatttgttttataattggtcaaactctagaagtttagagatactatgagacatgcagttatcttttgctttttcttttaaatattctttaaatgatatatttagttccctttggtttaagtgaaatgtccagtactaagagcagtgataatatcgcaactctgtaggccattttgcaaaattatatactatcccatttgaacctcacaacctctctgataagacaggcaaggcaggggttatttaatatgtggattttgaagtttagaccaggctgaaataatggaggccccaggattgaatagcactgtgctaaaatttatatatatggttgaaaaacttttgtagttatcttattttgatagcctcatgttttatgttcattttattaatacctgaaagtgtgagttgttccatccaaaaaatgggtttaagagtagattttaagattgctattagaaaaccaggtttagctgaactctgcctcattcatatatgaaccaggtaggctttcttgaaaaggcttttaaagtgcaaactcatataagccttttaccatacagcagccccagccagcagtgctagacatcaaagaagggatctgggagtgaactcatcaatgtgaaaatattgaagagctaacttgagggctgttgtgtttaatgtctgttagacattaaccagcatatccaggatgctattaaactccatcttcagtagtttgtttcttgggattgtgtaaacatcactaattcaaacatgcacttagtcataaacactgcagagagctttttcttttaaatatacttttaattgaagtataatggacatacagaaaaggcacaactcataaatgtttacttcaaggaatttttcaccaaatgaacacacccgtgtaactaccatctggatcaagaaacagaatagcacctgaagcttccttgttccccattctgatcatttattctctctcctcctgagacgtaaccactattctgacttttcccatcaatgatgagttttgtctatttttgaatggtacataaatgaaatcatagagtgtatattcctctgggtctggcttattttactcaatgttatgagtatgacattcattcttgttgtttcatctaatggcaggcagttcatttttgttgttctatggtactcctttgtgtgaatacaccacattaaataaatacaccacagttggtactaatttgcatcccttcaacagtacattagggctccacatctttaccagcacttggccgtaccactctttccagctagtcttgtggatacatagtaatatttcactgtggttttaatttgcatttccctgatctctagtgatgttgcatttccctgatctctagtgatcttttcatatgctaattgttatttgaatatggtcttttgtaaagtgcctgttcaaaacttttgcctatttttttaaggttatctgcctttaaaaaaaactaatttataagagtttttaaaatataaactgcatgtaagtcctttgttagatatatacgatgcaaatatctttttctaatctgtgtatttgagggtcttaaaaggggtctgagagttcagtgtgtagaaaatagtaccatgggcccttcttggctcttaagaaagtggacatttgaagatagaggaatggaagagagacctggatcttgtgctctttaaatctatcacaactttcttgaagtaggattccaagagcagctggatatgcctcacacacttgatatgatcagtctgtgtttttttggctactctcttgcaaggtaaacagagccatcaatatatgatattctggtagactcttatcatacataatgatatagtgctttgggttaataaatatttgaatacctactatgagcaagcactggccaggacactggaggtgcaaaggtggatatgtcagcacccctgtgcttagtgagctttcagggcacttttaaggtacttttgtatctactatcctgtttgatcacataagggtagggtgaccatcagactggtcagataaaaataatgtatccttttgctcctcaaacctttgaggatcatttagtcactgcccctcattctgtaagaactgtctttctaagatatgcctttgccacatcctgatagcctcactaattcatacctggagaaattcttttttctcaaagtgactaatttagataaagcatgcagaaatgactttatattttaaagaaagctacaagagtcaaagaccataaaatagatttacttagtcccctgctatttaacagcccttttaacaactccttaaataatatttattagtcaactgaaatcatatagcatttattgagggcaagtctggagaggcactgttttattctagacattgaaggagccatgaagacatacaagatgcaattcctgcgctcatggaagttctagcacattggtggtggtgatagtgtttgtgtgtggagggaaagtgttcagtaagcacacagcatattcaagaacaatgtgaacataaagacccataccacggaagctccgcagcaggaagggtcacgttggattgatttcagtgatgaggaaaggactatactcattaagatagtgtcgctgctactataaaaatatccccaagatgtataaccactcaaacacataaaaaggtgttttcaatcccctaaagttaaaaacaggtgttcctgattcatagttgactctgttccaaatggtgattcagagatccaggtcctcccctctcgtgggtcagccgccttcaacacatggcttttaagattgctgggcttgtccacatcaagctggcagaaggagaaagaacatggaaaatggaaagatcttataaccagatctgaaagaggagttccattggctagaacttgagtttcattggctagaactcagtcacatggccacagctaatttcaagggaggttgagaactacagtccacctgtgtgtctgaaaagatgagatggattgttgaccacgtagcagtcgttgccacaggttttgttatggtctggatgtttttgtcactttcaatattcatgttggaacttcagtccctccaaaattcaggtgttgccaatgtgatagtattcagagatagggcctttaagaggtgttcaggccaggagggctccttcctcattaatggcattaagacccttataaaaaaagcctttacacagcatttggctagcttttcctgctgcctttgccatgtgcagcaagaaggccttcaccacaccagatgctggtgccttgatctcagacttcctaacctctagaactgtgggaaataaatttctattttttataaattatctagtatcagctatcccattataagagcacaaaatggaataacaggctttatgctggaaaagcatttaaggtaggtcttcaggcaacttgaagtattctgacagacgtgggaaaggaggattaatccaggaaaaatgaatagcataaagaaggactgggcagtatacaacaacaaaatttaagggcatatttggaaaataggaaatcattcatcttgttagcagcatagaatacatagggagtagtgtgggagaaactgttggaaagctaggttgatgcaatttccaacctacgtcacattttaggaggttttaaaattctgactaaagagttatatccagcatagttttcaggctccttctcactcgcaggaaaaaatgtggcccaggttacctttctttttttcccttcacactctggcctttcctaggaagtgagttctcatgtttatctccccgacacaatggcaagcagttagggagaagggttcagcccctcagcatgggcagcttcgttttcagcttttgtactagagaatttcagagattccaggggctttctgccaaaaacccatctaatgcatggtatctgctgaatgctgtgtttgggatgaatcccaagttcaggagagggaggagagagggaaattcctttttgaccctaggacacaattaactcatacccaggatcctggaatttgattacccatattgttattttggcttggatagctgcaactgtggctcatagttataaaagtatccggtcctttaaaatccagccgcagctttcagcttgatgacctcctgactgattaattggaaagggtgggagctggggaaatccttttccctcccttcagacctgccaacttggctttgaacctacaagaatgttttggtcagagaacatacatccccacaccccgtaccctccctctcaccctcacctctgccccatgttgcgcattttatttgttatccatatgcattcatctttgttgaattaactttgacccaggcttgactatgtgctgccccagaaggcttctgtgtgacttattctctcttccttgagtttctgatgatgaaattcatgttattctgaccttccatagccttctgaccatgaaaataatgttattataaaggtaaatgaaaatttacctttgctgtatagtttgtgggtggtttctttcattgttcctaccagaatgtaagcatgattctatatctttcttaaaccattgaaaaagagagaagacggaatatttgaagtaacagctgaccacctgaaaagtgcttttcaatgcaaactggaagaggcagcccacagtttttcagtcctgagcacattcattgtatttggggtttgtgaaaagggaggtgttcaccttcccatggcaagagtttctagatgttttttttttttttccttatttgaccacaaagccaacctaaaggaatcattactatgcggcgtattttatcctgtgtttgtctttcttcctcttctttctcaagaccctcattgatcccactctacggtcatcccctgcactcacagccttcaaataactaaatcttgctgttcgtaggcatttggtgtttttctctttcagttgctagctctggggaagatgaaactcttcaggccaatgtctgtggtaccagctcattccctagcctgctttgagatctacatccttcatgaagcactaagacatttgaagagacaggatggtgtaatggaatggaacatgaggagaaattaagcagatctgggtcccaattctagcactgccccttacctctgtgaaactttgaacaaaaacttgacttctctgagcctgaaacttgacagcattgataagttttcgctgttttttaattttatctaagtggaacaatacagtatatacacctttgttactgatttcttttacttaatacagatgctctttgacttaagatggcattgcatcctgataaacccatcttaagtcaaaaatattgttaagtcaaaaatgcatttaatgctggcaatacagcagacagtctctgacatatgacggttcaacttaagaattttgactttatgatggtgcaaaagtaatagccattcagtagaaaccacaaccccaccataagtcataggagctcctcaacttacgatgggattgtatctggataaaccaatcataaaggggaaaaattgtaagtcaaaccatcataagccagatcctgtctgggttatatttatgagattcattcaaattgttgcatgcggcaatagtttgcacaataggatttatggtattacattgtatatcacaaattatttgtccattctactttgatggacatttggattgtttcagttattacaaattgtgattctatgatcatacttgtaaaatcttatatatacaccctgttgagcaacattgcacactaggttccccaggaagcagctctaagagatatttgctttcaggaagtttattcctttctgcctttaagatcaaagttgcattcaagatcaaaacttataggggagtgaggaaggaggattgaacacagagaagttggattgaaatgcagtcacaacaaaggcctcagccaacttgtggggagctctggagctgaaatggccctctagagttgtgcaaaatttgggcaaggaggccaggcctttatatatccctttataccagtcattgcatgtggattaacccaggcatgggaacatgatttggggtgacacatttctctttggcagagaacaggggccacatctgcgagctgtcagcaatcagccttcctagtagctggtagaatgcatatttttatcctaaaatgtctaaagtgtgtgtgtgtgtgcacacgtgtgtctaaggggtagtaggtgagtgggtgggggtaaatctgagcagtgcatcacagttcatctttagtagatactgttaaacaatattcccaagtgtttatgcccaaataccctcttaatttagattctgatatccccacatggactctttccaaaaagataaagaaaaatgtatagaagtgaaacaaatgtaaaaaatattctgtatattaacttattattttctatatggtggagaaagcaaaattgagaaccattgaaatgggttgtttattattttctaacttatggcttgatatcctgaaatctgtcaacactacccaggttgttctgaaatctagctatggatttagtagatcctaaagacttcctactgtgctgagaaaaaaaaacagaaaatgaaatatatgaattgacttttctcaaatttcatttttcagagtggccaaatcaatgaaggtccctgtatatgagaccccagctggatggagattcttctcaaatctgatggactcaggacgttgcaatctgtgtggggaagagagctttggcactggtaggctttgttgggttgatattactggggagggcggctgcagccttttgtgatctcagtttggagatctgtgaactttctgtgaattacagaggaacagttaagtagaggcaaaaaatcagagaaacctagtagagtatgtgctgtgatatgcttacctcttttgtccattttgtttcttctttttagaaatttctctttctttaaaaatttctattatggaaatctttaaagtgtataagagtagagagaatatcgcattgaatccccatgttactgtcactcccatttcaaccaccataaacttgtgatcaatcttcctttatctctaccctcatccgcaggggaacactcctccctgattattgtgaagcaatcctctgtagctcattgttttatccgtaagcatttcaagatgaatctttaaatataagggctcttgttcagaaaaaccacataaccacagtaccattatcacacctaaaatgttaaaaacgttttctttttttacatactttaaatacttcatccagttgttttctggcttgcatcatgtccaagaagtcggatttaatttttatgtttattcctctatgtaaagtactctgtgtaaagtaccccccagtctcctgcctttggctgacttcaatattttttaatctttgattgtcaaaagtctaatcatattaataatgtgtctaggggtgtatgcatgtatgtatttaaccctatgtgggattctcttgaattcttggctctgttgtttgttgttgttcattaattttaggaaatgctcagctattattttttcaaatatttctccttccccattctttgtctcttgtccttctgaggctccaattacacatgtgttagataatttgtgatgacaaatgagctcttacattcatttttctgatttatttctccccttttttcttcttgtgtttcagtttagatcgtctctattggaacatctttaagttcactgattctttccttagctgtgtccaatctgctgatgagcctgttgaaggaattcttcttctccgatactgtgtgttttttttttttttttagcatttctctttgactcttttaaaatagtttttagttctctgaaattccccatctgtttatgtaattgtttatctttttcattagatcatttaacatattagacatggttgttttaaacaccctgtctgatagttccaatctctggttcatctctgactttggttcagctgattgctttatctcttgacaatggtttgggttttcctgttttttgtagatctcataaatttttattgaatgctgaataatatgtggataagaacagtagatattcaggtcaattgtatttatgcctagaaatgggtacaacccttttttggggcaattagtgtggaaggttaagttaacctagtcaagcggtgatctgggtttgggttttactgtttctgttttaaccttcagtgtaccacaggcctcaaattcccccagcagtggcatatttttactgggtactggaactggggaagggtactggagaggtttttaagtgttcctgtttctccctcagttttcagtagtgactgcaagtctgtaacacaaaatacagttctatctccagggtcttaaactttccctggtagcagagacctctgactagtattggtgcaggattctgagcacaagttttcctaccctctccccagaggcagaagagtttttacttttgcccgtctctcagagacaatagatctctttctggacctggggatgagaaggtttttagcgtgtacacctaggaacataaagcatttgtttcatgtaagagaagggtttgggggagcagaagggcttcatccttgtctcccagtgacagctgatcgtcgcttgcatacctgtaccaccaagtttccttctttgttcctaattttttgtgaggacccagtggaaatctgtggaaaagaacttaaaaatgtgccccttgtatctggaaccccaggtgattttaaagtaatgtaaaggcctatactaggcctttaagaattttttaaactcttacatgatttcttattatctggtttttatggcagcctcctctttctcctatgctttgccaaagctgagagaattttcaggatctgtctctccttggagtggctctttggaattcacttgactgtgtggtcatctcagatctctgagttcaagaaaacttaccatgtttgagatttcctggccttttaccattgctaggatgggaatagctttctcttactgatttgcatatcctaaagagaagtacacaagtggaactctaaaagtaatttcttaataatttcctctatcctcattttccccctccccattaacagtttgttctaattggatctaaaagatcttacactgtaattggctgatatgtctcttaagtctcttttaatctacgtttctcttctttacattttgcccttattatttattcattgaagaaactgggtcatatttcctatagagctttaaaattgctttgattttgatgctgctgtcctaattttcctttctaatttgcttaatgtttatatgaagagaagctattgattaatatgctttttctctggtttgcaacttccttagttgcaattatagtaattattaatttaattatcatattaattgtagtggattttttttccaaaaactctatattctcttgggattttaaaatatataatcacataatctatgaataaaatattttttgtgtttttcccctaaaacctacaacccaccctcccttccttccttccttcctttctttcttggctcaggtgcacatgtgaatgtttgttacatgagcaaactcatgtcacaggggtttgtggtacagattatttcatcacccaggaattaagcccagtacccaataattgtcgtttctgctcctctccttcctcccaccctactcctcaagaagacccggtgtctgttgtttccttctttgtgttcataaattctcatcatttcgctcccacttataactgagaacatcatgcttatatagactattgttcccattcctagttacttagagtcttatatattgtatacaataattctgccactagttagtcaaataaatctagcaactggaatgaaaactggtaagtacaggttatcccttttctctgtctttataagcatttattaagtgtttacaatatattatagacttttagtttccaattaaaggggtaaatattccatgtgtaagccatgttacgcttttagtaataagtatttgcctatttcaattcaataaacatttactcagtgctgacagagtaccaggcattgtgttggatggtgtgtagaatacaaaatgctcaacaccacacccttcagaattttctaataatttcctctatcctcattttccccctccccgttaacagtttgttctaattggttctaaaagatcttacactgtaattggctgatatgtctcttaagtctcttttaatctacgtttctcttctttacattttgcccttattatttattcattgaagaaactgggtcatatttcctatagagctttaaaattgccttttaccattgctaggatgggaatagctttctcttactgattttcatatcctaaagagaagtacacaagtggaactctaaaagtaatttcttaattgctttggagatggactcttgctctgtcacccaggctggagtgtagtggcactatctcagctcactgcaacctctgcttcctgggttcaggtgattctcatgcctcagcctcccaagtagcaggaccacaggcgtgtgccatcactccctgactaatatttgtatttttaggagagacaggatttcaccatattggccaggctggtctaaaactcctggcctcaagtgatccgcccaccttggcctccgaaagtgctgggatggcaggcatgaaccgccatgccggccactattactttttactatgtgttctttaaaaactaatgtcaatagtcatacaaatttgccaactaaaatcaagcgatgtaacaatgtttattatttccaagaaagtactctgttgagtctttcacagaaataatagtgttttttaaaaaaaaaatgagcacttagtatgtaccttttgtatgtattcatctttttctagaaatttggaattgaatccagagctgctggcattagcatgagttgtccatacttgtcacaccaaatttttccactgtgaactctgaagtacagcctggtgctcttgaagttgactgttttcatatgtgcccaatttctagcacaagaaggggccctgagtgtgtgtgtattctgtgtcacaaggactcttgagtatctttccagtcttttgaggtttgctggatgcttccatgcatggattccatgccaatattgtaaatgccctgaagacagggcccatgtctatctttctcagctctatttctttgatgaatggtaggccctaagtaaatgcttgtaggatgggtggaaagataaaaggatgaatgggagaagggaaggaaggttggaaagatgaaaggaagataggtgggtggaaggaaagtacaaagaattttcgttttgttatctcttccttgtattattagtagttatctttttgtcatccttaaatggatgtatttctgaagatctgggtatttgggtatcccaagatttgggaagatttataaaacaaaatcacacaaatacagaccatttggaaagggatggggagagatgttatgaatgataacaaaattagaattatataaaatataatctttaaatattttcaatcatcataattattagcacaaactaatagctaacaacatgcttctagggagatctcccttcctggaactagtgttaataaacagattttaaattatttataatttattatgttaacttgtttatttcttatgcctgtagttgttgacaataacagaaatagccatgttcaacagtgggctaggttccagctttagtgatcttttgtatgcaccaaattcttactgactttagcatagtcattttgtgctctgttgtcttatggtttatgttatcattctccagttactttgtgaatgagcactttatttcccctgagagttgtagagtttgtaacatgtttagggccatgcctctttcttcatttatatttcacatatgaatgatgtatatcctaactgaagattgggttcacaatagtgctgttgcacaaatactgagtaagtttaactgtctcttatttatacaattattacatttactattttatattcctcaaaaggtaaaatataggaaaactttagtccattccctatctggatggttattccctctacatttgtctcttttcgcatctgccgattctagtctctaggagagagaaagaggccatatatccatgcatttcagattactgaggtcctactgcacttctttttcttatttgtggccagtgtgtataaatttggctgggttgcagatgtgcggtgtggaggccatgatgacagcattatcagtgctagatgagcagtttctctgtggggctatttgaaacaggctgagtgcatgtgtgcatttcaatctaggctgggccagagcacagaggtgctatgattgacacccccgtgagccttcttataaagccagaaaattgaaactcccttctgggtcctctgtgaatgatcaacccctgtgccgggaaacagaactctcacttagcattggaagaatgtctccatcactaagatccttttcttggaatctcaatggtcccagttccattgatccttctattaatcctccaagctaatgaaaagtggtaagagggagtgttgtgtgacacctaagggtggagcaaaaacaaaggaatggggcttctgaaaccacatctgtactgaccagagtatcctgggactgactgggagtcctgagacatcatggctcttagtcagagactgaagacttccaaacagactaaggggttcttttcccagtgtctagtaagggacttttaacaaggagaactgtcccttgggatttaaaatacaatccctaaagttgtgcttcgaggcttcccaatctgcattctaggagactactggttgctaggtggccccactgagaacacagtacagtgactgtagaagtgacaggtcttcaaccttaaaagccactggagagatttttgattcagtgtatgacctgtcaagaaacaattcttaaacaggttatggtggtttgtgcctatgtgggaagctgaggcaggaggattgcctgaggccaggagttcaaggccagcctggtcaacacaaaaagaccctgtctcttaaaaaaaaaaaaaaaaagagagactcggtgcagtggctcatgcctgtaatcccagcactttgggaagccaaggcgggtgaactcctgaggtcaggagttcaagaccagcctggccaacatggtgaaaccttgtctctattaacaatacaaaaattagccggatgtggtggcgggtgcctgtaatcccagctactcgggaggttgaggcaggagaatcacttgaacccaggagatggaggttgtgatgagccaagatcgtgctactgcactccagcctgggtgacagggtgagactccatctcaaaaaaaaaggacaattcttagagtcctattgttcctatctgccttggtgacaaaaaaaaaaaaaaatgagttgggatgtatgagttaggagcatgctggtatgctctgtgagggaagcatgtcagctggctggccatgatatggttaatgtgctccctgctctgggatggatggcttgatgcctcctaagtgatagacacaattcctagtgcctcctgtactttattttagagtcttcttcacaatgatggtatagagaccctaatgaccccattttgttgatgaagtcgttgaggtttagggaggaatgtcaagccgctggccaaagtcacactggctgagccacaattcaaacccaaccttgctggcttcacagtgtctgctgctgatgttttcagttcatgctgatgagtcatttcccaccctccccaaccccctcctggttattcttttggatgaaggtagaaggaatgccaggggacttgggagaatggtctcatgtaaacagcatggcatgagaagttgagggacccagcttccatcttgactccccctctcttagacaaatagcttagcttctctgtgactcaatttcctcattgcgagacaacttcgtctgaggggatgatctgtaggtttcttccatcatgatatttcaggttgcttctaactagctacccttagtgaggagcaaacctgatgaattatatgcactacatactaaagaggcattcatttattcattcagtgaacatttactgcacaccttctatgagccagcccagggtagagtgcgagtaatttcagacacaggcccttccctcagggagtttatagggtgttgctatggtcaggatatcagccttgtgtgaaacactatttattactattttacttattaaatgtgttgtgacacagaattattcactgggagccacattgcccacagcacaggatgtgtcctttgctgctgtctgactcttctgcgcttgcacctggctctgacttacatgcaggagagctttgttctctaattgatgaacattaggtacatttaagaatatttttttaagcatagaaaggtgacttttttttcagtgagccttgctttttcacctgatgttaaagatctgaacataagtggtttgagaaatgaaaatcaatctatctatcagtctaccgatcgatcgatcgatctccatcacaattctgtagcatgttctcaaatctcagatccacccaaaaagagtgaccccactttaacctcataactccactatttttcaaagacaaatctttatcttgagtagctgaaaaaaggatgagaaggctgcaaattaatgaaaaccatttctaaatgaaaaaaggtaaactggagaaataaagggaaaatttgcagcttgtcctttagaaagcctgccccagctctcaccacataggatgctttacccgctttcttgcaactcctgagggccacagcattgctgggataatccagtggcagttaagtccataggctttggagccaaattgcccagcttggaaccttctttttaccacttagtagctgtgtggcctcatacagatgacctaagctcaatctcttatttgtaaaagggggctatcaaattgtggaaattaaataatagatgcataaaatcccctagcgcagtgcctggtgccttgctgctttcttcttagaatggaatttatcctccttgtgattgtgcttcaaaaataatcaggaacctctttgagtgagtggcctctcttattgtatgaccaacaatcctggtttgtccaggactaagaagtttcatgagatgtgggactttatgtgctaaaagtgggaaaatcccatgcaaaccaggataagttggtcactccaaagctggcaaagtcctcagttttccagatgaaaatggcaaggagaaatcttgatactgaagctgactccagtgagaacccccccatgtgagcaaggccagggccgtgaattaaatgagagacccatggctgctttcccttagcaccacattcaagcaaaaagaggaagaggcctcactcactacccccaggcattctgccccaaacatgagactgcatacggtgcctttctgctgaagcaagtgactttcaagcccggctgcctgtgaaaatcacccaaggagtttttaaaaaagaaataccaatgcctgggccccatcattaaaagtttttattttattggctcagggtgagacctgagcatttgtatttttttaaaatctccttgggtgattctaatgtgcagtgcagggttgaaaattgccaacatatgttacaacttggagttggcaacaggtgcaaattgacttatagttttcctaattgacaaatttagaatttccttatctgagtttcagctgtaatggcttgatctgttagtaatgcatgggatgctttattgagctgatgtgtccatactggtgtttccatgtgaagaaaacatctttaagatgattgagcattctctttatttttcccttttcttttgtgagggcaatatacttattagtgtcctgcctagctcaagtagcatggttttgaagattgagaaaattcaaagtttaatttgagtggagggggaacagtgatatttctctagaaaaaaaaaaaggccttcttttttgtaccagtttttgctggagtcatggcagagaagagctgagcgccctccttctggtatgtggatggagatggctgcttctcagggctgctcagagtaagattgcgtgggctttgggctgggctaggttggatgagaaaggcaaggtgagtggtacttacagctttggaaatatgggtatattctccctgcaatgtcctgagccaggcagcaagcttcaaaaattgtgctggtgttattcaatgctaaaaagacactcactctcaagccataaaaagacatgaaggaaccataaatgcatattattaagcaaaagaagacaataaaaaaatacatactagatgagcccaactatatgactctagaaaaggcatgttttaaatgtgaatttctatgcaccattgacaactttgtttactttatttttatttattgttttttttgagacggagtttcactcttcttgcccaggctggagtgcagtggtgtgatctcagctcactgcaacctctaccttctgggttcaaatgattctcttgcctcagcttcccaagtagcagggattacatggatgtgtctgccatcatgcctggctaattttttttttttttttttttttgtatttttagtagagacgaggtttcaccatgttggccaggctggtctcaaactcctgacctcaggtgattcccccaccttggcctcccaaagtgctgtgattacaggtgtgagccaccgtgcctggctaacaactttaaaaatttatttttttcttatgaaataatacgttgttattgcgaaaatatttaaaaggaaagagaggaaaagcatctgcagttctaccacttcagagataataaccatgttaagagtttggtgtatattcttctgtttacttgtgtacacacatatatacatatctatattttttataaaaatatactgaatattcttttttagtaaactgatttttcatttattaaaattgaatgcacaattacctattggatacaatgttttctatttaagtgatgagtacactaaaagccactaggcaatatatccatgtaataaaactggacttgtacctcctgaaactataaaaataaaataaaatgaaaagaattgaataaacatggttttctgtgttactaaagattcttgtttgatttattttgtctacccacaaggttttgaatgaattttgtgcaatgatcctattgttcaacaattaagcctgggcaacacagtgagaccccatctctaaaaaagtaaataaataaattagccaggcatggtggtgtgcaccttgagtcccagctactcgagaggctgaagtgggaggatcacttgagcctgggaggtcgcggctgcagtgagccatgattgaacccctgtactccagcctgggtgacagagcaagaccctgtctcagaaaaatcaaaacaatatttttccaatttttctttattctcttatctacttcattgaatgtcctatgacttaaggttaagaaataaaatagctgggtcgaaagctgcatgatatttttaaagactgttgatcattattgccaagttaactcttcccccgtcaaacctttgctaacctgacaggccccagatggtatcccattttacacacttttctttgaccacagtgagggtgaacatttgttccaatgttgactattattattttcctctgacaattgcatgcttgtgccttttcattccattgtccattgaggtttctctttttcttattgacctatgaaaacattaaaaaaatatccagcctattatccctgtcatatatatagtgtgaacatttctactcccatttttactctgtttatagtggggttttagaaaaccatttgatacctttgtgctttctggaatttcttgtttaatctgcctgtcactgatacagcatagcgttcacttgcctgaaagcctttttaaaaggagagttatagcccccaaatccactccaaagtacactataatcatccagtggaaacatctgtgtaattgaagcatcattaatgtctctgtcccaaactcaaagaactataaagggcattgttaattttacttcatcatcagccccttattaatcttggcaaatgtttaacttgtaggcaaggatgtccaagccaactcacaatttactatgcaattggctacaaatgttgaggtgggtttttttgtttatccacctaaaagaactttatgtccctctagcactaaattatgacatcttatctcacagatttaacagcatctaatggttctatctctaggtaatgtaatccagctggagttcgaaggtatgcaaagcccatgttttagaacaaaagggtatttttctctagccagtaaataaaagtgattttttttttcagctgtaaaaggacaaaaggttttgaagtgatcccactgggcagggtttcctaaacttgttttttggcagttggccatggagctaactcagtcttccaaacttcttccatttttgtagcagtgtaaagaattcactggataagactaaagacacttcatggtgtgatgattaatgcccagggtcctgttaacccagaggcaaccacaactggacatccaacagtgccattagcagaccgttgatcagtgtgtaggaagaactaaaaacctgaccctttttcttattgattttagtaccttcacagcccccctcaggtttgcatgttttccttattgagaaaaaaagtttaacatttaacaccataaatgtcacaagtacggtaaatggtctgtagctttagttagaagttgtcaaagatgtttgacttaagtattgtttgatcccattttcaggggttaaacagctctgtggcgttgcgtctcccttgttggttttccatgtatgttttgtagttctgaaacccaagaatactgttgtccattctcattgccctgctgcaagaaggtccactctgtggacccagtcctgtttcttaagacattactattgctagagtgagaggataaaattacatgaataaccaagaacaatttctgaaagcaggtattgaggaatcagcaccttgcagtaattcacacagctttattaaaattaccaacaacaagatcaacagcaaagatatgtgatatcccagccactgttctgaacatctgggcatatttagttgcttaatcctgacagtaaccccatggggtaggggctgttattgtccatagattacagatgagtaccgcaaacaaaggtaaatggctgagccaggattagaacatgagaaatctaactctagagcttgtcctcttaacttgattaagttgatacaacaacaatgccgcaaaatgggtgatggggtccccattttacaaatgagaagctgaggctcaggggaattaatgactttgtaataactttccacacatctgtgaagtagcagtttggcttaagccctaattctaaagccttccccaggataccacatgtctcgtactacaacacatttctttacatacagggctttattcacttcagagagagcttataactggctaacagacagatacccaaatgggcctgtgacacactcttctgggttctcattgcacaggaagctggtcatttagactgcagtcttcatttgtgtgcctgatgcaataagaactgcctccaactctttctatatgaatagctgtaggatataccttctctattcattcctgcctcaggaactttgctttttctgtgccctagcttggaatacgtcatccccagatcttggcatgtctgacttcttctcaggggttagctcagatgccattgcctcagtgggggcagaccctaactatctgtattaatctcctagggctgtcataacaaatcaccaccaactgggtggcttaaagcagtagaaatgtattctcttatagttctggaggccagaagtctaaaaccaaggtgtaggcaggaccacccttccttggaaggctgtagaggaggattccccttgcctctttcagtttctggtggctccacatgttccatgacttgtggcggcacaactgtaatctctgcctctgtctgcacatagcttgcccctctgtatttctcctcttctgtgtcttctcctcttcttataagaatgtttatcattggatttaggtgcttgagataatctcacctcaagattcctaacttaattgtatctgcaaagagcatttcccaaaataaggtcacattcacaggttccaggtggacatatctgttgggtcggggaaccaccagccaaccttaggtcaagcagcttttggtgctgttatgctctgtgacatcatcacctctttattttcttcaaagcacttgtccttatttgatgcatcttgttctcttatctacttttctttgcctgtctccacctaactccatctacttggattcaaactttatgagtaaagaactatcttgttcactgctttaccccaagacgtagaacaatgcctgatatattgtaggggtcactaaatatttactgaataaatgaataatctcattgggctaatgagatgtcaacttggctctctgatcccttcagaaatttccaagttttattttttttactattttatttgaatttcagttggatatttttcagaaatgcaaatgtattaggagacatatatttaatataatgggtaaatgatccaatcatttctacataacattcaatcactaactggtcttcttaattcatttagcttttgctttgctcccacaaatgaatgctcagcagaatttttctttcacctttaggctctgaccacctccgagagaaggatggcctgtgggctgtcttggtctggctctccattattgctgcccggaagcagagtgtggaggaaattgtccgagatcactgggccaaatttggccgccactactattgcaggtgaggagaaggggaagggtctctgtatggaccctgaagaactactcctagaacaggtttctaaaactgatgggctagaaccttaaaaaggaggcatcaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggcgtgaacccggaaggcggagccgagatcccgccactgcactccagcctgggcgacagagcgagactccgtctcaaaaaaaaaaaaaaaaaaaggaggcatcttcccagaagatctgaggaacacagaggctggagctgaatcaccccttatagatagttgggggtggtgtcaaaggctaccaagctggaaggcaccaatttcctttcccctgatgacatcactctttaatcttttcatcaatgcctataaggtaggtggccctctcaagaggaactctgaactgcagagctttgaaaagttatttggtaactatcatggctgtgagagccgtgcagtcaaaccagaggcatttcttgttggttttccattcatatttatcaagtaaaaaaggcagacacagaagctgtgacaggttggtatgctttcataatcctctctctacctctttcttacctcctcaccaataatcagattcagtgtccaagatgcctgagctggcaccccttgaaggaacctcatggttcaagagccccagatattgttaaagttttgtcctcatgaaaagaggtacaggccaggtgtggtggctcacgcctgtaataccagcactttgggaggccgaggcaggcggatcacctgaggtcaggagtttgagaccaggctgaccaacatggtgaaactctgtctctactaaaaatacaaaaattagctgggtttggtggtgcacacctgtagctactagggaggctgaggcaggagaatcgcttgaacctgggaggcagaagttgcagtgagtggagatcgtgccactgcactacagcctgggcaacagagtgagactccatctcaaaaaaaaaaacaaaacaaaacaaaacaaaaaaacagggaaaaagaagtacagaaaaggaaaccattattttggaaggaagaaaaggaaagatcagtgggtaggagcttagggttgggggtctatatcactttcccgttgtttaagtaaatgaaagtaagagtattctggaagtgtggttacttgctaggagtgtgaacctaggtatgctagatatgtgtacataacaagaacgaagccatgggttaggaggagggagtaggaaacgatgttaactgtaaagaacttggaggtggggcaagggaatccttgggtagtctcagagactctgtattaaaagcagaaagattgtgactcattttgctttgtttatgaatagttaactactttgaatgtttggttgtgtttcaagagcttaagggacagaaagagagctttagactttcctcataaggtgattatttcttctgttaagaagacttttacttagatatgtatcagagaataaggaagcccatgactgtactcgttaaaatcaaagagattacaaccttctgggagatgtaaacaacaacaacatcatattcttagttcccatttagtcaagaaagctggggatgtgatagcttgcaaaacaactcgaattattcagtgtatcataaaaaatgaattctcaggacaggtagaaacttggtttactcattatttctaacaagtaccaaaaccccctgattcatgtgtgttttcttttcctggcataccaagagttaattggcacatgacattcttctattgcatgaagctgttccaaaacgtccaacctgacaaaatatattatgattgacaacctctggcctagtgagatcgctttgagtcagagatgtgttcctcataatttgtggaatgattatctaggtttctgctggtgtcttgaataattggtgttatggtaactgtatttataatgtagtttattttttgtggccaagagcttacatgataattacttcttcataacaaataccatatttgaaaataatatgcaatacagatttaatttcttctaggacattgagttatgtttcagatttctttccaaaaagatcacagagataaagaaaaagggaggagaaaatacatagaatgaaaggtaaacatttccttcaacccccagcaaatggcaaattagaaggtgcttgtgaaatgtaattattcctagcttgacaattttcttggcaggctgaaaataataaaacaatttcactttaactaatactgagcctgaatatctgagaaaatcttccagattatttttcttgtatgagtagaccccagaaggaatcttccatttaaagatttcttccttgaaaagtgtgttgttattggtggtgatcagacggggatttgggggtggaaggcagtgctagatcctgcttgtatatgaaggtgaacgtttgggcaaacagatctgatgattctcaaccctagactgaacgtgatctatcatattagtggatttttttcaactcctgaatctctttcaatgcctctctgtctcctgctagactctcttctcctgtcttcctgcccctttctccttggttgggtctttaccttctccaaatgtctacctttaaagtgactgcagtctcagaatatatgccctgctgaaaaagaatgttctgagggagttccttttttttccctctgaggctgagaaaaaaacaccttgtgtaggaggaagagaataaaagaaagggatgtagatgcaggggacccattgctagacatggtattattccatattttgcatcttggctaatatgctgatgtttactggatgtcttaaagatcttgagtggaaaaaagtagtaacaactattcagagcttccttcttccagttcactctgagaactcacatcctttctctatgctacaggaagcccaaatgtaagatcctccaagtgacttgggtgcagctgcccctcctatggcttccttcttaaacagacagtcctaggtgtgccattaggtctcagccaagaccatctgacattgtaaaatatagtttatttatggtggtgatggcaaataaaagttgttagctgtttttaagcacaagtgcctggcactgtgccaactcttggtatacatcatcatattttaaaccccacaatgacaaatgcaattggtattatttttagtcttttattttattttttctaatcgacttccagccccattgttacatttaatacgcttggctaggaggacttttttgaatggaacaattgtgatatttcttccaagtttccaagagttctatattgtgctcagttccccttctccctttctttttaccttccttgatttttctctctttccttccttcctttcctttctcccatttttcattccattctacttacatagaacttactatgtactagaaatagcagagagcaagacagttcctggagctcacgttctggtggccaaagacaggcaatgaataggtaaacaaatatacaaacaagatacatacagtttgggataactaccaaaagaaaatatgaagggtgatgagagaagaagacgagtggggaagctgccttagatagatggtcagagaaggtcacattctaatggtgacagtgggtttgaaaatggaaggaaagaacgagcctggtatttgaagagctggcagaagaatgtacaaggtagagggaacacacagctagcgcaagggcccagaggcaggaaagggtgcaatgtcaatgcacactggagaagagaccagtgtggctggagccagtgaacaatgataaaaagacagaacaaagttgagtcaaagaggtgggccagggcagatcccacagtgcctgatagaccaaggttaaagtgttgagttttgttctcaatgtgatgggaatttatagagggatttaatagaaagaaagtggcatgatttgatttttacaagattactctggccgctgtatggggaatggactgtaagggtcagatgaaagaggggagatgagttgaaggtgcatttctgtgctgtccttccctggaaacagaaccaatgattaaataactgtaagtgggccacccagttgctggttctctgattaggtttctgttcctcctgtgtcctcaccaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacaggtacttgctaggaaatcactacaacgggttatcaggcagaaccagtggccaaaatgtcctagaactggagaggtccttagggatgatctaaggtgacctcattttatagatgagaactgtgcagccaggaaagaggaaagcccttgatgaaggacacctaacaagttagtgcacagggtagattagaacatgggctttctgtggccaggcacagtggctcatacttgttatcccagcattttgggaggccaaggtgggagggtcacttttgagctcaggagttcaaaaccagcgtgggcaacaaagtgagacccccatctctaccaaaaaaaaaaaaaaaaaatagctgggcatggtggcacacaattgtagtcccagccacttaggaggctaaggtgggaggatcgcttgagcccaagaggtcaagtctgcagtgactcatgatcacaccattgcacttcagcgtgggagacaaagtgagaccatgtctcaaacacacacacacacacacacacacacacacacacacaaaacaaaacaaacaaaaaacaaaaaaaaaaacaaaagaacatgggtactctatgtccagtatttgtcccacttggtaatggatagaccaatatgtcaaataaatacagacccaacatttccttatgaaatgtttgtagcctgcaggtgctcatatgtggtggccattattggtgacagattcagaaaagttaccaagaactaaagatccctgtccttggggcctcagtgagtcagtccttggaattgtaaagtcaggagctcagctggcatctttgagcccccgtgccctggataggtcttttccagttttggaccacattcccacttccattttacaaacttttcttagattcaagtctcattttgatgtagaattcaagagatataaaataatgtgccttttaaagtatccttgggatatttttgctcaccgacaaggaaggctcggaaaccattccttcaagggaatggtctaatccgcactcagttatggattttatctacttgcaagaagcttgtctgttgagcttatttgttttgctgttaatgcagtattcctctaccttatatcttcctcagtgtactcagtgcttggataccttttccttagattttctttaactgttcacatcaggccagttctgcaactgtatctcaagttcatctatttatttcatttcccctccccctccataactctgactgttggttttcatttttacactggaatgtgtttgatagggtttggctgtgtccccacccaaatctcatcttgaactgtagctcccataatccccacgtgtcatgggagggaccaggtgggaggtaattgaatcatgggggtgggtttttcctgtgcagtcttgtggtagtgaataagtctcatgagatctgatgtttttataaagggcacttcccctgcacatgctttcttgcctgctgccatgtaagacatgtgtttgctcctccctcgccttccaccattattgtgagtccattaaacctcttttccgctataaattacccagtctttggtaattcttcatagcagtatgaaaatggactaatacagtattgatttcccccaacctcttctacactcttctgtctgagctcaattgtagctataaatggatacatgctgccaggatctgctcttgggaatttttctggtaaagaaagaaggaagttttttgttccttttcccagattccaggacccaggtgatatcttcattggctggtggtcctgagacacactagagcttctttgcaggtctgggtttagctcaaggggggtgatgagagaccagttacttaatacttagcagcatccccattgttggcaagttacagatggttcctttgctgccgttggtcctgttgggtagaggtggaatccctgcatagcagtgttgttgagaccctctcaggatgtcaacatgcatcagcattcagccccagggatagttgagtctggggtacactttaggtaacatagtgcaaaataagcatacttttcaaactatagacatctgaaagacatatttgaatttaaataaactagtattctaaaataaccattaagtaccttggtgcattcattcagtggatatttattgagagcctaccaaatgcataatttgttttttttcatggtacagttttaaaatataaatatatagtatctttattgatatataattcatataccagatggttctctcatttaaagggcacacttcaacagtttctagtatatttacagaattgtgcagttatcaccacaaccaattcagaacactttcatcaccccagaaaagaaatgttgtgctctttagctgtcatcttcctcccaacatccctccaacccacagcccctggcaacccctgatctttctgtctctatggattcgcctatttgggacattttgtataaatggaatcatataatacaaggtcctttatgactagcttctttcacttattgtaatattttcagggttcatccactttgtaccatatatcagtacttattccttttattaccaagtaatattctatcacgtggatgtaccacagtttgtttatccatccatttgctgttggatgtgtgaggtatttccactttttgactataatgctgctgtggacatccatctacaagtttttgtgcagagataggttttcaattctcctgggtacatacttaggagcggaattgctgggtcaaatggtatctctatgtttaacccttaaaggaactgccatatggtcttcgtaagcaattgcaccacttgacattcctgccaacagtatatgagggttccagtttctccacacctttgctaacccttgttattatgtctttgtgatttaaaaatactgttattttaaaacaacctactatattatggattatttttaaattaagatagaaggagatttgatttctataaggagaaacagaactatatctctctgttagcaaagctcagaggagacataatactgccaagtgtctgcttcctacaggaggcaggttgttgtggttctcttcagtattctcttgtgttggagtcagatagacacaggattgaaagctggccttgtcactgcctagatttgtgattttaggcatattatttaacttctttgaacctcatcttgaggggaggagctagtgataattatcacacatgcatcatggggaaagtttgaagagaaagtcatgtgaagcctcaggtacagcggcaagtacctaattgatgctcaagaaatatcagttccctccccttgaccagaatccttaatttgattgaatatcagttcaagaaaaggatacaactattctctctctctctctctctgtgtcacacgcacatacacacacacacacacacacacacacacacacacaaatcaggtgtatatttttaaaagtaataatcagtgtgccctagggttagaaaaccctcacccaactcttctatttattctattttaaaagtactttgcagtaaaatttgaggctcagattgatgatcccaaggtagtgggagattcccagttgtctcttgtttgggttaaattctacttacttaaaaaaaaagtagatagcagaaataattttcaacaatgaattgttaaaatttgtgctgttcccgttttatacagaaattctcttcaagagcagctttctgctccagagcacccaaggcaaccttggtgccattgtaaatcgtgtgagcaatggttgggtgtgcaggcttgaagtcagaaagttttgggtttgagcctcaactctgccacctccttgctgggttatcttaggcaagctattcaacccccctacacctgcatttttaaaatctgtgaaataggaataataattgtggctgtctcatataagcgtttgggagaattaagtgagatgacacttataaaatcctggcacataacaaatgataacaattggttaaataaaattatttatgttttaaaaaaagcatccttgggaaagactgtagcattgaatgaaccagatatgataagaaaagcagaaaaaaaacacacaattttgcagtgtcacataaagatttgagaaggccccttcagtttctaagtcatctgggaattgattcaaactcatatttctccccctctcccatcccccagcacacacactctgctttagaaagcgaaaggttttttaaggcagcttggtctcctttatgtccttgacctgaggtcagagtcaggaaataaaccatggaaaaaaatcctgtttcacatacatctccagagataaagtagaaatgcttctccatccaaaatgaaattaaaatcctgttctggtgataaccaccccactactgccaaccctgctgctgtggaaacgttcagtgaaggctatcctgcctggctttatgggaccattcaaggagcaagaaggaaaccctgaagttctcaacccctgacatgatttcccagggacctccctggcctcaatgtggcatgtttggtttcatgggatttactatggctgcctccaagtgtctgatgcatgtgtgacctcggatgccaagagaaaaattgatgtgtgctttccactatacagggcccaagagagactctgtttgatttagaaagcattttcatgaggcatggttcaacaactgcagttcttccttctatcttcatgaggatatgtcactattttcaagtgaaatctagtcacatgaaggactgactgatgctattttcttcaaatataagtggaaaaaaataagcctatagctacaatgagaataggggagcactttgatcaaatggctaagtagttaaaggagttcccagtttataccttctaaagagataggacagagaggagttgtgtgattcatgtgggttgcagggtgagccactctttcttcaggggcgacttcattgtgcaaacatcgagggtttccatccatcatgctaggtgagctctttcttcccttcaccatcgataccctaaagaatattatcaagattgtctcttactatgatcttttctccatctctaacatgtggcctaagtcctggaatctccactcagtgccacagttgtgagactcccccagctctgatagaaggaatactccaatcctggtattgtgagtgaaggacagtgtgacagaaatggctccacattgagagacagcatatttccactatggtgggtatcaatccagaaccatgacctatattttgaaaactggatttgaaatgagaaaccttgacacttcaggagcaaaatttaagcaactgagtctctttttatgactcatcctaatcctatgttgttgttgttgttgttgttgttttcttttttctttttcttttctttttttttttttttagacagagtctggctctgtcgcccaggctggagtgcagtggtgtgatcttggctcactgtgacctctgctcccgggttcaagcgattcttgtgcctcagcctcctgagtagctggggctacaggcgtgcaccaccacgcccagctaatttttttatacccttagtagagacagggttttaccatgttggccagtctgatctcaaactcctgacctcaagtgatccgcccacctcggcctcccaaaccaactcctatatttctaacaagctcaaaaatcatgaaactcttccagtgctgaagtcatttgcaagtcacagttcagctgatggttaaaaagctgatgtaaataaatgcataccagttaggtgatgtggaaaaccaaatccaatttgattatgtcaggctaactctgagctgattaatacctcttcaagttaagcaggctatgtggaaacattttgatgttgtccttaacctggaaaaaaagaaccgtttgaatttagttcagagaaaaagcacactttgaagactgattttgaagtcagttttcttttagcgttgttattttaatttgcaagaaggtgtctgctctttttaatttcagtgtttagaaatagtaaattggcaatctcaaagtcacattttatttccagcatgtggtgttttaatatgtacctcgatgcaacaaacccctggtcagcaaatatgaagcagctcactaaggtgttgtccccagcactgtataaaagcaactgaatcatatcaactggagaatctgaagctttaagattgagttcttctctcttcagagttagctagtcaaatttcagcttcaactttttgtttttgttttttgttgttgttttgttttttgttttttgagacggagtctcgctctgtcaccaggctggagtgcagtggcatgatcttggctcactgcaacactgcaacctccacctcctgggttcaagagattctcctgcctcagccccccgagtagctgggattacaggcatgcgccaccatacccggctaatttttgtatttttagtaaagacagggtttcaccatgttggtcaggctagtctcaaactcctgacctcaggtgatctgcttgcctcgggctcccaaagtgctgggactacaggcgtgagccactgcgcctgacctcaacttcaactttgatcacattctaatcaatgaactaattgagagactataattgtaacaatttatccttgtcccttttgctggagtgccatttgctggagtgtggtttgcgcatctggaagtagagcctcagaaatcattttagtcacactgattaacccacctatagaatttagttaaatctgaaaattagcatacccacaaatagcacttctacactgagtcacagaactgtttaagtgaatgggctattatcacatttagtttattgtgattcgatgtgggtttaaaaaaacctttttctttgaaaattgtgatgttgaaaagaatctctgcaataaacatatattcctttcctaacttagtctaatatggtgaaggttgttagaggctgattcatttacaacttcatctattcagtgagtatttaccaaacacctactagacgccagtcagctcattagcaccgaggatacaacagtattcaggacagttgagattcctgtctgctgcttaaaatctagcagggaagataaattgatattaaactttaattactgtagagtttgttgaacggtattacagaggaagaacttatttggtgtgcatagcgggggaaactagactagggctctagaaagttctccatagagaggtgatatctaagttgtactctgaagaatgggtagaaggcagcccaggtgaaaccattttatcagactctttgcttttcttcagtccaatgtggttgttatatggttgtttagctctccagataaagagctaaggtttcctataggcattctcaatgggatgctacgataactgtgattaggattctcaacttcagtgctcactctacaacactgtagttggggaaaataaagacagtcgggctctgtattgcactatggcttgtgctaggacattttgaaaaccataggtttaaaaaaataatttctactagccacttttcctgtgattttcctatttgtcctctgaaggccaaacgcatattcagtactttataatgacctgtcagctgatttgaaaataaaatgggaagctgggtgcaatggcttatgcctgtagtcccagctacttgggaggctgagacaggaggattgcttgagtccaggagtccaagatcaccctgggcaacacagcgagacctcatctcaaatttttaaaaaagcgagaaagaaaatagaatgagggagaccctgtttctggttagtcgggaagttctcatctccctgtttctggttaactggagtattgttataaagaattaccttctcctggcataagttgattgctttagaactattgtctaaagtgtcagtagtaaaattgtcctaaaatgtgtagcaagcgtgtaagcattatcgaatgacaacacagttactttctattggaatactaatgtctctgtgttgtcgggtggatgagcttcaccaggaaatataaatataaaagagaaaagctgcaaatgatcacaggaactaagggaggaagctatgccgttgtctgggtaaagtgtgcctgaatccaaaatatcccagaactggggtggatattgtgtgaacagggatcagcagtcattggccaaagaaatggggaaatagaaggtgcatgattttgttccattgttccagttttgagagttggaatttggatgaggaatagctttcaagtcttcgccctccagcagccctctcatcacctagcatggcttttctaggtgagtgctttaaaagagcgtgtaaggagtcacttgaccttgatttccccagatagttctttgcaattgttagcccccaagaaggctggttggtttttaaaagaggctgggtgagaactgctcccaagagcagggcagctgagtatggctgtgcagtcagcacactgcacaatggtacccagcctaatggggaaggagaagctgaagtccaagccagccgaaggaaggatggttttctgcaatttatccatgctgggggtagaggggggcacctgtttttaactcacacaaaagcaccatatggagtaactgctgccttgctcaaccacttttggactcatgctcacagctaactctatgaattattaaacaaagaaaaatgggtaattctaggtgggtttttttagtgtgtgtggaaagatacgtctgttcaatccaaatctcctgctttctaggctgcatgcccacttctacaaaatatggttcagatgttacgaagcagtatcttcaccttgacgctttccagataaatcgttgtgatttcctgtgggagataagatctgagttaggctcgcagagtctctctcttccaaggctgtcctgtctccaggttcacatgcctgctgtggccaactgactatatatgcgacactgtaccagattgcagggccatatgctgttttcccctggaattcatcccaagtcagtatttgactaggtccaatgctgccaaataactgttggtaatgtacagttcacccttccctgcctggctacaacatgtcctacagtctccaaactaatatctggcagctctgtgtgtatttagcaacttacagatttccctgtattgatttacacaagggtttatttttaaaattaaaaaaatagtaaaaaccctaacatttatttatcaaacatttatcagatacctactctacataaggctctgtgtcagctttgggaaaaatacaaaacataagatattgttcagatatttcgcatgagaagcaatgtgtgaatatcagtagttgcatatggttcaacctcagattgtaagcctagagtcagaagacctaaatggaagtaaatgaagctcctccatttactaaatacgttaccttgagcaagtgttttaacttctttcttttcaataaaaagagagattggcaagaatgactctaagatccttctttcaggatgttaagatctgacactcacaacaacccaataagctaggctgtattatttttcaactgctttttaggaaactaaggcttagagagcttaagtgactcaagaccaccagctaaaaaagtggccaagccagcattctagcctgagtttatccagttgctattcttgtatcatttccaaactgactcttcataaacagcaaatcaaagagggggcaaatccagggagaaaaagagatgctacagtgataactggaagcacactgaaggatttttgtgtggagatagctgcatatggacaagggttatgaaatcctttatcaatcattcttcactgggacaaagctaaggtgagcagaactcgactgtcatcattaaagctcacaaccacaggcactgaaaagtaaggaaaacactaagctggaactgaagtgctcttttgatacccacactcctccccaccacataattaacattgtcttctaataaaggagagcatatttttcccttttttgagtgtgtggctatgtgtcatcctggatattccggctactctagctgctgtggctagtgagatatcatgaattctttcacagttgctccaggaattcctacgaagactgtgctaaaaaaaaaaaataataatgtcagatggttcaagaggtggttctgctgctgacaaggccccagggggaagctttcaggattcagtggcatgaagttgttttattagcctcactgtgttaacagccctcctacagtcccagcccagtgagagcctatgtatgaaaccttaaatcctaaagggaccttccttataagggacatgtagcacagtccagtcacttgatagatgaggcaagtgacccagaaaaaagaggttattgcaattagttactgcacattagaatcacccagaaagcttttaaaatcctaattcccaagtaacaccccaaaagaattaaatcacaatgtttggggtgaaagccaggcaccaccattttttaaagacctcccactgatttcaatatgtagcattttgcaattaatgagctaatggtttgcctaaggtcatacatctggggacaagaacctaccatggttcaactccattgtttttagccaaaactggcccttgtcttaagacatcttgagaaatggtggaggaataaacagtcaagccctgccatgatgatgctatgccaggcactttcttagtttatcttttgcaaccactcttcaaggtagatacatcagctctagttcaccatgaagaacgtgcatgtgttttcatgtagcctgtggatccttgctaaatgcgaaggcaggctctctgagactgcctcagggggactgcagtggtgctcactttagttgtcgaacgtgcagtgacattcattcaacaagtgtttatggaaggtctacagtgtgccaggcattgtcctaggctatgtggataaaatgatgatgaatgaggtatataaggctctgtcctcccagagcttgttagctaatgaagaacccaaagtcataactcagcaagtccaaaattttaaggttaacactgcggtggaaacttgttttattcattttcactgagccttgtttcttcaagacttgtggcggcaaaaacacacataatgaagttgttagaatataaataagaaacataaatcaagactagggaatatataagtaagagtagagtcaagaacagaagaagaaaaatttatagtcatgcaagtcatgaggatccacttgggctgaacctcaaatttggcattaagtatcctggcagccatatcgaaaagggaaatgtggttagttacaaagttcttattgtcagaaagaaaaagaatacaagttccttagggaaggaaaggctttcctaatacttggctcttgaaggaatgtctcaggcagagcttcatacagcctctaacaatatttctactagtgactacaaaagtggattttataagacatagcttgtagcatcctgcagtaaaagtgagaacataaaactaaagtgcaatttaataaattcatttatgttaggagtaggtggtgagaggtaagttgatttgagccaaatacaggttcaggtgaacctatgactagaagctggaacaccagggaatggagggattttatatccttataacaatctacataaacataatttctctctactgagattttgataattcaaatggttatattttctatcttatgctgtagggataaaaggcaagtattctatgttgtgaataatgtaatgccttataccaggggtcagcaaacattttctgtaaagggctaggtagtaaatattttataccttgggggctagatggtctctgccacaactattcatctctgccactgcagcacaaaagcagccatagacaagatataaatgaatggacacgactgtgccccagtacaacttgtttcataaaagtaggtggcaggtcaacttcttacctacaggctacatagtgccaacccctagtataacctaaaaaataaatgcgattattggtattctttcattgaaattcaggaacaattggaaactttgcaagtcttggtcagtggtaactttggcttcatagtttaaatgctattgggtgatgacacatgatggaaagaacatggctcgtgtctgggttgcaaattcattaagttcgttgaaagaacatgcagatcccaaagcaatccaatacagctattcacacataaaagggggcctcagcagacatggtgctgggattgttgcagcacagaactaggctggctctaaagaaacccttacattccatgtggagaaggagaattaatgatgttcctcacctggaatggtcttgaaaagcaacatggattctcagttaagatctcatggttagtttcctaggaaagagggaagatgctggaccatttccagtaggctgatgcatgctattcacatctttgtcatctttccaagtgagaaatctattccaggctaccagacataggttctaacaatcttctaggcatgtagcatgtagtatagtcaaagacattataattaacctcaggggaaaacaataacattatttcatttttaaaaggcttagttatgagcagataacacatgtttatagtttgttatgacctgaattcttaaatttcccctcactggccaaaaatgaatctgagaatgttaattgtttaatgggaggtacttcaaagggttgagtctgggggctcatcagaagaggtaatcccaagtgacttggaatctgcaacaggtgggttaggacctcatccttagatattgctttaaccaatttatgggtaagccatagttctgagcagagtcacgtgctcacgcgccccacgtgtagtgacaacgggaatgtaggcttaaacataggtaacagcttcaaaagagtttgtaaaaacaaggctgtgaatatcaatataattgtgagacttttggggatttattgtaggtttgaacgtaacttgaaatacagtgatttgtagacagtcagtaattgcttcacttgctccatttggaattttgtaactattcacttctccagcagcataaggtggttaagaagacagtttctgttcgttgtaaaaaattactccaggcttaaggaggacaactattgtgtctttatattcatatacccaggatttagcacagtgcctaatccataagggccacactaaaatgtttgcccagtgaataaatcctggataatatcatcctgtctgcaaagccagtattacagagtgattggttgccagtaggggagatagctccctttggttacacaaattgtggcagacattgaaccactccaaaagaaactaaagctatttatttggggattgaaacaaaaaagcctacacaacttgaaaaaagcataaagacactcagatggaaccatagtgtctcccagcagatatcaccagatgggggtgggggtaaataattgcagtcacatatgcagcaggtatatatatttttactaatggcttattcttaaacaggacttgaggccagagaaatttcaaggataaattgctttgggagaatgcctgatatcaatgtctcctgagacatagaagttttccaaaataacaaatcaccagatatattattttgttgcctcctcttccttcccctggcccctgccaatatgcttatttacaagagttaccttatcagttgtcttaggagaacacatttccttcaacagaagtcacagtatcatcttatggtcataattttacaatatccctgcctctactgagaagagatacatagcgaatggagatgtgctgagccaatgaggaattaatcctaggcagcactagtagatgtggccacagctctggccccaccccactctggtggtcaggccaaaaaagaagtcaggtaagaagtgtgaaaggaaattcaatcttgggacccccaaactcattaagccacagggaaaattcaagctgggaactgggtcacgcaaacatgcctcccccttttggttcctaaataagatggctacaagatgaaaagctacatgcctcccccatattttgcccacaagggaattcccagtgagctgctagatctttacactaaaggtgtttctattaaaatttcaccatggcaatataaattgatagtttatagatgcagtcacccctggcccaccagacacaaatgcatatctgattgttcccctggcccagttttgtctgttatcttatataaaatgcagattccctgcaattttcctctgcctcatttgtctgtgtcatcttatgttaaaaaaaaatgcagattcactgagccagacaaaggcatgaatgactgtttttccctacccacctcttacatgaaaattgtgtacttctcaatatcctgccctttcccctttaaatttggagccttcaaaatcatctttggagaaaggcatagacctgtctcctaggtgtgcatccttaactttggcaaataaacctcctaaaataattgagacttgtcatttttctcgattgacagaagaaaagacagagccaagaggatggcagtgtacttggctacccccagagcctagctgaggctccagccctgggcacttcactggagcattcccttgccagcagaggaacctgcagcctaacctcatgctggggtaaccttaatgtgggcaatccgtcttactgtaatagacaaattgcctgctttcacttaatccacagatttacaagggacaaactttggccctaggaatatttattgaatatcatttcatccctgtgacttccacttctttctgattcccatatcaccagcccaagagaacttgagtatctgttcacagctttgctcctctttccccacattaaccacaaagcaacggaaatagaataaagagacaaatgggtaactctaagtaggttcatcacattcattacatgccctgtatccagagccaatataaatggtcttgattctgattgtgttgaggtataaaaacatgctgatttctgtggcaggtattaatgattattacttgtgtattcatttgctcactgctccattctggatgttcttggtctcagggcctaaggatcattttctcggatgcatcacggctcatcttccggctcagttcctccagtggtgtgcgggccaccctcagactgtacgcagagagctacgagagggatcccagcggccatgaccaggagccacaggtacagaaacagctgtgctcccagcagtgtgtctcgcagctcctggcaaatttagagagctccatgggcctttagtggggctattttacctcctggaaaggtacatgataatttcagctggaggacaagctcagggcaactccaagcaagtttaattcgttcattacagtgtttgaaacagaaaaattgctctctcgcatctatttgtaatccgtttagaccagcatttcccaaacaactgtcctctcttgactgttgagtggtttgttaattggggtaaagaaaaagcaccttttatagacaaggaaatttagcgttagagtcaaactggtgaaactctcagagccttgactacgcttatgtaacttttgaatctccagacatttggaccatgaccttgaggtgccaatacagatgggctttgtctctgagattgctacattgtccactctgagaggagaggatataggtggccttttaagttaaggaagcacattgacaaggctaagccagactgtttggcaaagtctcctcatgttttcaacaataaggctaattaagaactcagaaaaatcataaataacacaaccataagcctctccactcccacattcattaaagctccagccaacattaattaataccagaaatgactcactttaatgttgggtacttcaagctatacagctggctgctcctgtcttcttggtgtcttcaatctgggttttgaagcaaggtccttgataagatgattttttcagatgaaaacattggttctacctgccatacttcctttgtggaaaagtagagaaacagagaaatactcactgctactcattttagaggtgctcagaatttctagctataatttgccctgatggagtaagatacctggcaggcttttctttctttgtcagtagtttaggggtttttttgttttgttttgttttgttttgtttttttcatggtctgtttctttggagagtctcaaagaacttggcaataatgggtgctacagatccttacacctgaccctacagccagaagatctgtctggagtaaaatcatcctagatgggacaggagaggctggaggaggctgagagctattctcagggttaccaagagcatgagtgggcaaagcaggtggccagcatgaagcccttggctcttcctctcaggatcatagcctttccatgcaggggatgggacacactctgccaaaataattggttagtgcgtacatttctcccaagatagtaccaaatcatgcaagaatttggggcttaccctgtctttccaaataaaacactattctacatctcatgttggggagggagattaaagcaggggcctaaaagtccagagctacgtacgtgaggaatgatattcctggcctcaccaactctgactcactctgactccgggctattttttcctcaacattcttttccctatttgcacagggcaagtggctgtgatatttgcttatttttatttaccctccgcactggactgagaccaggccattagacaagtgtcacaacaatcctatacacacaagagtctctccctgaggcagtccacaaaagcagtgctttttttttttcttttcccaaggcttcctttgaagctgaaagtctccatcagcctactcttagaaggtcatgtgagtaaaggaaacataagtcatgctggttttggtccccatgactgcacatttctcatcctgttggtggaaagaatttgccactttgaagggttggcgaatcccttcactgacgttgctgttggaatttctgatttcccctcccttctcctcagaagcaagagttttcctagacctggctcgatgggcccccgagtatgtagcacatgatctagctaaaagttttacattaaaatagaactccttgttaaaataccatacatcattgactcaccaacttaagccctattgcataatacatttgagtcaggatataacatagagtaagattttaaaagaaatctaaccacctaggggaaagcaagaagattctctcagcaggccaacctgtcttaattactgctgaactctacctaagcctttaagtgggagcattttgagggctccttacagggttgctttccaggaccacctgcttctgccttctaaaaagcctttgattaactgttgaacagagataaaagtaagatgtactcctgaagctgctagtgttattcctgatcagggcctgactggaaagacctgcttgtgttgctttctcagctaccaaaagaaccccttccaccttctctaatctgcagagattccattgctgatcttgttccaattcaacaggtagtttttgatgttttacccactctaacccaatagccatctacacttaaattattttgcaagagaacagagagttcccttcaactggcttattaatatctggctattttactttggccatggatagtttcttttccagacattttgaacacatgtgaacagagcatgttttaagcatttacactgattgccttgcagacatactcataacaatcctagtgatgcaattaggaaaacttgtgatataatctatatgcatttagaccatactcacatgtagattttccatttgcatccttttgtagaacagtgattatgctatttaagttaatatcaatttcttatctacatcaaaaatattttttaaaaattatatccatatgtgcctacgaattggtggtaaggagaggatgggccggggagggccctgatgagatgggcaggttcttgccctgatcccactctgtgtccttggtaaatcaggaaggaaagcttccaaaggcttgttgctggaagactacctagttttttaaaatacaagtttattttaattttaccagcaatcagtaggccttcaatgagccctcaaaccagctggtaatcatttggaaaaaggaatgagccaaaagggtttaaaatcacaggtaaccagaaacagtacaattgtttccgttttctttcccatccaatttattagcagggctgctattattagcttctcgttgaccttcttcccttgtccctttcagcctgtgggtggagtagttaaggaacaatagaagatccaaaaggaaaaggaaggagaagttttgttaagggctaggaaaatcacagactgataatcagcccgtggctaatcaacccttggctttagtactttcaaggcagaatacagtcacacccgatctcaccccagtccttgggaggggcctgattttcccccagtcttcctgaaaattgaggaatttaagtatttgtttgtttgtttgtttgtttgttttttgagaggaagtctcactctgtggcccaggttgaagtgcagtggcatgatctcagctcactgtaacctccacctcttggattcaagggattctcctgcctcagccccccgagtagcggggattacaggtgaccgccaccatccctggctgattttgtatttttagtaaggacagggttttaccatgttggccaggctggtctcaaactcctgacctcaagtgatccacccgcctcggcctcccaaagtgctgagattacaggtgtgaaccaccacatccggctttaagtatgtatttttgataaactgtacctagaaggctttaacaactaatacctaagaaccaggtccctcatatttattcacctgtcaaaccaaaggtcatctgtcattttgttctacctgttcttaataagactttgtaatccagaaataaagtatagagccattttgttttacataggaagaacatatgatttgtcatctaaaccagaatacagatgctcctagatttacaacagggttacaccccaataaacccatcataagttgaaaatgcattgaatacacctagactgcagaacatcacagcttagcttagcctaccttgaacaaactcagaacacttacattaacctatggttggggaagatcatctaacacaaccccattttataataaagtgttgaatatctcatgaaatgaatactgtactgaaagtgaaaaaatcggtgtatggggactcacagtatggtttctactgaatgtgtatctctttcacaccatcataaggttgaaaaatcattaagtcgatccagccaaagttggggatctgtacttttgtgagcgaaagataataattgtaattatgtttagattgtccccaataaaccaggagacatgattactctagctaccagcctgcatcctctcttagaaccgcatctctttggagatggctttctaagaaaactagcaatgaaacctggaaggaaagagggaacatacagaaatgagaagagtcagctcagaggttctcaacccaggcaggctgcacatcagaaccactcaggcagcttggtgaaagtacccatgctttggccccagtcctagagattctactttaattgttttgaggtgggacctgtagtttttaaaaaatttcccagatgatattaattagacaagtgcatctcaaactaattaccggccaatcaccttgggaatgtgttaaaatgtggattctgactcaggtatgaggagggccagagattttgcatttctaacaagctcccaggcaatactgtgctgctggtccaggagccacccattgaatagcaaagagctaggtgaactgtgaagtgctagcagcaggaccttgaattctttaaaactgtagaatgagcagcacctgtttttaataccattccacacatcgatctctgtcttctagacttctatttctgttgcttattggattccacctgaatgtcttatagacatcaccaacttgacatgtgcaacactgatttcccgccagcctcctgtgcactcctccaaaacaaactccagcatgctgtttctttcattcttctccatctcagtaaatggcagttcctaaaacatgttagaccacctcatagctctgatagaatcctcccctccacctcatttagagaagagcccaaacccttaccatgatcttgaatgacatactggaaatggcccccttctccctctgacctcatttcctatctcttttcctgcttctttctccactccaaccgctgtttggtgaacatgacgagaatgctctgcctcgtgttagttacgatggctgttccctctgcctgaaatgcttttccttctgacatctgcatagcttgtctccttacttctcagtaagggtgtccctggccacctaatataaaatagccctcacatgcaggtacttcttacttccctaccctgctttgctttctccatggcatttatcctcatcatatatatatatatttattttattttattatctgtctccacccagtagaatggaagcaccaggaggctgggactttgtcagattatttccctgtatccccagtgcacctggtacatggtaaatgcccaacgcagttttgccaaattattgcaatattgaccattaattactttggaatctctcagcccaattatatcacacaggaagctgaaatattctgtactcaggatgaatgttggtgctatcatcaggtttcctcctatgactgaggtcttgaataaaataaatgccatttttaaggtccctacaacatgcaggctccattctaaatacatcctttatcttattcatcgttccagtggcctcatggcagaattatcctgctttgcttttgcaggaaaggagactgagtcaggaagcaattcagattcatggagtaggtaatttctggattggaggtttaaactaagtctttcttataacaaaatccacattgtccatgttaacgttgaaggcccagaagagaatttctttttatttgtgcttgagtccaaggctacctctggagcctcagtacagtgttattgagaggttttttcctcagatcaatcaattctgtgattccctgacaccaactgggtgcaacaattctattcaagtcagttctgacattatctggatttagcccagaccccacaagttaagggctcagtctcacaagattgctcctactaggaatgccagctgcaaatggggtgcacaggctacccacatttttgccttgccaactacaaatttagggttttctacaatcccccttcagatttaataattcactagaatgactcactgacctcagaaaagtgcttcgcttagcattactggtttattataaaggctagaacccagaaccagccaaatggaagaaatgcttagggccaggtgtggagaaggagtgtggagcttccatgccctctctgggtaagacagcctccagcaccttgatgtgttcaccagcctggaagctcttcaaaccctgttgctgaagtgttcttatggagttttcactaggtaattatggttgattaaatcattggcccttggcggttggatttggtctccagccctgctcccctccctataggtcacggggtggggctgaacattcaaaccctctaaccacctgtttggttcctctggcagccagccctccacctgaaactatgttggggcccaccaagagtcacccactagcataaagtctgctgtggctgaaataataacaaagactcctatcattcaggaagttccaaaggttttaggagctctgtgccagaaattgaggacaaacaccacatgtatttgttattccacactgttaaaagaagtttagcctaaagctgcctccttacataatttaagtttggcctaaaggtttttccatacatagtgaactatgacctaactggatgtgtaaacagactgtaacctactcttgtgacaagtagctgagtctcagccaatcacagtggctgagtttcagccaattacaggcagccactttttcaaaatatgttcaaataaggcaaaaactgagctgtaaccaatccagctatctctggacctcacttctgctttctgtacttcacttttctttttctgttcataaatgttatctgacgtcgtggcagctccaagttgctctgaacctatctggttctgaaggctgcctgattcaagaatcgtcctttgctcagttaaactcttaagtttaatttgtttaaggtttttcctttaacaacagttgtaaaagtgaatagcgtcttaaaaacaaccagttttctgtactaattttgaattagcaatgaataggattcagaaacattatgaaaataataatgttctaaatacatattggatatcttttctagttcataagggatctagagtgagtagtcaaaaacttggagaataaagtagaaatggatataatacatatgatgtgaaagagaaacagaatggagttcagaagtgatgcaaatccacattcacttagccattcactttcatgacaagacaaagatttttgtatatgtatatgtgtgtacatgcatgtgtgtatgagagcaagatttggggatcatactaggtatatatgatttaaagagctaaaagttgtgcctcggtcctggttttgggtcaagtttggattacagtttatagccccccaaaccctgaaaaaaattatatttcctctccttactttcccatatgtagttaaaaatgaaaacaaattcaattttaaaaataaataaaagatgttgttatttaaaaagaaaacctgagcaaggatatattaatagccatatatatgagggaaaacatgaggaaatacctcattttatttttctcctcagaatttggtcggtattgctgcactttggaactatgggggagggcaaagtgttgaagagagagttgagaagagaaacacttggtgaagagttgggctctaaactctatgaccaagttaaggagctggctcattccacttagacgagaggcgtgacttggaggtcttcaggaatttaaggaataatgtgaggcgggaaagatgaccagctgttctccataactaatgaatatgtaatttgaggaaataaactcaagctgaactggaagggattcacgttgactgttagaacaatttctcaactgtcaagactcctgcccaattaggatggctagtttgtgcttttctaagtctctttgcctacatatattcaaataattttaaaacaggggcaagagtagaaagtattgagcaggataatgtctcaaagtatgtgtcagccttaaaattttagttctgtaattataattttttttttttttttaagaaacaagaaacaagttctggtcaggtgggttagatttccctctagtggtgttgaaaggaatttagtatggctgtgttttcataactggctcttggggcggaattaaacttggaaagatgcaaagatgtataggtttttttctatttctgcttagatgagtactttctggaaaggcagacaaaacgccagggcaaacagtccttctttttcttccttagatattgaaatctggactcatactctgccgttactacatattgttttccctggagctgagaacactccttgggagggttggtcatctgatggcatgtgaaaaactcccttggttgggaatctgggagattccctcagggcctagtgtctatcatagaccagggctttttacagttttgatgacaataagcctttttcttggccaaacattgtgatcagatctcctttcaaggtactgagtatgtgaagccctgtgtatccacactccacatggtctaggacttgtgggaaactatggactgccaccgtgaaccactcatgttaatcccacagacagagcccatctcaaatctctctttgtggcaatatatacaaaagaggcccttaattccaaatcttgcaagaataccggcattgccagcttatcccgagaaccagtggtcttaagaacagaccactgaagagccaaaaggcatgccttgatcctggctttaggtcaagcttggattacagtttagaaagcctggaccctaaaaaaaattatatttctcctttctactttcctatatgttgtttaaaataaaaaacaaaattagctttaaaaataaatataaggaaacctaaaaatgttttgatttttttccttataatgctattctaatttctaaaatattaaatatcaacttcttaccaaaatatcttttgttttggtgccagttttaccatgtctaaagcacatgcttaaccagctattggttaacccagtgatgtttatatccacaaatcaccaagtcttgctggatcttgtttactcagcctgaaaaaggagcatgaatgaatttgcagcggtcacacaagtccagaggtcactggtcatcacttctcttgccagatggatgggtttgacaagctgtgtccagcacaatctgcctttcccagcagcctttttgttctagcccagatgcacagcacaaccacatttccgtgcctttcaggagaaagctacccaggtctcatgaactggtggtgattcaggttttctttgaagtggtgtccttccttggtgtacagtaaataatttgctttgcttatataataaacaagagtgtatcttaacaaatggggactgacagtgaacctggaggttgcctgtggccttcagaaggaagctctggactagtgtgtgcaattagccagcatctggaagcagcttttcctgggcttcccaacacggtcatgcttcattcacatggggaatacaggatctgagctgttaaggggagaatgtggctgtttttgctctcccgtctactcttggctgaatttaagtttgatgccctaatcccagaacgagaactcctgttcaagatgcaggtgagggagtttcccatcccttgtttttgactcccaggaacgctggcaggcctgacaaactccagggaggagcatctcaaagccagaatgcttaggccttgggcaggagggaaagctgttaaaggtttatacaattctggtatcgtgtttgtgtttttggttttacttttgagcatttttgttggtacaaatcatcacttgggacatactttggcaggttgggcctgtgtactataccatcatgatatgagatggaaggtagatgaggctgacagagtggcttgaaatgtagacttcattattattcaggtatggggaggccaacagatgatgagatgacggccattgaagagatagtttgttactcacagttcccaagaggaggggacccaacacgccacacagggccacgcagggaagcgccagcgtcggacaggaggcagcatgagcaaagggaaaatgtgggtgaagcctttttggagattctctgggaaaggtaaggtaaagcatgatgagaaggtttaggattagcttgtttgaataatttcagcaggctctggggcacagggactgtccctaatttgctggtacctagccttggggtggttagggcagagaaatagtggcccaagtgtgagagccctgtgagggtctgagaaaggaagtgtttggtttgcatctgaaaggcaagctccagggtgtgttgtttgctgtctctaagaattagctaaccctgggaagaacaaaaccttccagagtcagccaggccccaagatgtcaaagcattagaataaaaacaccagcttaacagccagaggaaaagataaaaccactgtcactttctcaggtgggtaaaattgttagggagcaccccaacaagattttgtttttttcacataccatcaaagctggatggcctctgatacaaaggttgggctttgaaatcagcatttttttttttttttttttttttgagacagagcctcgctctgtcactcaggctggagtgcagtggcgcaatctcagctcactgcaagctccgcctcctgggttcacgcccttctcctgcctcagcctcccaagtagctgggactacacgcacccgccaccacgcccggctaaatttttgtatttttagtagagatgggctttcaccatgttagtcaggatggtctcgatctcctgacctcgtgatccgcccacctcagcctcccaaagtgctgggattacaggcttgagccaccgtgcctggccgaaatcagttatttttgttttgagtcctagttctgccattttccagttttgtgatcttgggcaacttaatatcagtcaaattgagatagatatacttcttattttatattgttgtaatgattaaatcagataattcatatatgtaaagagttttgtacaatgcctgtgtaaatcaaagaaaatgaccaagatgagtctcaatcgttttagaggtttactttgccaggttaaaggtcatggcctgtgacacagcctcaggaggtcctgagaacatgtgcccaaggtggttgggttacacttggttttatacattttaggaagataaaagttacaggcaaagacacaagcaacacatgtaaagtatatattggcctggcccagaaaaacaggacatgtcaaagaaggggaggcttccaggtcataggtggattcaaagattttctgattggcaattggttgaaaaatctaagctttgtctgaagaggtaaagtcagtataaacaaatgcttgagttaagataaagaaagttgtggaagctgaggttcttgttatgtggatgaagcctctaagtagcaggcttcagagagaatagaaggtaaatgtctcttattagacctcaaaaggtgtcagactctccagagaagatctagcaagggaaggggattctctacagaaggccgatttcccccacaaaagatggctttgtagagccattccaaattacgtcaaagaaatatattttggggtaagatgctttgatttccttcagtgcctgttatctgtcatctgatgctatatcagggtcaggttggaatttggtatcttactgctacaaagagtctgttctgtcagtcctagaatctctaaatgtcaacagctaagctccagagaggaggatatattgaggcatatgctacgcccttttcctgttatggcctgaactagttttcgggatccttttggccaatgattaggggcagggaggagatgtccattcagtcagtttggggcttagaattatatttttggtttatacctgacatgtgaataaatgttcaataaatgttgattgtcactaatgttattgtttttgcctttttttttttttttttttttttttagatggagtctcactctgtcaccaggctggagtgcagtggtgcaatctcagctcactgcaacctccacctcccaggttcaagcaattctcctgcctcagcttcctgagcagctgggactacaggcatgcgtcaccatgcctggctaatttttgtatttttagtagagaaggggtttcaccaccattatttttattaataatggtattgactcattttcttatcacatgaggataaaagattcccagattacttagcaatttgttttataatgcaattgacttgtccttttccctcccattaacatctcagagaccaaactggatctatgagaaatgtcccaagagaactgacagcttctaaaaacctaggtcttctctgagagctcccagggctctcatgacatggcattttagatgtaccatgctttgtcagaaggttcaaggatgaagtggagtttctctacttgtctctccattcatggaacaaattcactgccctcctggcttggagtaagaggtagtgagtaggggttgttcaatgatttcatttcatccaaataatgtgcaatctgttggttgttccaagctcttttaccagagagaaagggcttgaacactggagtgggtgtgtgatgaaaggcaggttcattgaagaaaggatgcctgaagtttctttgactagccaggaggcatgtgctctctggcttcaagggattaaacagaaaaactggtcccttggagcaggagtcaagttttttctgaataggcccagagagtaaatagtttaggctttgctagctgtattagtttgctagggctgatataacaaagtaccacaaactgggtggcttacaaagcaagaacttgtttcttattctggaggttagaagtctgagatgagtgtgttgacagagctggttccctctgagggctgtgagggaaggatctgttgatctgttccatgcctctctttttggctcatagatggctgtcttttccctgtatctcttcattatcatcttccttcttgtgtgtctctgggtccaaatttccccttttaataaggacaccagtcatattggattagacctcaccctaatgatctcattttaacatgagtacctctgtaaaggccccgtcttaaaataatgtcacattctgaggtattggcaattaggacctcaacgtatgcacttatggaagacaaattcaacccataatattagtcgtatggtctgtgttacaacttctcaactgccactgttgcacaaaagccgccacaggtaatacataaatgaattagtgaagctatattccaataaaactataggcactgtaattgacttaagataattttaacatgtcacaaaatcttatttttttcccaaccattaaacataaaaaccatttttatggctgcaccaaaaccaggtggtggccagggtttggcctaaggcctataatttgttgatccttgccttataggtttctgaatatgacacgttatttacaatttctgattacattcagtacagcatgtatcaacatgagtttgggtaaaccatacacactataaatttcaaaattacatttgtatttgtgtatatttgtatacatagatgaattgtgaagttttagggaaaaaaatatcaaatctctctggaaatctccagcatgaggcttctgaggttgaactccatagcttttgattgcaaccaaacatgaaagggaaatgattatgtttgtattcatgaaatcaaattcctttttcaggtcttttgtttcttgtcagaagggttcttcatttttctttttaaagcaattgcttacacatgattttcagaagagcagcactatgtcagaagaaaagggaaaaacgttaagaaataaatgggatgaaaaaagaaaagtatgaatatgagccctggtgaattcttacaaagaaagggaagcaaacacgtgacattcagtagtgaccccaagccagggagtgctgtgacattgcatgtccctgtgaatggggcttccgggagctgataacaaggttctagtgcatttcagtcacattaacagtgatcctcaaacccagtctccaaggaacctcaccccatttccctaggaagtagcaattctgttgtttttattctttctttctttgcttttaattatattcttgggaattacagtcaggacagtcagtgtggtgtttaacaaaagctaagatactttgatgatatactgagatttcccagttatacattttagactgtctttgaccatgtaagtgtttctatattgttgaatcaagccgctggctctgactcatatcagcccatgtttttcagaatttgcagtcattatgaattcactttccttttaatggataagatttgataaaaagcttaaaagaaagtacttttacactgtttttaacagcgctttatacttttgctacactaaaggtagttcttggactagcagcatcaacatcacctggttgctacttagaaatgcagaatctcgggccccaacccagatctactgactcagattctgtattttaacaagctcctcaggtgattcatgtgcacattaaagtttgagaagtcctaatgctgggcgtggtggcattagcctataaagtgccatctactcaggaggctgaggtggggaggatcccttgtgcttaggagttgaagaccagcatgggcaacttaaggaggccctatctctaaaaaaagaaaactgatgctggctgtactggcttaaacctccaatcccagcactttgggaggctgagacgggtgaatcacctgaggtcaggagttcgagaccagcctggccaacatggtgaaaccccttctctactaaaaatataaaaattggctgggcatggtggcaggtgcctgtaatcccagctactcaggaggctgaggcaggagaatcgcttgaacctgggaggcggtggaggttgtggtgaaccaagattgcaccactgcactccagcttgtgtgacagagtgagactccatctcaaaaaaacaagcaaacaaacaacaacaacaacaaaactggagggaaaaaagggcaagaagtcctgtgatggatgacctttgggatccttatttccacctctgcttagcaggactgacattgtctccacaccagacaaaccctctaatgccaaactaaataggatgcatttataggggtgcctggcctctatttcttcctcatttaggaaaatcataaagcatgcagaaaataacccagacaaatgtgccaagatccttgaagacttgttcctgcttctcaggtcaattaacaaaaaaagaaacaagaaaatcagtttcaagttgcatctccatagaaaccctttctcaatatcaactcagcagtgttagacagttttcttcacacaattatactagttgagctgagagattcaaaataacagtggatgaggtaaagaaagttctaatttgattttgccaaggcacaaagccttgctaaaattgtgggtagacagtctagcacacttcaattactaggaaaaggtcaattatttaaaacactttaaatatgttaggttaaatggcagctgagtctaaaggcaaaggccataaaagaacatgttcctttgtccaaactgcattcataaagtgtgcattaaccatccattaatttcactaatagtctttctattgtggggaagagtctctcctcgtttacagggctcatttccatgtttttagtgcctggtgttaatgactgtcccactactgcctcctccgtaagactcaggtggccctcacggcagaagttctcttctagtttgcttctgctactcaactctgccactcagctttgctcaatgtggaagtccttgctaacttctttagaatctgatacacccttaaggaatgtgttccaaaagctatgatgtctgttccttctgttgtcaacatcaccttacgcaactgcaatctgattgtactctctctggctggatatatagggcctgttgcacacaaacagaaatgcaggcaagctttcccccactgggtgtgtcactgaccctcttgctgacacagagagatgttgcctctgatttgagtggctttctcactccaagagctgggaacaccccaacattcttaatctctttttattttatcttttatcaaaaagataacatgaactttattttatgggcaaataaacttaagctagaagggttgttgactatctaccaaaggtcagcttattgggactggtatgctggtccactcacctgtagcctacttttctattaatagcaagtcaggcttctgtcttcaatgatgatgataatggtaataataataataacaatagtatcaagtgcttgccccgtatgggggctaggcagaatgctatgtgttttgtgtgtgttatatctcattctcaccacaatccaatgctataggtagtcatgctatccatccatgttttacaaataagaaaactttggccctgagaatttgaacaatctactgtttctaaacagtgtccctggtatttgaacctagatttgggcctcagagcccaagaccttaactaaggtccttattatgtgccatcaaaaaatatgggggtgctcacccacctataaaaagtaaattggagtagaccagcattcccatcttcaatctggcatagttaacacacctcaatccatcctctaggaatgttctagaggcagtcctcaagccccacaattccagactagtagaaggtgtggtctctctttcagtcctcctattcccttttatgtcctcagatcctttcccaagggctagccctttcttagaaggctgtaccctctggaagctggagaatgccactgtgctgcttgtaactggttacctcaagtaggctgtggggtggcagttaggcgaagtacagagagactgtgaactcttctcccggagaagcagcatcaccacctggggtgaacctcaccatgggtgggcctgagaggaggtagtggggtgggcctccaccatctggccactgaggtccctgcctgggccttggcagtccctcaacatgggagggggaagagcacacactctcaggactccactcagccaggagttctccttgccaaagtgggcctggggtctcagcctctttgctttgtgacgtccaccacacagctgctttgccagctctagtgtgctcctaggagggctgggttgagtggagacagttcctggatttcatgtttatatagttctgtttttttgttttgttttgttttttgttttttgttttgagacagagtttcgctcttgttgcccaggctggagtgcaatggcgcggtctcggctcactgcaacctccgcctcctgggttcaaacaattctcctgcctcagcttcctgagaagccgggactacaggcatgcaccaccacgcccggctaattttttgtctttttttttttttttaaatagagacggggtttctccatattggtcagactggcctcaaattcccgacttcaggtgatctgcccgcctcggcctaccaaaatgctgggattacaggcctgagccactgcgcctagcctagttctgtgttgtagtcatgagcagttgagtccatgctgagagtttgcatctcagggcataggcataataggggacggggaggactgcagtacctttactccccaaatggttgctgggctcttacgcaaatctgccagccctccgcagtagtcttcaaggccctcataatacaaaaatctctatttcagaaaaagagaaaatttaaattagaatgccccagattcctggatatgtaactatccaggtaaaatttatacttattaatattaaaattatttcactgcctctagtgtactattgcttgttcagtggtagcaaattcagtcacccaccaacacaggcagtaagtcctagattggggccaatttaagacaatagagcatggtgggcactctggtgatgctcagctgtctttaattattgcattgttaatatgtgagctcaaggttgccaggttttctgattttaaaaggagcaagatatctggactttcaaatgaaatttgatttttaaatattggcaggaaaatgattacaaaacaacacaaatcccatatgaaggacttctaacttttagtagtggtggactaggtgattcaaactaaccttccctctgtaaagagctgaaagaaatatattaaagcatcttattaaaagcatggttgaccaatgacctaataaaacagtaacaagaacaggaaaagggttggcactcaggaaaatgagccaaagctctttctgtcctagggaatttgtccatctaggagaggtactaaagaagaggtgcttttgatgactggcacagggtaaaggtgaccggcatcaggtccaggtggaggaggatctggtctattacagtctgcctctgctaaccaggagactaaccaaagaggcagcaaagaggcagacctgtgtggcattttcgtgtggccaaaagaaatatggttagttaagtacacatcaaaggcagagatcctggcttaacaatccctgctctagggtgtaaacttgaagaagaccattccaaaggtggtatacagactgtactccagaggattataaatccatggctctgatcttctggctccctgaggagtctcatgaaaggaaatgaaggaaactaacaatattctaggtctccagttatttctataagcaatttttcaaacaaaatgggcaccaaacaataaaagattataaagcacttggatacacaaagcaacacataccagaatcaacagaaacaacataccacagaaaaagatctatagatactggaatttattcaatacacactgtaaaatagttattttcactatgttcatggaaataaagcactgaatgtaaaaacatcagcaaataactgaaaactataaaaatacaccaagatgttgaaattaaagagctgagaaagataaccaaaattaagaacataaatggatttaacagcagctgaagaatatcagtgaacttaaaatatttcagaagaaactatgcatctgatttttcagtttagtccttatgatttgcagaacaaagaatataagattgctgcctttggaagatgaaagatcatattcggaaaaatacagaatagagggtaagagacacaaaggatacagtgagaagtgctaacataatttagttggagtctcaaaagaggagacagaaacttgggtataggcaacactggaaaaaatgataggtgaagatttcccagaaccaatgaaggaggtcagcccactgattctagaaagccaagcaggatatataaaaataaattcacatctagacacatcaggctaaaattgcagaaaatcaaaggcaaagaatagtttgattgacaactaatttttctttatcaacactaaaaataaggagactgatggcttagaactcttaatctagtgaaactttccttctaaaatgaaagcgaaataaacacatcttcagataaacaaaagctgagagagtatctacacaaaaagaaattctcaaggatattcttcaggaagaaggaaaattatcccagatagatatttggaataaaatgcagcaaggaataaaagaaatgttaaaaataggagttggtataaatgaacattggctgtataaaatattaataattgctgaaatatgtatattaattaatatggagaattaaattatacaaccacagtaactaaacaccatgagcataattgtagttaaggtaagatccttgaatatattggaagaaaataaaggtatagataaatactagactttgataggtcaaggattcatgttgtagtttctaggtaacgattaaaaaaaatagaaggaaattacataacttcttaagagaggaaaacataggaactttaaaaaattgagaaagaaaaacagctaggtcaatttcatccatgtatacatatgtaactaacctgcacaatgtgcacatgtaccctaaaacttaaagtataataaaaaaaaattaaaaaaaaaaagaaaaacagctaggtcaagtaaaaagcacataaggtggtggatttaaacttgaatttactggttattactttaaatataagtgaactaactgctgtaggaaaaagacaatgtaatggtgattcatacctgtaatcccagcactttcagaggccaaggtggtaggattgcttaagcctgggagtttgagaccagcctgggcaacataaggagaccttgtctttacaataaataaataaataaataaataaataaataaataaataaaattagccaggtgtgatggtgtgcacttgtagtcctagctaattgggaggctgaggtgagaggattgctcaagcctgggaaattgatgatgcagtcagccatgatcataccactgcgctccagcttgagtgacagagtgagaccctgtctcaaaaaaaaaaaaaagacaactataagctcgttataaaaaatacatcttttatacataaaaatacagaaaatttgaaagttaaaagacggaaaaagatatacaaatgataacctaaaactagctctattatttcagataaaatagactttaaggtcaaaagcattgctaaagataaagagagactcttcaaactgataaaagagttaaatcccccaggaagacacagtagttttaaatttataaagaaaaaaaaaagagggagagagagatgaaaatgtaagaagaaaataaatccacagttgcccttgagtattttagcacccctctcagtaattattagaataagtatacaattagtaaagaacatagaatatttaaacaacttagttaacacacctgacttaataggcacatatagatattacaccacgcaacatcaactcaacgtgtaaattcttttcatgccacaggggacacgtataaaaattacctatatgctgaggaatgaaagaatacagagtattataagggcaactgaattcgaaaatgaaaacaaaattgacacaaaaaaagcttttgataaaatgtatcatctcttcatgataaaaattctgtgaataggaatcaaagggaagtcctttaatatcataaaacggtattgctaaagaaaaaacctggacgtaggctatatgtgctgacagtatgctaacaagggagaacgacttgatgggttcatttagaactcaaataggctttgtcttcagaaggacaagcatcagttttacatataattagagtatgttaaattgtttgcatttccctgtgattgttatatttaataatccttaaaaaggtaattttcaaatagtgtgcctagaaacagggaaacttttggcattaagacaaatatatttataaactttcagaaaatgaaaacttttccctcagtataagggcagtctagatagtgagatacagcctagctttgaggttaaaaatcacagtactgagtaggttcagagctcagctttgccacttgattgccatgtgactgcacaagttatgtaatgagtccaagcctcagtttcctcatctgtaaaatgagaataataccacctacctcatagactgtttagagattaattcaatacatgaatttggaatagcacttggcacattttgggtactcagtgccagctattacaaaattactaaagaatcaaaacttagaatccaaggcacaaagtatataaaatggcagtgaggactgagaacactgatcgtggcttccgaagtcttttggagaagaaagggaggaaaaggaggaaaatggagaatggagagagtcctttgagtaacaaactggagaggcaaaggtccttttgtttttttaacctcggtttcaatcttgaagttttatttctgctaaccatttggtaaaggcagaggagatcctaatttccctttgacctagcaagtgtattccatgtgaaagaaacctggaagcctagtgtggatatacccaatgaagagaaatgtgaagacatgtgagggacatttgggagggatggggatctgaaccaattagtaattccccatccttttacaatgttttggtggcagaaggtgaggggagaggtggatagaaagaaagaagagaggaacagggaaaccatggccagggaaacagtcctaacaatttaaactgacaactcttgcaggtaggtttgtagtattcagcagcacagtgaaagggctcagagattgtgcctaaagcctctcagctgctcctacagacagcggccagtgctcttgctctctccccttctccatccacacagggcatggagccaattagagctcacatttgaataagaatatcgggcctggcacagtggctcacacctgtaatcccagcactttgggaggccaagacaggtggatcacctgaggtctggagttcaaggccggcctggcccacatggagaaatcctgtctttactaaaaatacaaaaattaggtgggtgtggtggtgtgcacctgtaatcccagctactcaggaggctggggcagtagaattgcttgaacccaagaggcaaaagttgcagtgagccatctgagccttttatatcaggggctcacatgaacaagtctcttgtaaaaagaagctctctctgatgaaactgagaacagatagcagactcacgcaagctccggatggtggggcagtgtgttaaggaaacaatggggatgagaatgaggaagtagatggggagaaatagaatcagagggtttggcaactgcttggatgtacaggaaagggagaaggacccaccaacaagtacttccagctgagcagattgagagttcagagggacctgctcctagcaggaaagagaaggtggaaccatggactggcgtagcgaggaagttaattttggtttgcaagatgttacatttcatattttgggtttgttggtggtagaatactggaccatgatggtacctccaaacaatctaagagaaacacattttgagtgtttatcttattaattgtgattttattttaatttgcttaaaatttttgattttaatacgcaaagagaccaaagttagctcaagaaagtcaagagtagggtctgtcacatgtccaaatctcagagactagacctggagtatggttaccacctcaggccttcctattgggaggtaatggatctttagagataattgggagtcatgccattgttttctctctaccaactcctttattatttccttctgctctctttaattcttctcctggtttcaccctgctttcttataattttttgtcacctttctcagagtctctgctttctcataatccaggattaccatggagtcttatgccctcatggttaattaattataacctcgtgatttagttcccactactaactgtccgttctttcattacttacagttcaaatccccgaggcaaataatctgctaggctaggtgaagtttttgccccaggctctattgtaggttgctagccagcctctctattggctgcctgtaggtcagacagccacttctggtccaatcagctgcagccagggagtgggatcatgtgatgcaaacaatgcagcctgggtttgggctggagcaaagcatttgacaggcacaataattagagtaccttagagcagtggtcctcagagtgtggctcctggaccaacagcatcctgggaagctgttggaaatgtcagttcttgggccccaacccagaccccttgaatcagacactcaggatgaggggtgctgcagtctccactttaacagacccaccaggggatactggtgcatgttcaagttcaagaaccactcccttagactatgcaaaagcatattgactaaaaatgaatgtttgcatgaaatctggagagaaagcctggcattcaggtttagcaggttttaaacaaagtgggagtgttgttagttgatcctagggatcaggagaaagtagcatttgttataaatctctattttatggatgccagaatgtcagtgttttctgttgttggatgacctacctgcatttctggtttgtattgcctgccccgaaagatgaactatggtaattatcgtcatccacacctattcactctccacccatggctccaatccttccccgactgtacaaatgcacattcctcatagagaccagcccagcactaggttccctccacagattctgacaaatcttgcttgataagtgattatgattctggttagggtattgttttcctccgaaaaatcagttaactatttactttgagtcttgtgacattcagatcatttacatccttcctgtctattgcttgtcccagagtaagaagttcagtttgttagggttgttttttttttaatggatctaatttacatgaaagtggattataacaatgacataaagcaaaagagaagatgggagagaaagtaaaaagagaaactctgtctttccagggagtatggacaagttaaaacctaatctaggatttatgtgggctaggattaatgtgaggttaactgggtgcaaaatttaagtgggtgtggatgccaaaatactcagtaatcaagataaatatcgtagtgcaatttttaaaaaatcaaaatcaatgtccaaaaaattcatgataaacatagtgtcaaaactttaaatagagagaggatccaataccccctgtagcctgtctacattaatggacagcaaacatccagaaaaccctgcaaggtggcagaagatgccatcttgaaaggatgcaaggcctgcttggtttggagcaagataagcgttcactgcttcctactgttgactgtagaagaaatatgttaggcactctaaaaaacactggaattagaaaaaacaatgctatactctaacataattgattaaagtctccattaatttatttcctttattcacaaagggttattttggagtttccaggacattcacataacccacataactgagaacacctcttctcccactgtctgcctggttttggtcagggaggaagactggtcagtcctacccaactcctcatctgatgtgggactcatctggtccaatagggttgcaatcccatgatttccctgctcctccccattcagtgcattttgtctttctctctttatccttgtcactctcagatcttatatgcagaactgtatgatggaaaatgcagtagaggagcccactgtatgttcttatcccagctcagccaccaaacagatgtgtgaccgtgggtcaatcctgtgtcgcactgggctttagtgtcttcatctgtgccatgaagaaatcaaatgacaccaatccacattcctctctgcttttgaaattctgtgcttccagctccatgttagaaaactcacatccacagttcataacccctctttttgctcctcattccaactgcctctccaattgccccaggaaaattaactcccacccaccatgaggcatggtcgatgacatgagagaagagtttggggtttacgtgtatcagaggagtgatttctaaagaaaaacatgagtaaaaacccggcactgttgaccctcccacatgcacacaatgtcctccaggaatgcccacaggagtctctatttgccttatcatcttttcatcaaatatatcattcatttactccacaaagatgtattgagtatctcctaagcagtagatactttccttagccctgaataagacaaagtttctgccctcatcatgtggccactcattctagcacatatatactgtcatgcacggcgtagtgatatctctgtcaacaacagaccacatattccatggtggccccataggattggaatggagcatgtatagaaacctgctacatggcacttgatattgatgttgcgaatcaactaggggaaatgattgatatttagtgatggtgctgggacatttggtttcccatatgaaaaacaatatataaataaaaagatatataccatctaggtttgtgtaagtacactctataatgtttgcacaaggatgaaattgcctaacgatgcatttctcagaatgtatccccatcattaagtgatacatgactgtttaatttatacactcagggaagaaaaaatatattagtttattagccttaaaaatgggagcttgccgggcgtggtggctcacgcctattatcccagcactttgggaggccgaggcgggcaaatcacgaggtcaggagatcaagaccgtcctggctaacactgtgaaacctcatctctactaaaaatacaaaaaattatccgagcatggtggcaggcacctgtagtcccagctactcaggaggctgagacaggagaatggcgtgaacccgggaggcggagcttgcagtgagccaagatcgcgccactgcactccagcctgggcgacagagtgagactccttctcaaaaaaaaaaaagaaagaaagaaaaaaaaggagcttaacttgaagtttcctttccagaaagctggcaaaaaattcaatcttgggtatttttagggacttcttcccaggccttcctggggtcatacaaaatctaaagaagttctgtggttcctggaaaatggctgaaaagactgaacatcagtgaggtggtcttcttcccaaacactcatatttcccggaaggcagatgactccatggcatctgtgccggattagcccaggctcttggctcaggatgggagtcctcatatttaggagtttcctcatgtggcattttcttcccttcagcttgcataagcaccacggaagccctcttctctgacatgaacagaagaagggacaagtgcttggttgatgaatccagaaacagagttaagtaggtccactatacacatagatatcctattacatttgtatcataaaacatataaatgtacatgcatttgccagtattttgattttggcccaagacctgttctttaatatgagcatactgtttgccattgtgatcctctttcttcaaaagattcccactcataattcatcatctataatatctgtctttgattcctttatattacagcgggaacttaaggacaattgtgaagcaacctgaaaaaataattcttctataattttaaaatttctccctaatattttgtagtatctcacccacatctaatttgacaggattagctaatcaccattatctgttctttccaaaacactcaacttaattttcatagaaaaaaagtcttcttatttgcattcacgtttcattggtttacatataattaaattgcatagtctcaataattagtacaataggcattaacatattgggaacaaacttaactgactcctgataaacacagaactcaactgctgaagggagaagtaggtgagcatattagaaagtgatcttttggtcacggacatctagtgagctacggacgtgagtcaggatgttttactgaagaagtggaaagcacgcgttagtttgtagagttaagtggagatcagaaaagagaacttctctggtgtttacagtatttgttaaaacttgcttccccgcccttttgccaataggtaccaccacttaaagatgtggagtcaaaaaatcttgaaatttacaatgatgtaaaactgaatatgttttaatcctttagttccgtaaggttcaaattcattttcattgcattttcttaaaataataggatagtatatgtttatctttattcaccctctaaaacctcagctaaagtgattgagtttaacttcactctctttttctgtctgagtttaacttctttgataggtgttaatgaagaattacataaccaaaaagggggagcaggaaagagggaagagaagacaggaagaggagcaaaaactaataattgaatttctgtacaaaatgggcactttgctcctaaagaatagagatccctctatcttggcatcacatgggatatgtcctggcaaaatgtgccagtgtaaaatgtttctgggcaccaacagggttattaagaggaaaagaatcccttctgtttttacgaatcaagatgatcaacacggaaccggaggaaagtgccactttcttgtgttctagattttcatttttcttccagcttccaggagtctatgtgagcttgtccatctagccatcttcatagagtaagataatttaatacatgtaaccataaattgctgccagatcaatatttccaaagcacagctgtgatgtcacctttcagcccaaaacacttcaatgcctccccttgcctaatgaattaaaaccttacacctcactctagcatttaggtccctcccaacaagactggctcacatctctcaggattcttctgtatctacatgccactcaggacacaatggattgcttgtgatgtcttgtaccttgtgcatttccttgtgttcctgttgtgtggattggaatgtgtgcactccctttatgcatgggaataggttagggcccacaaggaactgaattcctctccccctcccaaaatgcaagccttcttttcctgaattacagaatttttgtttcttccattatcctaatattacccaaacttcttttctatcagtatctctatattaataggtgtctttattttttattttatttttattttttctttttagagacaggcagggtctcactttgtcacccaggttggaatgcagttatgcaatcatagttcactgtaaccttgaacttctgggctcaagccatcctcccatctcagcctaccgagtagctaggactataggcacacaccactgcactcagctaattcttattttttgtagagatgcggtctatgttgttcaggctggtattaaactcctggctcaagtgatcctctgcctcagccttccaaaatattgggattacaggcatgagccaccacgcgtggccaatatttgtctttaaattgactcactttgtttttacctcaatctacttatttattataaaagtactctacatggaaaaaacaataccacttgataaatataagcacatcatgaacatgaattcaataaaaacattcagtgacattacattctagctgggtaactcctgaggcatgcactatcttggttaaattgttaaagattggcagcaaacagagtttctccttgatgaaatcagaaggattgaagaacggaaaatagactgattttctcactgttttattagcaataccatatccatgcaccactgaaaatcattgtgagtgttgcatgctccacacctcggaaaacaatgcctcaatcccatgaaacaataagaaagaaatgagtcttcctccttctcatgtccttcaacttcccaagaacctattccttaggcttctaaagcatgcccacctcctccagaaaacccactgaggtgcctcataagcccagtgttacgtaatgggaaggcatgatcagtcatttctgcaacgttggccaatgaattggtctgtcatttcagaaacatcaggattgtgggttctttaaatccatggccctaggatgaagaatgagcttttattctcgtgtgtgtgtgtgtgtgtgtgtgtgtgtgtgtgtgtgtgtgtgtgtggtgaggatgagggtgtagcagcagaagactggagtttttctgaactcccttaattcacaatgctgtcttcatacagtgctctcatgtttggtagttgggttgtacattttcctattatagataaatttcttttgaagctggttaagactttggagatcaccttctccccctactctcctgccctgcccattccaactaccattggtggaggaggaagcaaatgtcctgctcatgaagactgcctgtaaacagtgaattggaatctgagtccagatgcttatggtagaaatccatcagaatgccccaaaatgtaactgacttgagttgttcacagactttccttttccttttgcaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaaaaaaaatccatttggttttggttttgtcctattcctccaaatgcagcagggcctttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggacatttagtggccaataaaaaagaaattcctaatttcaacctt

SEQ ID NO: 36993 - DNA, 7048 bp, Homo sapiens
gccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcaggtaccgcgaggcttgcggagagtggccgggccgggcaggccctggctaggccgaggccaggccagggccaggggtggggggtgctggccaggcgtggggtagagcctttcatccgggcctgccaagagcggggagctgtgggggagtggtggggaggcgggtgctctttgggctccctggaaacccaaatttggagctttgcggggtggatttgggatccaggtttcggcctgtgtaggacgtttattttcctgctggtatcttgggaaataacgagcatggaatgctagagtgagctaaacctatccttgctgaggatttcctctttttctagatgaaagaaacaatcatgaaccaggaaaaactcgccaaactgcaggcacaagtgcgcattggtgggaaagtaagttttaatagttcgggtttgtgggttttttttttaaggtttaggtattttaaaaaacatattccttttgcgcttcttatattatcggtgacaaactttgcctatcgagggaaattcacggagctagcaaatctcgaggagcgggggagacgagggttggagacacatcagtgagacgagctaaaaacatcgcctttgtgtaaacatgtttgtgttttcagtgttacagagtgtaagtagaacacaaaagtgtttcctaatttaattagtaaggaaaatgtgtcatttcagttagatcgttgtgcacatcatacccttgacttgttttggcctgagttttctaaagtcagtgcttgtttgtctctcttgtaaattgagacctttctgtactgctttctgaactaaatattctttagggtagttgcatatttcaagggtatttgaagatacgggtacattttggagtttaagagcagtgactattagatttgaaaatataacccaagtaggtatctttcctgttctgactttgtattactgtaaaaatgagggaattaaagtgactgatttttaaatgatcagtttttgattaattgtttttttcctggtggatactgattcacatcaaggggattcttttttgaagctgatttttagattgtcctgtaattaataagaagtccactgtagacagaggtctacctagtttgtattgttagcacattcttagtatttaacaaggtgtggtagcttgttgaaacagagcatgtctttacttggtaaaacttgtaaagcttccatggtacatgtttattaccttttagtttttcccaactttaagcgtttaacttagagttagctgtgagatagccagaagttgcacttagacttaaataataatatacagctttgttaaattactgaactttgccagcggtgaatttatcctgatttttttttactttttatttttgttaacgttagccatcttcaggatccacacccacacatttaacaacattagatgtttcttgtcctctttaatcaattgttatcagactgtggccttcaagtgccagcaaaactcaaattttttgtgtctcagtgtttggatgctcttatattggtgtttttaaccactcttactttcagtacagtttcagaaggagtaatttgaataatgtgcttatgtgcagtctttttgttgttactctcatcattaggctttaactttgggagacatcattttagggtaaaggaaatcttgagatttgctaggatatttaaagctgataacaagattaaattttgtgtcctaacatcttaatactcgtttagctaataatacaagaagtatttctgtagtcacaatatggaaacatttctacactgtttaagaaacgtacttattatgggatgtgaaattaggtgagttaattttgctttagagaaaactgcaggtgttaggtgctcttaggtaaatgttacaaaagccctttattttcatatctaatcacagcattaataataattatttaagtgaaaattgaactctacatatgtgaagtgtatgaaacctctagaaagtatgctgggtttgtctttacaatcttagaaattcctttgagtttcttagagaagatttctttggaaaccagatacatacatgaccatttcaaagtgatttttgtacttaatagtttggagaggttagtaaccagtactttttttttttttttgtagccatagatattttcttcagttaaataacaagatttatttaagcctttactatgttggatcctgagaatataaaattttaagaagtttaaagtccctaggtgggctttaagcctagcagtggcgataattgtcttttcttaaaaaaatcttctttcacagtgtaatatacatagtacaatagtagaagcattttcaaaatctagagatgggaatgatttggcatagggaaagggggtaattgcagaatttaggaaaggcaaacaggaggtaatgacttgaataagattttaaaggatgaataggaatagggatggaggttgggggacggtgaggtggttgggtgtgatagactttccttgagtgccttcagtgagctagatactgttgtagatactgggtttatagcaataaacagaagtccttatggagcttacattctagggagaggagatggatgataaaatgtatttatctcttatagtaataagtgttatgaagagaaataaaccaggatagaaagaaattgatgagtgagtgtggaagttgctattttactttgggtagttgagaaagaccactttgatcaggtgacataagagtagagatctgcagtgagggaaagagccatgtagatgttccggaaggagaggaacagcatgtgcaaaggcccttgggtcatagcctgcttggcctgttcaaagaatagccaaggtttattggctaaagaagagggatggtagcagatgcagtcaggagtggcatattaagggcaggacagtttgtgtagggctcttgtaagttaaggtaagggcttcagactttactatcgagtcctatagaagtctatatacagattcatttgattgttccatacactgtcttgcctgtaaatattaatttggatgttgatttttatttaatataaaaacagaaaaggggtcaggcgcggtggctcacacttgtagtcccaacactttgggaggccgaggcaggcggatcacttgacgccagcagtttgagaccagcctggccaacatggtgaaaccccatctctgctaaaaatacaaaaattaaccaggcatggtggtgcctgtaatcccagctactcgggaggctgaggcaggagaatcacttgaacctgggaggcggaggttgcagtgagccgagattgcgccactccagcctggacgacacagtgagaccctgtctcaaaaaaaaaaaaaaaaaaaaacagaagaggttaataattctggatgtggaattctttcaaatgcttaatttagattgacacatgctacctctttgatcacttttagagcaaatgtaaaaagtagaactttgaaaagatcattcttttcctttcccattttttgcttctatcttcgccttagcctgcctgctcactgcataagtttatgattatggtaatgttcttatacagatccaaaggtcagaaatgaattggaaactattcccatttgaaaaatatctgttgtggtataaatgtgctgttttctttcctcttctccctgactttagggaactgctcgcagaaagaagaaggtggttcatagaacagccacagcagatgacaaaaaacttcagttctccttaaagaagttaggggtaaacaatatctctggtattgaagaggcaagtatcaaattttgttactttaaaaaacaagatttggctgggaaaagttaacgttaatgcattaaatgggttgttttttttttttttaacttagggacttcaaagtccctaagatgtgtttctaccataaattaataaatatcagggagctcattaagtctgaatgctattagaatacatattccattccaggcaaaatttcacctgtgcttcacagtgaaatactagttagccagacttagtttaataaaacatttgtttttaaagagactggtcagcattgctaatttaaatttttcttttcttaataggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatgtgagtttcctagtaatggttttaccagggaattactcatttagcagctgatttctgatctcagggctcagaatggatatgagtatttttaagtttggaaatgcaagctttaaaaataacagatttgtaactgattttaagcaactgtccttgctcaagtttgcagtaattgatgtagcgtgccatgattgttacacttgattttgtggaatgttttctacttacttgatttggatcagatactttattaactagaaatgatgaaaatgttaatttggtgctttgccaataactacttgtaagtttggaattgaaaaaaaaattagtgtaaattatgaaattacttcagtttcatctatatagttcgtattaccagtaatcttttaaaaatggcttgccagtattctggcatttttaattacagtgtgatagggattttattcggggcagaaaatagtgtagctgaatatacatctgaggatgtggcagtgttatgctgttttctgtgcttaaaattttgaagaataggaatgcaggaggaagtcagaggcttatatatggctctttagttacccatgtttttctaggtattgacttaatctgcctcaattttcatttttattatcacattgagttgcaggttctaaactgtcagggctttcagagctgaaataggcttttgaagtatcccactgatgcctgtatgggcctagtacataactctcctgtgtacgttcatattcttgtgtgataaaggagagtggatgcttaccactcacagactctttaatttttttactttaacttttttcatttcagtaagtggttgttgagcatcacccttatgccacacacagagtagttgagaaaatggcatcttcatttgtctcccaaaatctcaccatgatttggtatgtgggttttacctgcactctaagagttccctactgcccttatactacctcagggcctatggtggcccagagggattgaaaggatgggtatggaattttgtttgttggctgttcctagtattttaacccatttgtagacattagaatatcatgttattgatagtatcatagataaaatcccaaatgtcccttatcatggaaataagttgtaacaacacttggcatttcatctgttctttttttttttttttttttttttttggtgaatatttattaaaaacctagacaaataatgtttacattttcctttcatagctgtggatggaaaagcaccacttgctactggagaggatgatgatgatgaagttccaggtaggaacgtttacttgtggttaacctagagaatcttagcaagggagaataagaaatctttgtaggaaaaactacccagggaagaggggtggtaagttaagatggacatagatcttacttagaatgagaaaaataatgcagtattaggtaattgagaattatgtttatagacttgacttggcttgtttctgtttgggatcccaaggatgtgtaggtatctaaccttaaatattgaataaataagtatatatatatagtaccctaaatataactattacctgcagagcactaatgacccttgctccctactttgaaactcatgaatttacaagaaggtgtggagttgttcaggtatcttgggatatatatatgcattctaaaatctgtagcagcataactcctttgggaatcatgagacatttttgtctcttacctgttattggataaatttacgttcttctaaaatatttattgggcaggagaatcactggactcataaatattcccactttgcatagacaggtatccttaggaatccaggaaaattttaacattgtgtgtcattgtattctttggttctgctcccccactattgaccaatgtatgagatgggaagaggggggcatttttttcacttttttttttttttgcattcttgttcttggggctatgacacagtatttatcatcattggcaaatgaatgtctttccttcatccccttttaatatctgataattatttgtagatttggcttttttaagaatttctactcttttccttttcctagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtataca

SEQ ID NO: 36994 - DNA, 437 bp, Homo sapiens
atgcctgaaccagctaagtcagctcccgccccgaagaagggctccaagaaggcggtgaccaaggcacagaagaaggatggcaagaagcgcaagcgcagccgcaaggagagctattccgtgtacgtgtacaaggtgctgaagcaggtccaccccgacaccggcatctcgtccaaggctatggggattatgaactccttcgtcaacgacattttcgagcgcattgcaggcgaggcttcccgcctggcgcattataacaagcgctcgaccatcacttccagggagatccaaacggctgtgcgcctgctgctacccggggagctggccaaacacgcggtgtcggagggcaccaaggcggtcaccaagtacaccagctccaagtaaactagttacctgggtaaaagcgctaacgacccaaaggctcttctaagagccaccca

SEQ ID NO: 36995 - DNA, 435 bp, Homo sapiens
atgcctgagccagcgaaatccgctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgccttagtaaacccaaaggctcttttcagagccactca

SEQ ID NO: 36996 - DNA, 157260 bp, Homo sapiens
aagtagcacggattgctcatccgatccgtgccgccgcagggagtgtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgaggtctgtgctctttgttgctggcttttatccctccccgcggcgccccctcgcgcagcctccagactgttcagccggtgtccgcgggcgctcgctctctgcgagccccaggttcgcgcgagttgcctgcgggaggggtcggggacacggacagacgctgccctaccagggattcggaggacctggtgggcaagagcatgacccagcgactcccgcctcgggcaagcgcccccggcttccagcgctgggagcgccctgggcacgccgggcaggtggaggaaggctgggcgcgcggaggctcgcggaggcgggcaagctccactcctccctttcgggacccggccagggtggtgtgacagccgccccgcgcccgcgcagcggcaagcgcgcccagaggcccaggccgaggcttactgagcccccatggccctccccctccaccccttaaggacccggggggtgcggggagaggggacagttcttgcagggggtggtgccctggtctctgctcactggcccaggccgctagggtccaagtgtgggtcgcctggctctgctgtccttggccacaaattagtccacaccttctttttcctaaaccaggtttcttatttttctggagaaaggatgctttcttccattctccaaatttttttgatccaagtagattaaacactactagcgtgtcaggtagctatggcaatcttcggaatacaggaaaaggctgtcccctccccaggaaggagggacatgcagcctctttgtgccaccagaggaaaggctgggccttgacagggtgaggcttgatgatctgtgggaatctggacagcacaggggattcagggcccagatagagaggaggacaggcaggtgggggccgcagcagtctgggaagaggtcctggagcaggtcctggccatggaaggtcctggccatggaaggtttccatggggaagaaatgggagaggatatcttacttagctggagggagtgtgcagcagtaaagatcacggtggtagaggccagcaaccctgggtttttatccccactctgctacttggaagcttgggacaaacgctccaacccctctgaacatgcgaaacagtgctgatgtagcaaacactggagcacagctctaactgtggtgggtggggtgctgtgagcattttggcaagatgtacctattccctatagccaggctcttctcagctgcccctgccaggctggcacctgctggagcagttctccagggtggccaaggaggagattgcagggccagagcagagagagcggtcacagggcaagcgtactggtgctagtggtgcacccatgactgctgctgtcagctcattcccacgccctgccaggctccagggaatccggagaactccatcgggccgtccatggttccctgggcctggggtggaggtgcagcatctctgggctcaggcagaatgagcccagactggctgggtggtgaagaaggtgtcagggcagtgagagctcctccaggtatctcgggggtcctggctgctgagggataagcatctgattttcagggtttagcacagcccctctctccatgctttccccttcccagaccttcctgctggcctgaccatgccctggccttttctagcttcttgcttccactgcttcagacttagacatgccaagtcgcatactctaggggccttggggctaactattgtatccgacatgctcactccttccctccaagctgcagctccatatttaccctactgaatacaatcttttcaactgctagatatgaaagttatcccagagagcatctgaactgaaccccatttttcagatggggaagttgagcccagagtcacatggcgaggcccaggactagaacctcagcctcctggccctgtatacaatgttctttgcgctgtatcctgccacctttttttttttttggcctattctcattcattcattcagaaaatgtttactgagagcctgctgcgggtcaggcattgtgggagacacttttgccctcctaaacttacatacagggaagtagtgcacaaagaagaaaatgggcagtgaccatgtcgtgtgcaaaaaaaaaaaaaaaaaaaaaaaaaaaaaaaaagctacaatagtgaaaaaagagaggggcctggggaatgcattacatgcaacattgtctgatggtggtggcagtcatggcaggcttccttagggaaatgattttcaaatgaagagctgaaggatgaataggagtttgccaggcaaaagcgggcgagtgtgaagccttgttctaaggggacaaacggaacagcctttgaggctgggggccagagggaattgggagaactgggggaagtccaggaccccggaggactgggagtgtgaggaagtaggagatgtggctggagagagacgggcagcccaggtcaagaggggccttagagaaagttagatctaaataagagtaatggggagccattgaagggttttcaggaaggcagttatgcccctagagtgagtgcttacggctggcaaagcagtaaggccaaaaacagaaggctgctgcaggccagaggggacaatgaatgggggtaaaagtagggtcagagaggggtgactggaaatggtggctgaggtcaataggggaagatgctggagccagaggaagggagctgtcccacaggtggatggcgtgagtggccttatctgtgggggccttgtctgtgctcctggagggacaccctagggttgggctgtccaatacagtaactgctagtcatatgcaactcattatatttaaactaactaaaattaaataaaatttaaattttagcttgtctgttgcaacagcctggtttcaagtgctcagtggacactgcagctagggactatggagctggacagtagagagaaagaacttgtacatcctcgcagaaagttctattggccagcgctgtgctacgagcagcttctgggcctgcaaagcaacttgaggggaccatcctgggcctttccctgtgtaggtgtgttctcccaggtctgagcaaaggtctgagcaaagggcagaggagagcaatgggtaaggcagaaaattgggacaggcaaaaacctgccacaggacaggagaattcagagacaagagaggggaaatggttttgttacaaaacaattctccaaaatggaggtgcagaaggtccctgtcctcatggggcacacacaggcatctggtgagtttggaggccaagaccaggattctagctgggctttgccagtcttgtggccttaggcaagccatgctacacccctgcacttcaggttcatcttccattaaatctaggccctgcctccctcctgggattggaggcagatcggagacttcactaaaaggtgccatcaccaaaggccatgcacaagaccagatgagtgctcagggagggcccttagggatctggggcaggcaatctttgcagcaggcaggactgggccacttcctgaagaatgggagaaggacactggggagggcaagcctggtgaggcacacggcctgtgcaatggcctgggggtgggactcccatgccaatggggaaagcaggtgagggggcagagactgcgtgtatgaggcagaagggagagggagctgcagggagggccggccaaggggacccaggaggacaggaggcctgagaggggagccagaggcagatctgaggggaccagcccatgacgggggttgtgcagagccgggattggaggatggcgggagccagctctgtggggaaccaggagtgtgctttccagacctcaggccccagctcttcccccatcagcgcctctctcctggtctgggacccttaacgagcactccagctgcctgttatttgatttgcttgctgtgaagaaagaagctggaatgtcccaaatggagaaaatcagatgacacctaggactgggcagccgtgtgcagtgaatgagaagggagtggaatttaaaagagccaaatgctgggccgggtgcagtggctcatgcctgtaatcccagcactttgggaggccaaggttggtggatcacctgaggtcaggaattcaagaccagcctgaccaacatggtgaaaacccatctctactaaaaaatacaaaaattagccgggcatggtggtgggtgcctataatcccagctactcgggaggctaaggcaggagaattgcttgaactgggaggcgaagtttgcagtgagctgagatcgagccattgcactccagcctgggcgacagagcaagactccgtctcaaaaaataaaaattaaaataaagagccaagtccatcttctaggcccaaggggaagcagaggagggtctcagcagccacctttaaggtgagttttgagagatgccaggtagactccctaaccccagtaataacatcagaaactgtaatagaaatgtcctgtagttatagggtgcatacaggggccaatgctatgcgtgtcaccactatatctctttcaatcctcacaacttccctaagggactgacattcacaccacccccttttacagatgagaagactgatgtcactgtacctccctcccactatctgtgattcattcctttggatgttaaggaatctcctgggagaggaagtggttgaaacttccaagctaaaatgttaaggaaccccaggcagactccttcatccctaaaaataacaacaattataataacatgtctcatgtttatacggtgtgtgattttggtgcaaaagtaatttcagtttttgccattgaaagtaatggcaaagagatgtaggggacagatataggggagggatcaaagcagcagctgaaagattggggctgtggatggggtcctttaggactgaaatgctgggatgaggatgggaagagactcttaaaggggatgtacatgtgtgctagggtgggtaacctgtgcacagtgtcctgtgctgaccacagctgactggacctcagtatatggacagactctggatccaggtttcctcaaatgcagccagcacaaggtggtaccagaggagtcaggggtgggatccagaccccagcaggcatctctccttcaccacaccttcccctttccagacaattaactaggtcagcagtggcccatacatggcttgggtgtgccctgctctccattccagggccctcagcagacattattaatcaattgctgcacactttcccatggagcttacatgcagcctcagaatccttttcaacagtgttcaggaagctgctacttactagtgacggttggtgttcaagacgaaaagctatttcataactctagattttgtttttttaataacaggtgcttactataaaggcagggagaattactagagctctgccgcttctccaaaggtcttcgaactagcagatagctctgaacagactgaggacctcaggaggcagccaaccctcataggaaggtggtggggaaaaccaaaagcatctcaaacaccattccatctgccctaagcacagctttacggtttgataactcccagaaagatgtcttttccccttcttcttaatcactctagacttgccccactgctctctggaaagcctcctcgaaccactccaacccaatgtgggctctctccctgctccaacttcctgttgctcttcctaggttgtgccagacatttagctcagagaaggaaaatagacatagcatgtgttgttggctttccttatcccaaacggtagcagatactactcatcgctcaatacactctttcccattcagcctaggtaggcctcggaatccttctcgacacagtcctccagtggcacggagaacagcaacccaggctgccgctcccgtccattagagtcagtgcacaagaggaaatccatttgccattcatggttcaacccaaccacattgtacaacggtctctccatgtgaccacacatgacccgatgacagcgatagaggcatgctgtcttgggtcccttattaattctagcccaggactttgcacataatacgcagctctcacaaattagctgttgatgtaaggtccccctgttagaggctggggaaggtttattagtcagctctcctcgcagcgtccccggccctggacccagcaataggctcagcatttgctcagggggtgtttctcagcaaccagcagaggatgagatgattgacttctgtgtgtccaggctgcatgccttgtcctggctgggagagcaggaaaggctcagtgatgtgttccccactgggcagagaagctgggggcacccaccccctcccatcctctactcccaaggtcaggagcttcatttttacctgccccagctggctgccaaggtttttctttacagagtcggggggtggcaaaatggtgaagcaggcaacaccatagcatttgaacccctgccactaactgtgtgacctgagcctcagtaccctaatctgaaaaatggagatgatgacatcctccttacagggttgttgtaggattaaatgaaatcatttggctaatggcaactgtaaccattgccacctcgctcatcattggaggaggtaatatggggcttcatgcaccttgtctacaacttttattagtagctgatatttattgagtttacgctgtgtattgagcttacacttacactgtgtaccagggactattcaaagacctttacatctattgattcactaaatcctcacaataatcctatgaagtggttactattgttactattcccttcttacagaagagagaatagaggcacagagaagttaagcaaatttcccatggtcacacagtaagtgagtagcatagctaggccttgaaatcaggcagtgtggcccagagctggcatcctcagccactaggatgtacttgtctgtatgaagtaccatacctctctaactctgctgaggccagtcaaaccagccaggggctggggatctgttcagtttggtttggctcccagaggcagtgtttactgaactgccttggcgtcagggccgtgccaccatctttgttgtaagaaagacattatgagagttgctaattacatcaggccttggtgatgagtactctgagggaagcccttgtccagtcttggcctctggaatgcttgggcttcccagggtggatgggtttgttcttgtctctcggactctgaactggccactaggaagcatagcagcaaatctagggttcagccagtggcaaaggcttttgtatgagccttgatcccagatcctatttgatcactctgcctttgctgttcttctaccttactgtatactgtctgtctgtctgtttgtatcagctgcctgaatgctcccttttagagccagagaggggtaaaagatctgaagtaactaaacattttaaagttactctcccctccttctcactgatccagatgtcctcaaaggcttgcccttgtacgggtgatgctggttgcattagaatcgcctggggagctttcaaaacacgccaggccaattgttcccaatacctgctgcagatgtctgtgggtagggcctggctgtaagtgtctaacgagctcctcgggtgatcgtgttctgcggctggacctggcaggccctgagaatgagagagagagagagagagagagagagagagagacagagagtctgtgtggcccagtgcctggagctccctgtacagtgaaacccagacccccttacccgggtcccaagcagtgctcaaggggctgaggggcagtgatgaagctcacggtgagatgtcaacaaaagtctccgtgtgcactgggaggtttgaagaagggcaagcagcaggctttttgctgttgttttccaaaaacaaaatcaactgaggtttgccctccaggaagcctcagaagtccttctcccacctctttgggttgggttctgcccctcccagaaacagtctattgagccctcagtcagagggaaatcagcaggcttctccaagggaaactgaggcctgggtctggggagactagggtggatggggtcaccagctgcgctgggtgttgtctgggccactggcaggccccagcagcagcccctgctgacactcccgctctcccagccacagccctgggtgtggggcctccttgcagagatgctgtctgtggcggaaggggtgggcctgctggcagggggtgctctcctggtccttcaaagagcaagggccagccaagcacaaaggggcagaactgcctgccagagaggctgggcatggcctttgaggggacactgggcccctgtctccctgcctggcggctattgtaggttttcctgaaaccccacatggctggggcccacgtaggctgggcctctgcctccttggccctttcccatcctcactcccaccccagccttgcctgcctcctcaagtctgggtcattctcctttgagcattcgtccaggcatttccctctgcccacacgctccttcctcctgcccaccaccccctcccttcaggcgcttcggttttttatccgctctttgggttgcagcaggagaaccttgctgcccctaaaggctgttgtgggtcctgagcttctgccatagagggactttgcacccgctgccctctgtcaggctgcagatgctctgcgaaggcacctctttagcaccaggtcatgctctgataaggtggcctgtagggcaggtcagaaagggtgacctctcgggacagggatgaagaaagggggctgggttaaaggggcatttgccagggctcttccaggaatagcttcatccacctccccctgaactggcacttgaggtttcctggagttgggggaagctctgtgacatgggaggtcagagggtgctccggacacctccagcctcacccgactccatagaatcaggaagggccttcataagtcaggtgctgctctaggaatttcctacagcagccttggtcctcaagcttacacacctcagtgacggggagctcactaccttatattgctgactgttccctggtaggacatctctggctcttaatgtcgtcagaggcccagccaatctctacacccaccaacccacaactccagcatgtcttgaaagcacctcaaactctacgtgtctaaactgagcaggaaatccacccctcaccagcatcccttcatatgtgagcacaatgacctccagccacacccaccccagctctcctgcccacaccttctcagcctctgcagacctgtcctctcctctccatccctgcctgccctccccagcccgagctgcccccctaactcttctgctctcacccatgctgtcctgactctcttatccacacagtagccagaggggaccttttaaaaaactaagtgtaatcacgccgtctcctgattaaactcttcagtaactccctattgctctcaggctagagaccgcattgctaaatgtgacccatatggccttcaggtgcagcccttgtcactctctccagcctcatggctcacctgcccttgcttctggagtccagctacatggtggcacgctgtcaaggctaggagcacagactctggaacccgattgctgggttcaagaccagctctgccagttactgcctatgtgaccttgggcaagttattcaagctctctgtgccttaggttatacctctgtaaaataagggtaatgataataagagtacttttatgagggttgtttttaggattaaaaaaaagttaagatataaagtgctttgagtagtgactggtactccagtaatagatcatccaatctccttgaaagagccaagtttcacctctcacaggcatagagtcaaggtgtgggctctgagccaggcttcccgggttcaaattctgcctctgtctttccaggctgtgtgctgtcttgcaggttacttggcccctctctgtcttagtttcctcgctcatgtaatgggttgcagtgagtgctggaggaattaacattaagctggtgcaaaagtaattacttttaattgccattgaaagtaatggcaaaaactgcaattacttttgcaccaacctactccatgcaagatccttgcctggctcctaagaagtgcattattgggttagctttcagcctctcccctgtgcctgggcccctcacctggtgagttactgctcagcttcagatcttggctcatgtctcacttttctgccatgagccagactagtccatgccccggctggctctcagctccttgccccttttggccacagctctgatgacaatggctgccccacattgatgtgtggtttgtaggctcttctgtttccctccctagagtatcaacttcatgggagcagcctcagtctgctttgcataacaaggttcccaacattaacccctagaacattgtagatagtcaatacccatttgtgaaaggcaggaaaggaggaaagaggtccccaacattcaccccaggacttctttgtggtggggggcccctgccttatcctgcaccaggcctagagatgacccctggacccctgagatccttgaggtcctgggccccttgccaatctgcctcccatgcacaccatcagttctggggcccggttccttgactccttgcggcagtagcagggccttgggttagctagaaggaaggacttcgtcatacgaatgctgcaaagctcacataggggtatgtgcctcctgtccctgacttttttcctgaaccatagagcctggggccacatctgtgtgtggttctggtgagacagggaggcagagggagacagaggcagtatgtggtatctggaggacccgcaggcccctgtttcatggccctgggagtctgtgatcaggtgccaagtccactgcacgaagagaactgttgaggtagggagaagacagctcctaaggcacccccgtggcaccccctccctgtccccagcacacaggcccctgcagcagcccatgcaagtccagttctggtgggtgtgggttggatgtcttgatttcctccactttgatttcaccctgccaagctgcctgtgccctggggcatgtggctacgagtgggcctgtccctttaacccctttggtggagccagccctctcctgcagtccctgggatgtagcccatggggccagcactgagcagccaggtcctgcctctgtacctcctcacggaaatgccctccctcccccatgcccatttatcccaattctgccaaagcccacctcctcctgggaccacaaggatgagtcctagagggctgacctaaaagtaagtaattcggttggagtgtggattgagacatctgacccgggaccctgacatctgagggccagctcagtctgcaacggggcagccagcccagcagcagttatgctgcaggatgatcaaaaggcctctagcagatgggatcaagtccctgccctgtgccaggcattgtgatcagagtgctggcacaggggccggagcttcgtctgctgtggtcattccagtgggcacctcctcttccttcaactcctagttctcagggtcaaaaggcagggctgcaggtcagaccctcctcactcaccctccctttccagaagaggggctctgagtttcccaggaggaggaggagggacatggcaagtgcaggaaacttgaccacttgtcgcagaggtgtatgccatggagccagggcagcaggggtcaggccagccttattacagcaggtgggaggaggcaggcctggcactggctcaagagagaagtggccttcacctggccaccaaacaaaacaagctggcaaaacaggtgctcaccctcctcacatctggatacctctgtttatttttttgcctcatctcattttatcctgccagctgtcttgcgtagtctagcagatcacttagattatctccattttatggatgagaatatcaaggtccagaggggttatagattttgcttaatacacagttagtaggagagttgggactagaccccaaggctctggcactcccaagtgtagtcaagctgatatgatatgatttcaacactgccaagctctgcctacaatagattcttcactggagtttgggggccatctgtgccaacccaaaagaaagtcccactccagcctccaagggaataggaggcatgcactaataatgtcaaaaatcaattattaaatgatattttccacctaaagtgcttagcacagtggctgatatatggtgttcaatgtgcatagctgttataattaatattaactcttgtttaataattcaacccaaaattgatagatgctccgtggtttcccaggcacttgcctctgcgttatctcattcggtctccacattggcactcaggaagctggcagggggtggtgggtcatatccctattttgtagattccccctgaagggacgtgccaggctcaaggtcacagctgcaggtctcacctggcttctccctctgggctgtgtctatgccacagcttggacccaccccatgtattgcagaggcccaggttgagctaggacgttttaagagccctgaggctgagacacagggagggagtgttccctaaacccaagaccaggctggagccacattctctggggggagtgagtagctgcctggcattttccctttgatactgatacaggcattttaatagctgcaaccgatcaggcgggtgatgtttcagctctggccacatagggcattccaggaggccccggctgccagcaggggcaaaacaggaaggcttctctgccgagggtagctgagggtccaccctagggcctcatcttgggggtgtctcaccatgggtctcaaagtcagatgtcaagggggccaggctggtggcctaagtaggtgaagctggctttggagagagagtactttggtagcctagatggcacacatccatctgaaaggggcaaccaccacacagcaccacctgattgtacatgctcagtgttgacaggtctcccattgtgcaagagagaccagaactggatgtgaaatctcctgatgtgtgaacaaccaatatttattgagcacctactatgtgccaagccctgttttaggcgcagtgaatagaacagaacagaaaaaagtatccaggtccttgtcgaacttacattccagtgctacaaagagacaataagtaagaaaaataagcaaaaaaaaaatcctaaggaggaaataaaacaaagtggtgtgctgggggaggaagaattttggaggaaggggtgcaggaggtgaggaaggcctaacagcaagccaggtaggtagctgggaagagaacacccaggcagagagcccagtaagtgtgaaggccctgaggtagagaaagcccagcatgtatgagagcttcagaggcctgtgtgattaccctggctgccgtgttgagaaaggtctgcaggggcacgggcagaagtcgggcattcgttagaaggttatcacagtaattaggccaggtggtagtcatggaggtggtgagaaggggtcagatctcggatgcgtctggcaggtaaagaacaggaattgctaatggaatgggtgtagggtgagagaaatagacatcaatgataattgtgaggttttgagcaactggtgggatggggaagctgatggtaggggcaggtccaaggaggagttgggagagtctatcagaagctcagttttgccaggctaattctgagatgcctatgaagggccatatcaagccagcagccagatagatgcatctgaagttttgaagaaaggtataggttggagggcgtcattctgcatagatggctttgaagccatcagactggatgaggtaccctagggagccagtgtctagagaaagaagtgagaccctggatgtggaccctgtgacttccaacatttagacatcaagtagataagaaggaatcagcacaagactgagagggcacagccagggtggtggaagggaaatggggagagtgcgtgtcctgggagccaagggcaggaagtgccccgaggaagaaggggggtgagcaaaggctgcagcctggctaagaggaagcatgaggactgcccaccagatttggcaacccggaggtcactggcaacctgcaggacagttcttaggggacagtaggggaagagccaggtaggagtggtccaggagagacgtaggaggcagcgaagattgtcatccaggagtttttctagggaaagagctaaccagagtcaaaagaggattattctcttttccgtttttatgctgggaataacaacagcatatttgcataatgattccgtgagggtgggctaactacagctaaatccagcttgcagcccatttttgtaaatatatattttttatgggagcacagccacactgatttgtttccaaactatggctgctttggcctgcgatggaagagtggagtaggtgtggcagagatcatgtgtctcacacagcctcaaatatttatgtttgccggcccctgatgtaaatgatccaatctagaggaggggattgatgaggcaggaaggcaggggacttgctggcgacaggaggggttggccctcgtggaagcacagatggggagcttaggaggagagaagggtgctggcaggcgcagatgcagatggacggcacgtgtagtggtggctgcctctggaagccctcttctgcttgcttttcttctcaaggtcatcagttgacaatgaagttgggggaggggacgttggtggtttggggagaggaagtgtgaaaactcccaggacagtgcaatggtgaagggttgagggaaccacagaatgattgctgggcttccgtttgagatctggatcatgaatttaaagtaagatcagtcggcgaggttgtgtgtttctcccgctttaccctgctgcctgtgtgcaggggtggggtaggaggagacgttggatctagccaggctcgtggcttagtgaacagggcgggtgtcaaggcagtggagggtgcagacagggggtggtgataatcactggccacagaatttgagccgggcacggagggaagtgacacatggtagtgatggacagtaaaaagttggtaggacccgcaggttgaaggccctgtgggattcgagggtccctggggccggggtgttaggtccttgggaaatggagatctgtgggcagagtgttgaagcctaggctgtggatgggtcatggtgctgttgagatttaatactctttcaaaataaactctgggcaggccaagaaaacacttacaccctgaactgacctggttttctagctgtgcctgtggtagctttgcctgctcagatgcctccatcccctccaatcaaggctcccgatttccgggtccacctttcccacctgccttctctcccaaactccagagctgcccatgcctaccctgctgggttccacaaactcgccatcttcccacaacgtgctcttgccgctgttatgtcctaggggtggcatcttggctgcccaaggcagggcctggctcccacaaccaccccaaatccatccagtgcccagttccttcttcctcccacatctctccactgggtgatgaccatgacatcctccagagaggacctcagcccaagcggtctcactggtctatactcaacgggctgctggagtgccctttataccacccaaatttgaccacatgacctccttgcttaaaacctttgaatggttcctccatgctagaatccttacctgggcacacaaggcctggttattagtcatggttctccagagaaacagaagcaataggctgtatatagatgcacagaaagcgagttatcaaaagagattggctcatgtgattatggagatgagaagtcccttaatctgccatctgcaagaaagaggcccaggaaagccagtggtgtagctccacttaaacctgaaggcctgagagccaggagagccaatggtgtaaattccagtccaagcctgaagggccaagaaccagttgtggtgcagggggagtcaatgttcaagggcaggagaagatggatggtccagctcaagcagagagagcagagtctcccttcctctaccttgttctactcaggccctcaacagatcagataatgcccaccccctatggtgaggacactgttctttcctgagtctactaattccagtgctaatcgacatacctagaaagaatgttttcccagctatctgggcatccttagcccaggcaagttaacagataaaattaaccctcacagctcccactcccgactcaacacccaggccctctgaagtctacagtcacctgcacacatctgagtatgcttctcccacaccaagctcagctgtttgctgatggactgtgactcattctctattttgcagtctcacaattagtagaaaataaacataggatctattgaataaaagcattgaacttgaagttagaggacccagaatttaagccctctggggtttacttgttcaaggcaattccctttccctttctgggacttagtttcctggattatacaatggggctgatttctagcctgcctgttgcacgggtcagtgatgagggtcaggtgaagtctcaggaaatgtgaaagtcacatggaggtctaccttaggttgggttcccaagggaacagtctccaaagtggaggtctatgagtagatgacttacttatttgacttattggcatcaacataggagggggagtgagggaagcagttgggcagaggaggggctgagctgtgatacagtcatgacagaggccccagctggtcctgtgggagctccgtagctggggtggccctagagtcagtccaatttgaggcagaggggccaggtctgcattcctcctgtctatcagtaattgaatatgggttgcctttgggggagagtgtgaccctgatcaaggctgcttccttgagctgagagcagctcccagaaagaggctcagccatcagcagccaacactcccaacagctaaaccactggtctaatcctgggagcctggatggcccaccacagcacccatgagctgtggtgctttatggctgtcaacaagccccagaaccagtggcagggatccatgttacacattcaaagtctctgcccctgccttaatgacctgccttcctgccccccacattcctatcccatgtcctcactcagatcactccagccacacttcaccccttcctgttcctcagatgctccatgaacaatcctgtctctgagccttcgcctctgctgttccctctgactggaacacacttcctccagacatcaaaggattcattttcttacttcctccaaataccgcatgactcattttcttaccttcctctgggtttttgctcaaagtcccctcaaaaagaggaccttccctgacctcctggtataaaaaaaccaccttccatcattctctgtccccttgctttactttatttttctcccagcatttatcactgcctgttacacattttttgtttttctattgatttttttcttccacaagaagttatgcccctctaggggtgtgccccatgaggatggagcaggggcaccacccactcatgccacaaattctgtctccagcccaaccctgtgatggcagcttgctcagtgctgctgctgagtgggtgacaactccgatggttacaacctttagccaaaatgctgccaactcctctggtcttggcttgtcagtcatttagccgacctgtgtcatgtgccttctgggtgccaggcccccaggtgattggtggggagggatgtggaggcaggttcgtacagtcccttacaggaaagcagcattcatgagccaggctcagagctggctatcaccagaggggctatcaccagactttggcctgggggctcatttgtttgcccagcggccgctctgtgcccacctgtaccttggcctcaacattcatcctcctaattgttactcagcctcccctttctaagtgagggtccccactttggggtgtttcccctcttctggtctaccttgatctcggcccccttctgccctcagagccccccatcccatctgtcactgtgttccctccccaggcatttgcactcaccttcctccagcaggtggagcgggctttgtgccaggaggcgtgagttcacacctcagatccactacatcctggctgtgtgaccctcagcaaatcactctacttgctctgaatccttgtgaagctttctgaccttccctccccacccccaaaccagaggcgataccacccttatgacacctcccatattactttcttcacctctcttgtggcccacactgagtggcaaaatttcacagtagtgaggaagcaaatagctctggctgtcatcctaactcgtcaaccttgtcagggtagggactacagtacatcaggtgcagtcagtcctggccagccagagcacaggcttcatgtggccaggtctttcagttagtttttcaagagaaattacaaatgcagatttgcacatgaaaccacccacttcaaaatattggcaacaaattcaataataataatgatttaaagctcactgtgggaaccaaataaaatacactgaaaggcctatttggccctggggctaccagcttcctatggctgcatgagcatcacagtgtgggtttgaatcccagctctgtaccttacttcagccttgaccttggccaggtgcagtctcctctctgtgcttcaagtcccttacctgtgacatgaacatggtaatagctaacattcattgagaacttcctgggtatcaggtgccattctttctatgcattaatctttctaacttcgcagtaatccaatgaagtgaggactcttattagcccagagtctgagaactgtgtgttagtccagtcagcctggctctagaaatatccctgttaatggctagtctggccaactttgttgcaagaatcaagtaagagtccttatgagacccttgtcacattgccctgtgcagtgtaagcctgcagagttgacacacaggggaatcctgcatgcatggtcattacgcttgctcttctccacttgccaccatgaacatgacaactcctcgagggtcggggtgttctacctctctgatgctcccacctctttgggaccttccaggtaggctcagtgatttgaagggaagtgaggaagatatttggtggaggggtgcagagagccttgccatccccctactgctgcacccctgcccagcttgcaaatgctagctttgtaagggacaccagaagaacagaaggcactgtccctgcccaggggtccatcaggagcccagtccaaggcagaaaacaattagcagagagctgagaaaagcatgtcattgtgcacatgagcatgaggtgcaggaagatgcaactggtttataggatcctgtgtttggggttaatttctttaagagtgctccaaagacatcagacgctgtgattaccgggatgggctttcttgtctgcttgttattacccagatgcccggtggccagtggaaggccattaactgcctgtctttgatccaggaagagttctgccggtttccccctcttcctgccctcctcgtcagcccacagctgctttccagggcttggtgtctacgagctcctggtgactcctcttgtctgtctccttgtacagaaatggaagctccactcaaggaggcgccgggaggccccaaagacatctccaggatgtaactgcccaccaggtaagcagccctgcaaataggtgaccgcggatgttcctaagactgagaccagaggctcttcctggtggccatgctctagccacacctcactcaggccgtcacttttcatttgaaagacaggagtgacaatatctgtggttgccttccatctgctcacagattggcctgcctgccccgcatccatcagtccacccaccattcatttgttcatagagtattttatgggcctgatactctttgaaccaggttgtggtgaagtcggataagatgatgggcatgactgttttgaaagttatgaagtgctatgcagcgtcaaagggaccatcagccccccaaggggaggcaccttgcttgctgtgttcatcattgtgtccccagcttcccaggtatacaaaaatgtttgttacctgaatgaatgaccctataattgtaagaccttattttctatagctagctggattagggcaatgtgtgttcactatatggcctctaggctacatgcaacacacacatgcttacatgcaaggaatgaaggcacaagccaaaggtcgcaaggtgatactgtgtaatacagtgaactggtctaatctagaacaaaaatctgctttcgccacttactagctctgtatgggtggagccctgacctgtctattctagtgctttcctctgtatccttgggcctgttcctcaactgtgtctattcacctgtgtaacagctgcgtactaaggacctgctgggcaccatgcagtgtgtcgggttcaagtgcattgtccaccatgaatgcaagtgataagttacagcttatgagaaattttctaggtgcctgttacttttctaggtgcctgttattgttaagccatgagagtgacagatgaggaagtttcactgtttccctgaggaactagaatgcactgtacctctttagaggtggggaaggaaggcctaaagaagagttgcaggagacaaggtatcacatttaagtaatggcagagagttttggtccgctactggcctctgccagctcagcgtgtggcctcctcgatacccacggtggcaggtggcactagcagggtgctcactgggctctctggctggccctcctctggcctcagaagccgagggacccaagtaacactcacccaggtccccaagccagggaagagaggctgacagatgttaagcatatgggaaacgaaggaccgcatttgctggagagtgaatgggctggggtgggagtcacagttccaggatgctgccctgggagacaaggagaccgtgaaaagattcagctggacccggtgagaagagggtcgtccgggttaattaaaagggtgtccagaagccctgggaagctccctccctccctctgggcccagaagatagggcccgggggtctgggaaagctttcaggagaggagtgccaagattaatgagatggggtggaggcaagggttgggtgatggggcctgggcagagagaccgttcgcatcagggctcatgggacagcccatgtttccaaggatcatgtctgttgcccttataactcttgggcaatgacaaccgatttttgctcagcgtatagaatgctggtcaagggcaggatatttgaagccacagaggatgtaggtttgaattccatctccaacatggaccagtcttatgaccttcagagagttatttaacctccttgtgcctcagttgccttgtctgaaaaacagggacaatagacaccagcaaggtagagattcctcgagataatcctgggaactgcttagcatcttctctgattcctagtaagcatgattatgattattttctcaactgcctctcgcacttcaaagatgcagagaaatccttatcaaatgccatgtcctagtgttgggggcacatttgtggccaggcagagacttgcctttctcccttccctgccttattggggaaagcacatcagttgtctgatggccttcaagtccatcatcagagtgggtggttctcaagaggtttcaatattgtgcctcagaaagtcaggctcaggtagtcctgggaggctgggagctggggaggaatgtggcaggagggggaaggacttggaagagtgcttctcttctccctgcctgctgggagtctgtgtggaacccactggtcctgggcagtgaggagaagaccatgaagcagctcagagggtcaggggaggaggaaacaccatggggagaagaaagggcttgaccttggtcctctgcggggaagggacagcagcaagggctgagttggccaggcatagaggaagagtgggcaggggctcctggaagggatacccctgcatgttgagaatttctaaaaaggcagtttggcccaaagcatacatcagagccagtgggcaatgcctgaagaatttaaagagaaggccccaaactcaggcaaaatcagagggaactaagatgctgttccggcctttcgtaactgagtcagggaaggactggaatggccacacggaagcatttcacatcatggaatcacagcaaaatctcctaggatgggctgggtcctgctgggtcccctgccctgcctctctctgactgacctgaggcttctcatgccttggtacagtaacctcctcaacagcaaacccaacctattataaataatagcagttactgccactgtgtcccacttgagcacctactatgtgccaggcacaggactgagcactttatgtgcattggtaaccttcctcaaaatactaaaagtaggtagaagggaattcagttctaacactctggaatgtctgaacatcctcaaattcgcaaagagaacatcactgtcattcttgcccttacatcatgcatttccgattatctcctgagggtcggagtttataaacaactttaaggctcctgatccttgcagaaggactcatacaattgtcaagtgccacatacaaattcaaagcttgatttacttttgtcttgcagcacctaatactgtaccccatacatagtagatgctctgtgaatgttcaataaatgagtatcagtagtcattgctgatgactggctgcttcctcgtgttctccctctgccatctgattggtttcagacaccttatccctcaccccaccccaaatcttgcctgatgctgaatttactgctattgggacaaaacaaacacactcttcctgcccactgcggttgctgagatggaagcctcgatcctcaaagtggtgcctgccctctgtggccagctaggccaagccggagtcctgcggtgggtgtgttcttccttgtggcagccttggggccctgggcggcacccagaaggcctgggacacataatcatgggcagaaaacctgcctctttccctttctatctgaccttcccagcatcctcctgggatcctccctgtcccaaaatagccatctactggctgagatctggctgcatcctgcttctgggctgcatgcgctgtttgccaagggagtgatgggcttgcaggcctgagaaggatgccaaaggtcaaccctcagttaggagggtcatggctgccagaagttcagaggaataggtgtgggccatttgcacagcatatggcctggtgggataggagaatggtcttgggaacagatatacataccatgagacttcctaggccacttgagaaaaatacaaagaccaaggaaactttcccattatctgtcccttttcttattaacaaatgaggagcaggacattatagtctagccagcgaggaaacagctacttcaggcccgccacgctggggctgggtggggctggcctgtgtcaagtccagggtggggcaggcagtgtgaaggatgacacgtttttcacccagagggaagaatggctagctcagctgctgaaggaaatcacttcgctgtcggagcctcatctccaagggaaagggtaggccagagtcatgccctgactgccaggccaaagggctttggactgcagcagtggtggcatgggggtgatgtggtcaggcttgtgcactagcgccatgaccagcactgcaaagaggacggatgaaagcggagaagtcgccttcagccagcctaatgggagaagccacagctgccttccgggtcagtgtgctggtgaggggtgcatgaagtgcccaggagccaaaggagctggggctctgggaaaacttcaccaaggagaggccttggaggttgttcaaaaggaacaaataagcaagtaggaaggcatattgttagggcatcatagactccatatggtgtccacatagacaccataacaggagaccccccaaatacaaggacttagacaaggtggaggtggaggtctcccttccctagcaggccagggctgggagctggctctgccatcttcatcttgtggcatccttctctggcagatgcttcggttcttgccaccccatgaccaacacaaaaggggaatgggacaagtggagtatgtgctcaaaccctcaagagcaaaacttgaaaaaagagacacagatcacttctgctcacaacccattggccagaacttagtcacgtggttacccccagattcaagggaggccaggcagtatttttcatgggtggcgatatgcccagatagaactttattacgatggtaggtgggaaaacagatatcaaagaacaactagcatactgcacagaggacattccaggctggctgagggactgtcatggacaaaaactcggaggagcaagaaaaaggcagtaagtttcgggatgacatgcagttgaagaaatctggagctcagagcagtaatgagaaatgagggtgggaggagatgtcaagactacaaagagtcaggctgaggctgcccggctccctctgtccagtaggaggcaaatgatttcatccagagggtgattgattggtaatggctgcctgattgattggggggctgtgctgagtcagcttctgaggctgtatccaggttcagcagaaaatgtggtaattgcttattgatgtctgctctggatacaggagtggtgggggagcagtgcctctgccctggctgtgctgtcctcacaggagatgatgtggcatcagagaaggtttggggagcagggatgtcacctgatacaatttgtattctagaacaataactagcagtgatgtggaggctggcctggaggggagagcagccccttccagcaacaagagtctgcgatcctacgaatagggctttattttcttatgagctgctatttacctttgggttgtaatggcctctccagccttggttgtttttccacagctgatgagagctgatgcccacacatcctaaaccctactctctagctagccttgccttattttccctggcaccagactttgcccccaacagcctcatgacatttacatgggcaggacctgtagccagagctttggtcacaaaccaggctcctcttacctcccctgtgctgcagcagcgcagaccccgagccccgcttctttgtggtccttcttatttcagacttgatttatttcagatcttaggaatctgcagaccaaagcgtcctttgtttctatcaatgaagaaaagattcaagagttgatggttattttagggagaatatttaaactaaaggtatactgtttcaggtagctccaaaaccctgctttacatgcaaataattgatgggctacttcggggtcattcttgctatttcttaaagcagatcccctggggccagcctactaagagatcctcctgttcgattgctgttctcgtcaatattcagactcccccttgttctgctgcagccagagtggtgtgctttcccctgcgatgttagcctcagtcctccccacccccatctcttcctcctgactttgcagccccaccgcatgtcccatctggcctcccagacacccaggtgcaaacccacaatagcaacatcagtgcccccttcgccttcacccactgcactccatcagccaggttctgtcaactccactcctctgctcaaaaaccatccatggctcctcagtgctcataccccccatcccaaagataagcccactttgtctctctagcctgatctctgaccagtcttccgctgtcctgcttttctttcagtaaaactgggctgctcccctgccagaacttacagtgtcccacttgcacacaactcatgctattctggtatctttgttctcagtttctacctagtgaactcttcacccctccatgtcagctacatcatccctgcagctccttccatcctctcctccccacttggcctcggccatgagttctgctgtttgatgagtatgttaacgtaatgcctggtgtatgctcgatgtacaatccaggcaaaaccacccactgggacaagtaatttgtcctaaaatgagaagtgcaaacagaccaagatgtatacacctgcagaggtttctccctgactgctagcattaaccatttgctttagatggtgtaggtgcttgagagcagcatgtagtatgagtctcttacacagcaagagtagcttttgtgggtttccagccagggagagccttcccacctacaaaccacactgggcagcttccttgccatctccgcctggatcctcaaacggcacacaatgaaagccagcaccttccccccacctggccctttccaacattctcgacctctcccagcatctaagccatgacctgggcttcaggctgaacaccaccatttccctcacaccccgtcaatcaccaagtctcattcatcccactctgtcaatttcctccacctccaccgtcatcacccttgttcagggtgctgccacctgacctcctccaaacccttctttacacagaagccagaatggtatttttaacattgatgtataactccagataaccaaagcacttcagtactttccatcacccttaggataaagccctaaatccctaacacagcttgttacctgctctgacccccctcgccatgatcccttctgcattcccagcaggccccctggcagcactggtgctgctggttgtctgaccacatttggagtaacagactatggctgacgggagccctggccaagccagacagaacgttatgctttagaaatcagccagtccataaagcttggactcttggctccaaacgaaggcccttccttggctgttgcagccccatttcaggcaactggcctgctccacaaggaaggttgaccatcaccttggagagggccctgggtttaaggagcacccccaccccccacagccatagctctctatgcccctcatggggtggagggtcaggtaactggcgtgggtgaggccaaaatgaccacagctgctgggagaccaggtgctgcgcggctgctaaaatgctccaccatctgcccctggaagagccttttctctcaaggccctctggctctgcgtttcagaaattcctggggaattctccaaagttcatttcttccccatttcctcccaaaagcacttccagatccccagccctcctggacgctgctgataatgtgtttctcctagatccgctctgataacactggggtggtcggctgagatttgtagggaaataaaaataaggaaatggagggttccggaaaggccagaagagccctggactgggaatcagtcccagaccttgaaggactctgagcagattactctcctctctctgggctttggtttcctcgctgatataaaaaggtgaatgactgaaaaatcatttggcagtatctggtaaagtaaagaatcgtgtccaataaagcagctcccttcctaggcacttctgagagaaatgctcgtctgtgcgtaaaagaagaagagatgctcactgcaacactactgtagtaagaaaaaaggaaaagaaaagaaaagcctaaatatttgtcagcaggagtgtgcagagatatgttgtgcagtattaaattgcagtactttcatcaatgaaaatgcacacacagtaaacaggataaacgagaccttcagactcagcaattccagggctggatctcctcctctggagggaaaaaagcaaacgacaagagaatatttacaatataagtcatttatctaaagttaaaaacataaagacaacacaatacaatcttcaacaactatatgcatagatagtaaacacgtaaagaaatgatggaaatggtaaacatcaaattcagcagggaggagggactgggtagagactggggtgcttagggaggttcagctacatgggtagctattaggctgggtggtgggtacgccaggttcagtacatattttttgtaataactttattgcgatgtaattcccatatacaattggtcgatttaaagtgtacaatttgatgggctttcttacattcacagagttgtgaaaccatcaccacaatcagttctaggacattttatcgtcccaaaaaagaaaccccattccttttggcagccatcctccattttcgcccgccctccgacccccagccccaggcaagcgttaatctactctccatctttatggatttagcataatgttttcaaggtttatccatgttgtagcatgtatcagtacttcattcctttttattgccaaataatacattatattgcttttaagcctctctgaatgtctgaaatatttcaagataaaacatatttaaatcataaagttaatgaacggatgttgttgaattagaggatgttgaaggaatccttcatgtctgcctctaaacctaattggcggtctttaccagcaaggatgtatcattgcttgctgcctaaatcccgtgtgtgtgcaccctcagccacctgtgggctggcagcaatggttctaaccctgccaggacccagacccagggggtcaagccctgctcagctggactctgacacctgaccccctctgtggtgctctgaagcgcccttgctcttcctctgcctgtgctcagtgtcacttcctctgagatgtctccgttgaatctcccagacacagctgggggccctttttctcagttcctagagctagaaaactaactcaccatggggtggctatttggtcccctggtgagagagcagcagccacgcttacagccctgcaagcttctcaagcttctgagcatcagtcctcaccctaggaaaatgaagatgttggtgcttgcctgatagactcgaggtgatagggagataagttatgtatgaaatttttcaggggtggtgaaggatttgcttttatgcctctgactcactcactggacatgaagattgtcctgggcacgagctgtgctgtctgcaggaaggagcaatggactggcttcaggacttgcaatacccactgccctgggagaggcaggctaacccagcagttacaggtgtgggctctgacttcccagtaaatcccagtagtcccagttctactccttgttagtcatggtactgtggatgggttactctcttgacctcacataaaatgggaatgacagcacctaccttgttggactgatgggctcaatgtggggcccgacacacacttggcgggaaatgattgttagttgccacgatgatggtgatgacgacatgagtggaaaagggcttcaggtgacatggggctgtgaggagaggtcatagtctttgcccagttgcattcagccatgtgaggtcccgaaggcaatggcacgcttgccactgaatgcaaggaggtaatgtggtatggctgctcaaagcgttggcctactcctacttccctgatctgccctgtggaaggctaggcccttccaatgctatgaaaaatgctggatgttctatttatgagacactgtgctaaggcactgcaagagatgggtgaaaggtatacccacccttaaagatgtgatgtgggatttgtcacaggtttaggggccttagttggaatcccagctctctgtctagctctccagcacagcaaaagccacctaccctctctgaattttcacttgctcatctcttacatgtaaataaggatcttacagggttattatgaaagttcttggtcaaccatggagatacaaatggagaatatttggcggacctcgtggcacaatggtagtgcgtctgactccagatggaggatattatgggaggggagttggactggtgcacaatccagttattttgtagaaggtagaccttgttgagtgctgtgggatataaataaagggctgtggacagggcaggggaagggtgaattacaagtgcaggtgaccattgattccttggaggagacactggaacttgctggtgatacttagtgttggagggccttggaacccccggtttatgaagaaagactcgccctccttcgccccactccatccagccaccatgcggagcaggagcttctggagagcaggacttgccttaaaggctgtgtttgtgccccttctccagacagagtcgggcatcctctctccacatcctgagagggaatgggctacatttgtagcagctgtagttgggttggaagtgattctggattttgcaggaaatccattgtccaaggaactctccagggacagtcagtaggagaacgaggggcaactgcaagtgcctcgaaggtagaccgcagcacgcactgcctggtcacctctccctgtctgccaggctgcctgtctcagagagaccagtggaagagtcctgaggaagaaagacaccatcctgttccagctcccaggggcgtcattcactcccacaatgattccatgtgtttgtatcacaccctcacccatcagaagcctttcccttagcacctgccctgtgagggtggaaactgcagccagaggagttaagtgaagaaggactgcccttctgggcagttacaataactggaagttacagtaactagattgagcacccccacctctccactcctcacctcagcccaggccaggaatcagcagccagacttctggactgcctacgtgctctttagggctccaggatgaacatgaactacatcaacaagcagcctgggtccacctgcgggtagagggctgctccaggccctgtgttcagtgccgtgggatgcaaggtgatcaggcaaagttccttggttcagggctgggcaagtgctaaacagaagcataggcatctagtttgggaaatgcaagaaaaggagtgactactcctgaagggaggaatcagaaatggctgcatggaagaagtggcatttgaaggaatccctgaatggcaagtaagatttcagtaaatgagaatgtgcatgaggacattttaaaacaatgaaacaacataataaagaatagagacctgaacaactgtgttttttccacacacacccccacaccccacaccccactctgggaaatgaggaatgatctggagcggttgtagtaagctcctgcggagggatggagtaggaggtacggctggaaagaaaagttgggggttggggaggcagaccgtggagggagttggacaccaccctgaaagccagcttctatttggtgggtagcaggaaaccacggaaggtttctcagagggatgtgatgtatccagctgtgtatagctcagtgtagagggtgaattaggggcaggagagaagctgggaatgggcagcaatgatctctctaaggcagcagtccccagtctttttgggaccagtggccagtttttccatgtatggggatggggggatgacttcaggatgaaattgttccacctcagatcagcagacattagttcaattctcacaaggaacctgcaacctagatccctcgcatgcgcagtctgcaatagggtttggggtcctgtgagaatctattgccaccgctgacctcctgctgtgaggcctggttcttaacaggtcacagtccagtccagatctatggcccagtgcttggggacccccgctctaagagaagacacagagaagcagaggaagcaggtgaggggagtaacgagagggaggttgcagaggtaacattagcaagttctagctacctactaggtgtgggccaaggaggggttgaggcaattatgagcctctgagcccaggtaactaataataaccatggcatatattcaacagatgaccttgggccttgtgctttaaatacaatatcacttacattctgatcaagcaccctatgatgtaaggctatggctatccacatttcaaaaatgaagaaactgaggctcagagatgttcagggtttgcctgaggtccacggataagggacagaggcaggacttgaacccaggactttcaatgccagcgcctttgccctccggacaaggcagagcagaaggggggtaggttggagaggaagggtcaaagttctgtttgggacaagctggaggttgggaggtgggggatgcaggatgcctcatggaaatgctgagggccctggaacagttcgtccagagggagaggggctagaagcccattctgagcttgtggacttagagaagaaagaccttacctgtagccatcgtctggggacaatgctcagggaagtggccttacctgtagccacctgccagcaacactactcacagaagagagagaacaggagtgcatcttgctggagagctggctagaagcactgaggtgggagactttctgccccaggacatgcccagagcccagggccctgtgccccttcacccaggactcacaatcctgcccgcagcacacatgggtgctgtgcagcttgtcccaggctgctgggggcagatgagctccctgccctagacccagtggagggtcccttgatcttgccaccacctgctctgccctgaaggagaaggttctgccacagtgacgctaaaggaatgccagatgctcctttggaggaaaggagcagcaagtgggaagagcccgcgacctctgcttgggcagttataagagactagaaggtgggacatgccagacccatggatgcagtccctggctcttcctcctggacccacccaggctgcccactccctcgatgactacccccactcttgtcataacccagccagcctctcccctgttactccctggcaagttcctgttcagccactaaggcgacttgggtggcctctgctggcagtggcactcttgtccccacacacctggccctcttcactgcaccctcccaccagctctccaggttacgactcacactgccctattctcctgatgaggaccctgaagctcagaattctttgctcgaggatacagggttaggcagtggcagggttgggactggaaataagctctgaaacatcagaaggcaaatgccccccagggacccaagtgctaccctggagcacagtgggaaaccgaggactcggcagtggccgtgatgcttgtccagggagcatggagtcagataaggctggaggacattaattagtaatgataacaacaacatctattaagggcttactctgcgcctggcactgtgataagcactttattgcattgtctcatttgatcctcataattactttatgtggcaggtactattattatctccatttccatagaagactggggcccaaagaagttctgtaacggggccaaggccacagagctagtgtgtgttgaagccagaatttaagtagtctgagtctgggcaaaccagagcagcatcagaagctccccctgccaacctctagctatctctctctctcactccctcactccccaccaaacagtttttgagcactggttctgtgccatgccccatcctcaggagacagagaagagcccacagtccaggaaggggaaacacacgggtaactcagtggctgctgcagagacccagggctccggtggggctaggcggtgcccagtgtgggctacagtcccagggccgcatcctccaggattccagccctgggaggccggccccaatcaaggcggggccaaggcagggacacaggtctagaaccacactgttggtggcttgtgcagctggcatttggccctgagacatcagatctgggactcagaagggaccccagagctcagctgactcggcttcctggtgagaggccctcctaccatgcaaaggggagctggctatgcacatataagcaggggagggaggggagggtcagagctccagctgctcattctctttccagctcacttcacaaactcacttcctcccacccctccagcctttgccatctgtctgtgtggcaggtacaccaggcagggcactgttggaatgtctccagtaggcaaggtgtgtggctgacaagagctggagatgggcaaacctggggcacacagagctacatccttggcaggctggctcctcagcctcatggagaccctggggagcctcctggagctagaatgaggaccaagtatgggcagaggctccctcagtgcctgccttcctctttaaaccccaactggggaggaaatgcctgccacagaaagatgcccagcaggcggtgggggtataagtggatgccagcttcccatgtagttatgtgagctgtcacggggtgacctggcataccatgacaggccggagggagggtggggcgggtcccaacctcccaggggcagcaggtactgggcagctgtgccgtgtgttcccgagacctgcctgtttgtggtcatggaggggtctccatgccagggctccggctccagggtgcccagggcccaagagctttgacagcctgaatgtcctcttcattttcctataggcttagaacctggatgtgagtccttctcaacaaagaacttactttccctcggggtgttcgggaatctggacaatgaggccccatcagcatcccatgggggaccttaccaatgatcctggctggtgtcggttctgattggtgggtctctgtacggttctagttccaaatgcttgaccacatcagctccagctgtatcattctttgctcattggcactcagaggcactggtgtgtcagccaatgccacagactcctgacgccttctgaggccaagagctacagccaagctgggcacctggttccggattcatctgtccattagacagcctgtccttcctgacaggtgacacccctgctgttcattaaaagacagcaaaagatgctgccacagaaactgattggaccctgaagccaccacccaccacacaactatttctagggatgaagtcagatccagcctcttctgcgcttaccctggtacattttcccactgcctcttctcctcacttctgtggagggtggcagaatccctggggagctggaagtgggccttgaccctcctgcttcatcatcctccatgttgtcccccttgtggagtggccccttaaggcagtgggatcatgttcccgtggaacggcgatcctgccaaataaataaataaacgcagagaagaagacagatttcattatccaaaggaagctgaagctggggccaatttctgatgttcattttagtggcactgtagtggggctggatgttcctcagagcatttgcccaccttaaaagccccctgtgatgtgacgagccactttctcaatcttgggaagctccaagatctcccagcccttctccagtgctgtggccatcctggtcttgtcacccagtgaacacaggaggccagggccctgtgggttggtcacccctggacattccacccacagtgccttgggcagggcaaggtctgcgcctgctccaaggcatccaggcagccccctcctcaaggggccacaggagacagcagcagccacagccttgtgccttcccggtcccacttgtgtcaaagctatacaggcctagacaggatctggtaggagcctgggctttagagacagagcctaaggccgagagaaggcaaggggttcttctagggtcacccagccaatgctggaaacacctagactaacaaagtggcaggattatctgctggctgagttctgggatccaactgtgttacaatgggcaagtgacttgacatctctgagctgcagctttcttacctctaagatagggatcatgacaacctctacctccatgctgtcctgagatgaaggagatgtatgtaaagcacgtggtacagtacctggcatggggaggagtttaatcagtggtattgagctgctggtactcagctctcctgaaccgcaggccaggactctcttgaccacccacattgcccttcctcctgagcctctgaaacaccactaccttggggaccggcccttgccagaggaatttattcagacaggggctcctctaagctgctttttgactgcagcaaatgctgctacctccactaagcccctgctgtatacagagcgccaggcatgcaggtatatacaggcctttgtacaaagggttcagatccaccttgggaaatggggtgaggcgtggcttctgtgcacactgtgtggccctgagtctctgggcctcagctcccattttgtaaaatgagcctgagacagcctcactgagtagcttggcgaagccagtgagttcctgcgtgtgaagccccattgaaagtgcgaagtggattgctatttgctacacacgtgccagttgttatttttgcatttacacaataatggacaagacctgaccctgtctctagaaacccatcccctgattgggcctctgaacagtgtccacaggaaatatttcaccagttatatcctgcaatctggatgtgtcagctatggtatttggagaatgcgatggtcttggaagcctccaggggagaggtgacccattcattcattcattcgttcgttcgttcgttcaacaaatacttgtgaagcgcttgccatgtgcagtggcaccgagctctagtgatatgaggaccaacctgacagaggtcttgacctcttcctgcttccagtgtaatgagagaaatcaacaaaataagcacataaggaaattaacaagaaaatatccactgattgttatgaagaaaataaattaagacaattttaaaggattccccccacggcccactttactgaggtataattgacaattaaaaactgtatatatttaaggctgaccatgtgatccaggggatattttcgatagggcattgtggggggcagtgttatctgtgagaaggtgacatctgaatgacaaggggagcccaccacgcagagctaacagatgatcctgagcatgagaagtgctgtgcctgaacttgtcacagcataaagcactagaagagtgtccatgagataaattgattaaagaattaaatcagaggttggggaatgagcatgctggttagcagcaaaagccggtgcaaaatccctgaggtcggaatgagcttggtgtgtctgaagaagagaaaggtcagagtgtggccaggtgaaatgagtgacagggagagagcagagagagagctcagggagggcgcgggccagtcctgtggcgcctcgtgtgactctggcctgtggtatttgtacatttcaccctcaatgagccaggaagccacaggaaggttttaggagggggagccaccggctctgggctacattttccagtcctcttggcaccggcagagaatggattacaaaggcagagtggagaggagccaataggtgtcctggacaattgcggtgtccaggtgagaggcagtggtgacagaggaaatggggagagtgtgcagattttgggtatgtgctagaggtgacgctagcaggccttgctgatgggctggctgtcgggtgagagatggagagaaaccaggcagagctgaaggcttcttgacttgagctgttgactgggctgggctgtgaagctgctggagctgcagaatgcttagcccaggtgctgggggtcaggggcaggtttcctggagagatggggacagggctggagggacagacagcggcatcgaaggagcccggtgactcggtgactcggggtcctttaagttgcgtgtcccccagcgtggagtccacttgctagagtgagcagtttgttgaattgctggttccccttccacttcaccagcttaggagcaagaggggctggatggaggaggcagagcctgtggcctgtctgcctggctgaggggggccctctggagtcagatgtcctgagttcccctccccacctcagcagcttcacagtgcatttccttgctcactaaatcctgaaatactgggatgatggggccccctttgaaacttgagtgaggtaagtttaggacaaattaaaggaagtcctgcttctcacagcaacttaggacctcaggggactcattaccctgagaggtggtccaggctgggaatgtcatgggattcctgagggatctgggtaaaagaacaaaatgaggggccctcaaaggcccctgagaggaaacctgggatctgtgtgacctttaagttgacgtcagggaggaaaactggtctcttgaggcttctgctggcaacagagtcgggaaccatcctaatccaacccagcgttcccctgccccctggctctcagaaccccgggcgccagagctggaaggggccccaggctctgccccatctagtccttttctgtcactcaggaggacactcctctgtcacccctccgcctgaaaccctgcagtggcgccagtgccttcacgaccatgtccagcacaccccatcgggccccatccctccccactgcccccctgccccacttccctggactccctgcagcacagccagcctggggcttaggagcagggctctcatcaccaggcctctgcccctgctcttccctctgccaggaaccccctcatctccacctttgcctgttaactctcccttacccttccgatttggccttagttgtaaactcctagatagccatccctgattcccacccctgcccccacctccccaatttcaggtcacctgccactgccgaaagcttccttagagccagcccagcctccaagcataaacctatcccactgcatcatcagggactagtttcacatctgtctcccctctggacagttagctctgtgtcttcccagcacctggcacggaataaatgctcttcaataatcatttaaggtgtcaggctcagagaatggaattgccatgcacaaaatcacagcatcattcatgtatcattcaacacatattactgagcactcactccatgccatgcctttgctaggtgctggtaacccgagggtgagcaagacatgacttacggttcagtcagggaggcagcctccaccaattgccccagcaaatataaaattgcaatagcgatcagctccaccaaaaggcaatgcaaggtttcatgagaaactagaaaaaaaatcctcaagcgtccttgagcagagagatctggcaagggagtaggaattgaccaggtaaagggcagggaaagtgttccaggcaagggaacagcaagggcagagaccctgcagtgggaagggaggatgaggaactgaggcaggagcagtgtggcctgggcagggagcttcgggacagagactggtatgagatgagattcagctggaatatgcagggctttatggaccacgttaaggctttcatctttatcctaagagcagtggggagccaccaaaaagtattgagcaggaccatgacctaaccagactggtattatgaaagctcagactagctgatatggtttcactgtgtccccactcaaatctcatcttgaattgtagctcccataattcccacgtgttgtgagagggacctggtgggagatgattgactcatgggggtggtttcccccatactgctctcgtggtaatgaataagtctcgtgagatctgaagctttcataaggggaaacccctttcacttgattctcatttctctctcgcctgccgccacattaagacgtgcctttcaccttctgccagggttgtggggcctccccaaccatttagaaccttgttaaacctctttttctttataaattattcagtctcaggtatgcctttatcagaagcggtaaaaacggactattacactggcttctgtacagagcaggaaaaataaccaagtgccctgacactaagcccttataggatgtccatgctctgtagcctctgtagccctgctccctaccccaggtcactacatgtccaaggacctcccctactccaaagcattggtctgtccatgctcattccggcactaacatcatccccacccaaacgcaggggctgggcttcagtgctagctttcctgggcatttggtacaactgtgctccatgaggctgtagtgtacactacactcttgtctccagtagccaggacaggctgtgcatgcccagatgctggcctcagtgtgctgtcaggggccagagtcagcaccagcacccaacagatgaggactgtttcacccagagtttgctcctttgaggagcagagagcccagctccctgccaggcctgctgggttccgctgtgtgagggtttcagacggggtcccggcagtgacccagcagcagcatttatgccagagcagcagcctttacatgcctccggtctacactcgtggaagttggtgtcaggacgcagtaaggttaatcctccaggttgcctgggctgcagaaacactgagagtaaactgtttatgttctccggctgctgagcctaaaggccttctgcaaagaaatcatggctcctaggctgtcagtgctggagggtgggggttatctcttccagcacccacgtcacagcaggagagggggcccagagaggtgagattctcaccatgtcgtgttgctcaagtggtcagaagattcagcctccacgtggaggccatcggcccacatgatagctggtgtgatgatgttaaactcttccccctcaacccacggcctaggagcgagaagaggaggaggagttaaagggtgagagtgcagaatctgggtttcagatcctggcaaccatgggttcaaatcctgcctttgtcacttgtcagctgtggcctcttgggcaaatttttcaacctctagggtcttttttcatctacactgcggtgtccattatgactgccactaaccacacatgactgtatatttaaattaattcgaattaaataaaatttaaaatgcaattcatcagtttccccagccatatttcaagtgttcctgtggctagtggctactgtattggacagcacacgcacagaacatttccattattgcaaaatgttttctatccaacagctttgatctataaaatgaggataatgagaaggcttgttctatggatcgtggtgaggattaaatgagataatgtatataaagcaagctggtatagcacccaacatatattaggtgctcagctaatgtttgccatgacggtgatggtggtcatggggttggtgaagtccatttgcttctgtgtacattttcagtgtcctgctgtgtccacgaccagaggtgctacagcccaataaaaaggtgctagagttaggcagttgtgcacctggatttatttatcaatacgaaggtgttgaacatctgctgtgggccaggcgctgttatcatatgctgtgggcaggtgccgtggtaggtttgtgatatgtcacaaagtcaaacaagacatagtctttatcgtccaggagagatgcccaccagtaaagcatagaaaatacccaagagagtcagaagaaaaagaaaaggaatagcaagccctgagggcttcccggaagaggcggcatttgctctaggtcttgaaggaggtgtaggatttgagtcggagagggcaggaggacattccaaacaaagggaacagcatgggctgtcaggaggggcctgaaaagttatctgtgcttgaatgatggccagctcagtgtggctgtccagggaggatgggccataggcacagtgctcagcaaatgccagacactccctaagtatttgtgggatcagcaagtggaatgaagctcataactgtgattctgggcaagttatctgacctgcctatgcctcctgcctgctcacacttcaccagcttctcaccccagcccccagtaagcctgtggagatacagagagatgagacgagaacatgcttccatcgcaaacataaggtggtctaactttgtgcctcagtttcccacctgtaaaatagggtaataatattagccacttccttgggccattgtaaggattaaaagagttaatacagtggcatgtttagaacagtagcaagcacaaagtgaccctagagaagggttaactagcaatgttggcatagcgacaagagatatccttgcttttgtcatggagaagggaagtgttggctgaagtgtttgagtaggacttaaaagttcctaaaatcatgttggcccgtcatacctcacctgccttaaaggatttttgagaccgtaaagtacatatgccaggtgaatgcaaactggagagggtggtgccccagactgtcaattatagcagcaatggggaagcagatgggattgagctttgctcctgagctgatttactgtctgcagtggttttgctctggagagcctgggctctgttttgggaaatccaggaggtgacttttcctaaggatcttgagagatgagtaggagcttgctggaaaggccagcaagagaaccatactatgttaaggtcctgtacttaactagttataggattctctatcctatagagacaaacaaaacccatccagacctgccttgcttgacatctgacaccctcaagatgcctccaagacttcactgtgctttcttgctgagcctcatcctcttttcttttctctttttcttttcttttctttttctttttttttttttctgagacagagtcttactctgtcacccaggctggagtgcagtggcgtgatctccactcactgcaacctccgcctcccaggttcaagtgattctcctgcctcagcctcccaagtaactgggattacaggcacccaccaccacgcctggctaatttttgtatttttagtagagacagggattcaccatgttggccaggctggtcttgaactcttgacctcaggtgatccacccacctcagcctgccaaagtgctgggattacaggtgtgagccaccgcaccagccctcttcctcttttcttacaccctctaaatacccccacccctgcagctacaccaaagtaggcatccccaacccactagcctgtgtcactccttcccctccctcagcctgcagcccctccccaatgggaaccagcttcaggtgcctccctgggaaacatttcttgcctcccacaaggtccctgcatccctcttagcagtaaccctgctccctgatttggaaaaagacatttcaccctttttccaaatcaattctgacctcacctgcagcagaatcacctagtcagctaaaaatgcagatgcccaggtcagacctacaacatcagaatctccaatcctgtggtctggaaatctgcatttagcaatccaggtaatccttttgctcaatgagttcagaaagtcactgaactgctaaatttcactgtagcgtatctttttgtttgcatctttttccctccactggacaagggtttcctggaggcagggacagggatagtgccttgctgtctgtttccccaaggcctggcgcaaggccagtgcccaggcagtcctgaatgaaccattcctggacatgacacggttcccgtgccctccctccttccagcccatgccggaaataaacttttatgaaggcttttgtgagtagtctgtgatctctctgggaggccatgcatgtctctcttaaccaagagaggaacctagaagaagagcagcccagccctcggtaacaaggggctgggggtggtcccaagacagggtcctggatgaagaagggtctggtggcactggaggggctgggggagagtgtcctggttcctaatcaacaggaagggcctctgcctccaggatcacttttcagcccagctgcttggacataacccgagctggggttggggttggggggaggggcggtgacagacaggctgacggggaggccagcactgcgacagacggccagcccagcacacctgcccgcccaactcttgtacacccccactgccccgggaaggtgcatccagggagaaggctcagctggtgagctcagaacacccttctgctttcttcccccaccctgccctccccttcttctgctctttccaagcttagggacattcaatccttcctttgatggacagccaagaaaagacttcttccacatcctaaatttgttagcaccagctaatcgtcttaaccttcctccctccagtgctcccaataggcgcctccttaaacacacagggtgcttttttgatcctcagaggggagcaccgggagggaccaaatccccacaggggcagaggaagtttccctggaggtccctcctctgccgtggctgctggtgagccggggtgtgcagacacgtggggcaggagcagtgactgcagctgcagccaagcctgaggcttggcagcttagaacccgctgattcaagtgggggtgcttcccagcgggagccacggccctcattaggggctcaccccagggtgctgctagaaaactgaagttagccaaatcccaggtcgtgcccagcagagggacactctttcttgaccctcgcctgcttcttcatcttctctattgtgtctctctttagcctcttccttctcttcctcctcatcatagcttccatctactttacagggtgccggaccgcatgcttagggcctgaccccagctccttcagaaccctaacagctagaaattcttatgctcattttactgatgagaaaattgaggctcagagaagtgaaatgatgtgtctgtgtatataaggtaatcccatatgagtcagggctggggtgtggaccactgtccaaactgttgctgttgaccgccataccattctgtctccaaaacacacatttctgaactgctcacacaggtacacaaattagataaaagtgacctactgcaatctattaaatgaggtcaccctgtaaacatctcttgcaggaccaggcacatagtaggccctcagcacgagtaccccttccttcctcccatcccctcatctctctccctactctgtctctctcctcctgctctttctccttgcctccaggcttatgacacaggtgagaagagccaggacagaagagaatgtggctatggcctacagaccttgtcctggccctaagcctcccaataaataacagggtctgtatataagcctccggctctgcagcatctcagcttgggaggaatggcgtttgctggcggagggattaggagccctgggaggaagggacaagggcctccctccaaagcagcaggggaaggctctgattcactctctttctcctttccatctgtggccccacagaaacagcaaagaaacctaaagaaaacctaacaactttgccgtcaaggtcctcagtggatgtggggctggtctgggagggaggagttccccttcctgcaaagggctggaccctgacccgaaggcataagagacccttctgagacctagcatgcttggaacacaggcaggaaactgcccttcttgccccctggcccacctccttcctcttcccagcttgtctaggtccctagaatgggggttgtctggccagatggagtctccagtcatttgctcaagacctctgagtcacggaggtgaagaagccactgggaccagctgagactgaggggctctgggggaggggtcaggacaattgcagaggctgccaggaagatggatcagatggccgcatctgatccaagtgtcacaaagcagtccaactgaggttgctggcgaagtgtgagcaagctaccggcctgagctgaattaaaatcatcctatacctcctggatggcttagtaataagaagcaaagctgccacttcccaaggacttattaagtgcaagacccttacatatgtgtatatgtctccaacaaccttgcaaactggtactattagttccactttataaagagactgaggctcagagaaattaaaagaaacttgcctggggctctggagctattaagagttgctgggatctgaacctaggtctgtttggctccaaagctcatccccgaggatacccctgagaaaaccttcgatacagaagatcactcaccgtgtaagaaaaacactactgagtgagagcaagaacagccaacaggtgtggacccacgcaccgtcctctcacctgtcgcctgactcacctgccttccccacgccacacttctgctgtgtctttctggaggcaaagggacaaggatgcttcttggatcagaaagagatgccctccccttatgaaaacaatggaagcattccccacagaagagccagctggtgccaagggggtcacttaaggacaagtgagggcctaagagtcccctccacaactcaccttctctttgtggctcaggtgctacctagcatggacatttgcatagccaacggctgcagcctacagcctgcctttgcttctgtggtgctgtccccatgggatttcctgccgctgcctctgtactcagacacccagggtgccttgacacccccctgcaccacctgacccatgtgggcaattcatctccacctcccctctggctcagacaggctggaattctcttaacgattttaccaaacccaaagagaagtgtttaaaccatttttttaaatgtcttagaattttcaaaggttctgatatcacagtgcttacagagaacgggtttctgaccctaaactggtagaaggtcacttccagatctcaaatccattattctgtcccatcagagacagaagtggctgccctccccttcaatccctttcctgcttcctccaggaggggcctgggggctgtcatagaggcccagctgcctagcctggtgcaggggatggggagcgggggtggggggcgcttccgcagcagtgccccctgatcacttcccactgccctatcatggaggcccatggtccgcagtcaccaaccggctcagcagcccctctgctctgtctctggggagagtggtggtatgatgcccacacaatggcacgtttttatttttatttatttttaagaacaagagaggatattgtttccttctttttcacatctcctttttatcttagccctggcctcaattctgtgggactccctgaccctcctagcatgtgggaacaactgtgtgtagccttctgttgtgtttgggggctgaagacaaggatggcggctcccactgtcttcccagcctgcctcgacctgtgcccagcgcagacctctgctgtgattcccttagtgactcctttacaggtgttttttctcatctgcagaagtcaaaatgtccccagccactttccaggcctccccacccggtgtggcctgcccaggtgattccagcttccttgaaccaagcaccttatgggatggggctgaaactgggccccacggccagctcccgagtaaggtcagaggtcaggagagtaggacgagttggtcatcctgggctcctcttaatgatttattagccactgttcccattaggagctgttagcacatcaaagcgggatttgcagagcctgaacacatagtgacggtgacagacattagctggtggctgccctggagccataaaactcccactgggtgagctggaggtggagggaggcgctgatcactttggttctcaactacagcaaaggcagacgagatccaaatgtccatggatgagatctaaatgtccacatttgtaaaatgaatttgtgcattaactcattaaatcactgagtttggaactctaggtaagtttagactgtgcgacacagtacgatacagggcaaaaggcagattctggactccacaagatctgggttcaaatcccagctctggcatcaagaagcttcaggaagttgggttctttcaaagcctcggccctgtctctagtgggatgaggataacaatcctcttaagagacatcaggagaggacctggagccacacgttaaactgcctggcatggggtgacactcgagaaagagggtttcttaccccatggcacatgtctaatgcaggggccttccagcggcctcctgcgtctggaggaagccacctactgagaggtctctgccagcctgctcagggtactgcttttcttagtgctgtcttttaccaatgggcaaagggcgggctgttgtccttgtgatgctgaggggggctgaggcagatcaggttccctgggaagctgactgtcagccagcagactctacatacacaccattgaaaggggaggggaagagagagaagggaaaggcaacagaccgggcaaaggaagatgatgagctgtgccaactctcagtgatggcctcagcccacccaggtagttctggaacggggatggcccctcagagttgccccaagggggccaggccatgaagggggttcttggacaaggtggctctctttagccaaggcactcctgcagaggactgacatctgagagctatctgcaggcagcaccctagcatctgaagggacaagtccttcattccctaaaggggaatctggatggcacagcacagcaggcactacaggggcctttctacaggggccagcacatgggccaggggtcctgagagcagggctccatctccgccttcactaaggggaaccatgcacccctcaggagaatcgaggtcctgggagattctgtggcattcctgcgtatgcttcacaactgtagattcgagaaaacagggtgttgggctcaatgaatacatctgttcagctttggctctgatttctgaagatttctcaggttcagagaagtgagagaatcagggaaatcaggaagggagctccccttccaccctgagccaaaacaattttgccaaagtctggacaccccaaaggtttcccagtgccctgggggaaaatgccaaactcctccctgccctggccttcaagatcccttgagttctggcccctgccttcctttcctgcttcatttcatgtccatttattttcttctcctgaaactccagggcagagctgcttaatagaacttcctgccaggatgaaatattttctccctgcgctgtctaatacagtagccacagctacatgtggctattcaacacttaaaatgtggctagtgaggctgaggaactgaactgaattttttattttatttccattttattgtggttttttgttttgtttgttttgttttgtttttttgagatggagtctcactctgttgtccaggctggagtgcagcagtgcgatctcagctcacggcaacctccacctccctgattcaagtgattctcctgtctcagcctcccaagtaggtgagattgcaggcttgcaccaccatccccagctagtttttgtatttttagtagaggtggggttttgccacgttggccaggctggtctagaacttctgacctcaggtgatccacccgcctcagcctcccaaagtgctgggattacaggtgtgagccaccgctcctggcctatttcaattttagtttaatggccacaggtggctgacagctgctgtaatagacatcacagctccaaccacagaggatttttttctgtttcccaccccagggcctttgcacttgctgtgctggtgtgcagtgaccatcccttggactctctcgtgccgcctcttcattatctaggtttcgactccaacaccacctcctcagaaaggccttcctcagtcatccaagctaaagcattttcccaaattccagccccgtctactatatttgcatattgtaacttctcatagcagtcatcagtgtgtaaatttttcccatttatttatttctgtttgttgtctatcacctgcggctagagataataataataataagccaatacttgtatggtgcttattatgtgtcaggtactgatttatcatttcacatatgttatctcatctaattccttcaactctcctgtgagaaaagtgctgctttgtccccattttgcagagaaggacactaaagctcagaggtggacttgcccaagctcgactgctagaagatgtcttttctacctctatagtgccagcaccaacatagagcagtgccagatatatcgagcaatggctcagtacgtggcccttgactgcctgtctggctgagactcagcagggtggggtgactgggctggtgtggacccaggaagtcctctgacgagccttgcagccccacggaacccctggttgggatggtgggctgggggcaagtacaagggtggcgccaagagtggcctgcaggtcacttgtcccattttgggagaccccagtgggctgggaggggagaggaatggacctcgctgggcaaaactggcaaacccttctcctgggcagtgaatgatgctagtggccaaggtggactcggcccattgctgggcctggggctgcggctttcccagtgccttgacagaaagggaccagagctatggagaccacccagactttttgtctgcagagagctctgacatccgcctggcctccccagcaaagcccttgcctggggctgtccagctggggcgggggagcggggggaggtatggggagggggctctgtgcagcccagcagtggggagatatcttcctagcgatcagcatctgataacacagcctggtctccccagggtgcccctgccccctctaaaaagcatcttctcttaattaaaaagtcagagccttctgtctggaagggacattccatgaggaggggaagccaccagagacgcctcaccctcttcttggtcctgctgtttccatttcctatggatactgcacccaccccccgtcccatcccccacctggcaccccaggcttctaggtgtgagagagcttcgcacaaggagcctgaaacacaactgccatttccaatgaggcctcttatctgctgagtgacctcgactcagcttcttaaccttccagcctccgattcctcattcctgtgagggaacacatgtgcccctctacgattgccataggatctagggaagcacgatgctctcaaaactttcaagactttatacatatgaggtcaacgcaagtataaagaaccataacgatgttcacacaaaggtttcacacaggctccctcccttaggctcagaaaacaatgtataaaaggaaaactgctagatgtacaaagatattcactgcagcatagaatataaaaaacacagaaacttcgtgatctagtaaccaactcaaagataaatcacgttatatgatctttaaacgcagccatgttaaagatgtcgtttccaaggctgccctgatgcaggaatgtgtctgccttgtcatggtaagtgaaggaagcagtggaccatattccgtgcacaccgatttctgctctgtgaacgtaggtatgcgtgtggacgaggatcagagaggggaagagaaaatggaaacagttgagagtgggcatgggggattatggatgatggcttttctttcacaaaatgtcctttaatgttcttacagagctgtttgaacaataaatatatgtcagaaaaacaaactaaaaaaaattttaaagcaaagccaaatgtaaaatccaaagtgttgccactcttctcagttcagatgcatccagttcctggactcctcggcctcccgagaaccccacatccctggcacgtacactggaggccatacagctcactgtgcagcccgggcctcaatcttcagcctacatggtatggtgtgtgagatgtcagaacttggcttcatcctttccttttccctttgccccttctcgtgccacatgcttaaggccctttctattcaaaagacagtggtttcagccgggtgctgtggctcacacttgtaatcccagcactctgggagatcaaggctggtagatcgctggagttcaggagttcaagaccagcctaggcaacacggcgaaaccccatctctacaaaaaattttaaaacaataaattagccaggcatggtggtgtgcgccagcagtcccagctactcgggaggctgaggtggtagggtcgcttgagcctgggaggttgtggctgcagggaaccaagatcacacgactgccctccagtcttttgagaccctgtctcaaaaaaaaaaagtggttcctgtcatttctgcttgtcaccagactctggttagaggttctacatcctcagttatgaaaattctttcacttgcagttgtactgagacctgccaaggatgccaagtacgtttcctcacagggacgagctgtgattgattggttgtggttgccaagaagtacaagaaacagtgctgaaatagatcagttatgtctgccatgggtcctagatagaggaatggtatatgtcctgtggtatttgcaattccagaatagacaggtactcagcgcagggcttggacatctgggctttcatctcaaccctgccagtgcttccctggagaaccttgggtactgtacagctttgtcatgtgtgtaaggaaatcggaggctccccgttctccaggctgtgtgctggtgtggaaagaggatggactttgcagtctcatagacccaggcaagaatcctagctccaccgtttacttgtgatttgaccttgggcaatccgtgtaacctatggagcctgggtgtttacacctgtaagttagaactcagataggctgagttataaagattagaaatagtaaatagacacagtgcccagtctactgctggcacacagtaagtgttagggtagctgttttcctggccacctgtgacattcagaggggttggtggtgccgttcagccagatggcatggaagcaggccatggggctgccaggctgccacccatgagactgtgtgtttctttatttcttcctggcccacagttacacatgcacgccttcaccatgccctcctggactaatgacagagctgcttgagacaggattcattgagagacagggacaaaaatgatgtttcacttgattgtgctattgtaagttaaaacactccatattataacgaactaataacatattataataacactccatattataatgaactaataactaataattagtaattagctaattactaattgctgtatatgttgttaattgtgtgcaatttaaagtaagatttaagaaaaatagatatccaggggtgattaagtaccttactaattgttaattattccctgtccctgcttcacggagtcctgctttacttccgggcctgaggaaagcagcctcctaactcacctggcatcctggggccggggacttatgtggggcttgtcttcagctctgggctccatgcccagtagaaggggggagggatgcaagagggagggatgcaagcacacttgtcattgtttagtgtacccaaacagttccactcttggtcaaactaactctcacgtacaagttcaatgtccaaacactgttatgacattgctccttcacagatctgtagtcagatgatagccagtgggcccacccatccattcatttaattactcattcatgcatattcagcaaggattgactgagcccacactctgggccagaagttctgggctgtggaattggagcagttcaggcctggaaggtgcccagagactgtgtattgcgaattagcagcttgaggaccaaatgtagctctttcacaggttttgtttggcctgcagagtggtttttaagtgttcttaaattagtagcagcatttagaaatgagaagattttgcagaaaatatctgattctcagcttttcttgaatagtttcaagatctgccaatagtaggtctgcaacctcaactggcaatacttggttgcagctgaggggtatccagtccattttaggcacacaggcaagcccttagcactttgccacagtctccaccatgccctatcacatgacacctggcctacttcatttatttatgtgacctgcctggctccttgtaggcattggagtttgtgacacctaatctccctcaactcttcttagagtagtgattaaagaattaaggactgtgcccatcataaatcttacaacctaacaaaagacaaggtagaaaaacatggacatggaacatggaactgagatccacacatagaaatgagaataattcactgaatattttgatgtcgtggggttgtggtaaatcaaagccagctgcgtgaaggagaggatgtgaagccgtgatgtgcgtactgcaacctctgctggagaactgtcgatgccttttggatgtggagaagggagcaaggcttgcacaacagatgatttcctgggaagggcccaaggtgaggggctgggggtggagcaggaagtccctccccttgagaagatatctctaggtcctgtgggaggatctcactgtttctgggagactcagtcaagggtgacaagttcaagtgtggagactccagattgttatcaaaatagagctgaggggtcagagccagcaaagtgcaacgggcaaggctcatccctgattgatttccacctcgcccacacaagggctgacttgatagagaacttttccaccttccctgggcccactgtccctatctgtgtgtggcagcccagcccctctgacccgtgctggaggcctggccaggaaactgttcagcctgagaacagtgcctgcccttggcctgaatctgtaaaattgggactccagtctctaccagcaagacctacccccaaggtttcctcactcaggacttacgattctgaccccaacctggaagcgacaggggcccacggaagtaagaaaatgtgcaatttgtcccaacagttcaaagctgatggcttaaatctgtactatttcactcaaaaggtcacccagccctgtccagcctgctctgcttagctcagctcaccctgagccctgcgtgggttccaggattttaagggctcatctgagaggcagggcaacagcgtgattaagggcctggtactggttcagagcaagcgaagtgtcctctgaattgacagctgctcccccactgctcacattatgacctgagctctgctccccatcagatcagtggtggcattagatcttcacaggagtgagaacactattgtgaactgtgcatgtgagggatctacgttgcacactccttatgggccaaggcggaacagttttatcctgaacccatccctcccaccccgaaaaattgtcttctaggaaaccagtccctggtgccaaaaaggttagggactgctgccctagaatcagcctgcccctcaccagcttgggatgcaaggcaggaggtgctgcctctctctgtctcagcctcctgaagtccaccttaaaaggcttataagggttaaacatggtaatacctgtgaagcattaagactggcgcctggttggctgggcgcggtggctcgtgcctgtaatcccagcactttgggaagccaaggcaggcagatcacgaggtcaggagttcgagaccagcctggccaatatggtgaaaccctgtctctactaaaaatacaaaaaatagccaggcatggtggcgcatgcctgtagtcccagctactcaagaggctgaggtagaagaattgcttgaacccgggaggcagaggttgcagtgagccgagatcgtgccactgcactccagcctgggtgacagagcgagactccgtctcaaaaaaaaaaaaaaaaaaaagattggtgcctggcacatgagaagagctcttattagccattcttctggttagaacacagtgggcagtatcatatgcttctgggattggatgccattatttctgacttcataaccataacaattgtcatagctatatttattgagtgcttactctaagccagggacagtgctaaatatcttacttgtattctctcatttaccacccaaatccagtgaggtagatactcttattacccccattttatagaggatactgggctcagagaggttaagcagcttgcccaaggtcacacagctagtaagtagtaaagtagaaatttgaacctgtggctgtttggctccaaagcctatgctcttgtccaggattctgggcagttccccattccttctaagtaaaaggaagaacagtgaaactacgacactgtgtgcatgtgtctagttgaagttcctcctaagatgggcagtgtctggatggagttcgtgatcagtcctcactgggggactctgggagccaacttcaggcaagagacgagcatggtctgaacttagcccaggaatgaggccacatggtcctcaaaggaacttggaagggctcattgaaggttttcattctcagcagtctaaccatctccccccaccactaagtcttgttgactcttaatttgcttttgcagctgaagcaataaatgtaaaggttaagaaagaaagctttagggtgtagctgattccaaaggctctgccaatttaccagctgtgtgacattggacaaattacttaacttctctgcacagccacaagagccccacctgcaaaacggcgcataatagtaccgagactgcctgtcagggcagttagatgatgcatgtctttggggctaagggcatgcctggatttcagttgtacgactatgggccagaactttgacctctctgtggctcagtttcctccactgttaggtgtggacaatagcacaccttgtatagttaccttatggggctactgtgaagaggaaatgatatgtgtaaggtgcttggcgctggtaagaggttagcatgatgccagaccaaaatgggttattaatattaggttgatgcaaaagtaattgcgggttttgccattccttttaatggcaaaaaccacaattacttttgtaccaacataataaatgtgactttaaaatcaaaaagctcatcattcagagatacaggcctggttgtcaaagcaagacctatgaagcctgcagcccctcccaggcctctgaggggtggcattcgacatgagtctgacctgagctgtgacccttccccagcccctcttctctgctcctccggcagtcgccgggcagggcactggccagcagagccatgatgtgacgtttgagcttccccaggcagggccttgcacaggaacactggcgagatccggtgtcaggaagaagtcccaggtcataggtgtgatgcccagagacttgtcttccttcagggacctgagtgacccctcaatggaagaaagcagccctggcttgggactcaagggctggggctggaggtcaagggtctcgtcaggaccacttgcccctcccagtccagtcgcaggtcacaaggcccagagccacaggcaggggagctgcccagagggctgcagccggaggagactggagtttgggaattctgtgcgagcttccagacagcacatttcctttctgcatctcagtccctcactcagaaaatggggctgctgactcctactccagcctttcagggctgttttgtggctcaaatgggaaaaggtaaaacaaagccctgagaaggaagaaggactgaatgtcagccacagagtgcccccagacaggagcttgcttctgagtagagaccaacgtggggccagcctcaccccaggaccagcgggacacccacctctaagctggacggaaggcagagtcagggggtctgtacctggtgggcagcgtgggggctgcagtctcactctggggttcccggcctcagtctgcaggaagcagtagacgcagtgaccagcagatgagccctgctccagggaaaagctgccacagcccccagcctcaggacgaagtgtcagggtacttggatggggcggtctcctgagctagaaaagaagccctcaaggtcagggacagcgggtgacctttacagccttctgcacagcagccatgcatagctggtgttgagcaggtgttgaaagcgggcatgagggagacacagctccagtgtgccaagatacaatcttctttaccccctcataccgcactgagccgtgcttccaagcacctgccttctgctgaagaatgagaaaaataattctgaggaactcagccacttcctgctcaacccttagcctttcaggttctcatcagctgtcgagacaccatttccctctctccctttcattcacccagaattacagctgggtgggggaggggcacgggggtggcctggcgccatcttctgtcgggttgtcgttcctcttgccaggggctgggcatcaccctccatccccctgggcagaacctgcagccaggtcccccatgccctccttgcctgtggccttctgcggccattttcctgagccccaggctgctatcccccattccaagggatgtgggactctggcatcaagggagctgcagggatggtaaggggatctcctgtccctctgcctgctcaaactgtctcaccagagccatctccacgagggctccaggccccaggcatatacccttacccattgctagctaggctggcgaacggcttccctggaaacacaggactgcatcgggaaggagaggaggctggaggaactttaaggttttgttgggaggagaaagggagaatggacgcagaggaggtaaccaagaaagtctgctacttaggcacaccctcctgcgtccacagagaggagtaaccccggctgctgggcatctgagcctcccccgtcccaccagccctcaggcacttgccaaacaatgcaaggagcaaggaagtgaagggggcacctccagattgaaagcaggggttagccaagggcagagtgtcaagaagcccctggagccagaccaagtgccccgccaggctgccaggtgtgaagtccacttccatggagtttacaggaaggtggccactcaggttgctgtcaggtggctccaggggtggcagtggcatagctagtagtatggagtcctctggggacctcctggggccagggcatgaactaagctggaggggatcttactggctcctgtcccttccttgctcgtacattccagtctctctgccaaccttaacagctgaatggggatgggatagagagctgcaatcaatgctagtccccatgcctggtatgagatgtgtctggggagtccaggacacccagcctctccacctccgtctctgccactccccaaggctagactcagtcctgcctgattagttagaaaagggtcctcctgcttcgtctacttgcttcccctgagtctcacctccaggtggctctagtttccaggatgactaataggttccatatcatgtgccaatttctgctgattgatagtggctgtgttgcaaagaattgtgaaaccttgtctaggctcattaaggagctgtgattgattatcagtgtcagccatgagtgcaggcacagagactgtaggtgtgtgtgatttaaactgctgcccacttctcccaggacctgttataccccatcaacctgggctggaaaggtctgggggtgtcttgtggccgagagatgtcatcataggacagatgtgagctgtggcgtgctggcaaacgcttaagaagtggctcttggggtaaggtggggctgctttgtagcttttgccaatttctgtggtgtgaatactcccaccatggccaatttccagctgccagtgtgaagtcactgggcgccaagttaggaagagatgcccacagttggctcttgcaagactgcacaagttggctctgagtagtcagacatttttcctaagaaatgtaaagcttctcaaagctttgctaatggtgggctgttctgtgaatagcactagaccaggattcaggatcatttaccagccatgaataataggcaagttgcacccttctcagagcctcagttttctcatctataaaatgggagttgggttgtggtgaactgtgatataaggaagtgctttatcagtcacaaagcatgatttgtcaaccatgctcccgggacatcaaataaattcagttggtctacccagaaatctgcctcaggcttccctagaaactcagggtttgggccatagggctgtacgtgacagggcttgagtgttctctttgaagttaaccccagaagacacaggctgccttaaagctcaccggtgtcccttcacaggccagtgaagggactgccttaaagctcaccagtgtcccttcacaaattgcttttcatggtttttaaagttactcatgtttcccttcttcactgctctttgaggcagaggctgttccttttatttctccatgtgcctccttcaagcttcgggggcccatggtcccgggaggcaggcagacctggggccaagtaccagcccagtgatgcatgtgttctgcagccttgaacgcaccataaactctctgggcctcaggtttttcatctgtagagtgggaacaataaccaacaatacttcactgggtcattgggcagaccgagtgaaataagggtcttagcatagcgtcaggcacagagtacatactctgtagatgaataacagacaaattactatttgtccgaatgaggtcttgggtggaggtggaacaggccaaactgtagaagaatgggatcccaagagttggcaaaccacaggtcggtgaggcctgggccacgggtaagggcgtgcgtcctagggactgaggcacgggaggagccccgaggcaggtctggtgccattagtccagcatggggtttctcatccttagcacgattcacacgtggactagatgagtctctgtggcaggaggctctgtgcattgtcttttcagcagcatccctggcccgtacccactacagaccagtagaaacttcccagtcgtgaaatcaaaatgtctccagacattgtcaactatcctctggggagccaaattcccccgagctgagaacccctgctccagcaggcagagtgtaaccaatatcattagtcacccaaggtctgaggggagcccgtgatgcacagcacctgtcctggcagagatgggtgggtcgggcatgtggcagagctggtggcaggtggtcagctgcaggcaccaggaggcatgggtgggggctaggaccccagcttctaggagcccagcggtcaagcagggtcagaagatggttcagatgacactgaacttgggagcaccctgccactcttgatgccccctgtccaggaccaggactggatccagcgactgggtggcaccaagtccagggtcgagggggaggggacttacctgaccactttagaaggggctgagggcccagccgccccttccacccctgagaacttcatgacctccagccaggagaacacaggctttgcagcaagagagaccaaattcaaatccaggccctaccatatggaaataaaagttaaacaatcaacttaagccaggcatggtgactcatgtgtataatcccagcactttgggagcccgaggcaggcagatagcttgagctcaggagtttgagaccagcctgggcaacatagtgaaactccatccttacaaaaaatacagaaattagccaggtgtggtgtgtggtctcagctactcgggaggctgaggtgggaagattgcctgagcccagggaggctgaggctgtagtgagccgtgattgcaccactgtactccagcctgggcaacggagtgagatactatctcaaaaaataataataaattaaattaaattaaattaaaattttttaaccttaagaatcagatgccatcatctaagagcaaggtgaccaccttaggcaggttgcttaacctctaagcctcaggttccaagtctatggaaggggtgataatgccaacttcacaaggttgttataaagacaaagtgcggtgttatagttaccatgcttagcactgtgtctatgtctgccgcataatgagcactcagtaaatgtcgattgaatgaatgaaggaatgaaaaaatgaatcctcctacagcaaacctttctcccttaaaccctcatgtttgttttagttctcatcactggaatttctccagctttctaacataggaaactgttggcttctcagcgggaggaaatgagttattcatctctgtatcatcagagctttgcatcaggcctggtagataataaatgcttaaaaaaatgaagttttccttcctcagaggacaatgagtatactttattcatctttagagagccacagcccagcacagtgactcacacagtaggcattgttaagtgtttgttgaatgaacgaacatacaaaaagtggttgaaaaagggcacgacccagaatgctaccccagaattcttcatgggggtccatccctatgtgtccattttggggaagcatggccgccttgctcggaagaggtgggtcaaaccccggcggagaacggtagtggcctcagcaggaagctgaggcagtgcgtgacagacatcagcagggaggtctcaggcagaatgtccccaccctggatggctgttgtgaccctctcctgacagccctgcttgcgggctgcttagcccacctgagggggctgggacaatcttcatagttctccctgctgcaagaaacaggttcctcctgaggaagcagcaggtgcatgggcggagtccaggtgtcttcctcctctctcaaaatgtggtagtacgggcagtacctcagcaggatcagcatgagatatggtgtgctctgttaggaagaccccaggatggggagtcaggagactgaatgccggtctcaccgccatcacctgcccacaacatggccctggatggtcatgaatctccctgggcctctctctctccatctgtactgtggggacttggtaatgccttggagtgactccatcctttggtgcctggccagggtaatgggcacagccaagtggcccacatgggagagcaactagtgacatcaaggcactgctagattttgcaaagccatcagctccccagcatcttagagctgccaggcattgaacacagcatcaggggaagcatctgcttggaaacccagggctgtcccaatgcaggcctgtttgatgaaaattggcaggggcaggacgggagttgggttttccaaggcacctgaagattttccagtgggtctcatgaagaccatccctaacaggggaaaaaaggtgtgtgagagagaaagtcttcttttatagcacctgtatagctcttccccttctatggcacagcattagctcacaaagaggattttcctgtttctgaaatccctgtaggggacaggtatgggtagtggcagcctggctgagcttggaagagccaaattcccttgcataagacaaaggtgcctgtaaaagacagatgagagggttgagtctagagaagggggctggaggctgaccataacaggcatcccaggggcaggtctggagaggacttggtctgcaggcaattgcagggtggggggtaggttgctttctgaatgagagacagagagagaggcactgtagagaagggtccagagctctaccatttactagctgcatggccctggggagtcgctcaaccttcccatgcctcagtttcttcatccgcaaggcgggaatgatagaacctattgcataatggaaaacccctcgaattgtgcctggcacctaataaggaccatagaggtgtatgcagtgacaatggtggtggcagtggtggtgatgtaaaaaccctcaaaatcttcagtagaatttatatcctccaggggtgcacccagcaaactgctcctcctgctacccagctgagccttgagtcttgtgccagctacctggctgcatctggtgacacctatgcagccgagagtgctaacaacaggccgggctgccctcagagctccagtctgtgtcactggggacatctcagagctctagcctgtgtcactgggggcatcaccagagcctgccacagtgggagccagggccccgtcaggcctggcaggcgcaaggcatctgccctccatgtggctgaagcatcccaaaattgccacaggctgaattttgtcaccagcctgcttctcatgcagaggacatctcccccagccaggaggcacagatttcccagctaagctggcccctctggcaggctgcgctcaggggatattttcagattctgggtgacattcctctgccactcagcctaatggctcccagatgctccccctgctctgtgctccctcccgcttgttctgggccctgcatgcaaggcccgggcctggggcttgctcacccaggctctacacctcttgactttttctgttgcttttaatctaaaacactgtgttcctccttaacgtgatggcttgacagaggccagcatgaaagaggctgtttcctcctggatggtgaccagggcagagaagccgacagataaaggaggagagaaggaagccggctctgggaatgggaggagcacggggaaacataggagcctttattggccgagcataaaagaagcaacaggagtcgcagctgagttaacgtggccagggcactaggggccgggcagacacaccaggcccagctgggaatcaccgggagggtggggtttcgtggctcatgttccgcagaagcgcctttccttccctatctttctgggactgcttttctaaaccttccctcccgctccccacccctattccttttttctccctctcggaacacttgaatttgtcattcttggctgttgccagtaatgagatagggctgctgctgcggccgtgggagggaggtggggagtggacaccagaaagagaaaggaacagagagaggcatggaggagggtggggccggagcccgagagggggctttgagaaagaggctgtgggtggcagaccctggaggggtgaagtgcctaactcactgctaaacagaaaccaggacgggccaatgggcctcaggcagggtgcacagtggccatccacgcccgcccctgcctgcctgctggccctccctgacgtgcacagtgaggacacgggcatgctaacggtcctcatctctacgggatctgttatttccgcctttctcagtgtgcctcgctgcccactgtcccgtgttctgcaaagcagccttgtacacaagttcaggcaggtcccgtagagcccgttttgtggggtgggaaactgaggcagaagggccaccggcaggtccccagcagggctgagcctggggcctagacctctggatttctcatccaattatgaaaatatggagatgaaataaagggggaagagattatattggtgaaagtaggccaggaaaagacaaacttcgaagaccagatggaaacccctccgctgatgaatccttggacactgcttccaaggcggcctccccaccgccccctacagcaatgacactgacccaggcattttctctctctctttcaggacctcctgtaagtactcaagccgagggtctcgtgcatctgaaaggcctgtgtcacctgctggtaacggggttctgggtgggggcactgaaagctgggcccctgctgtcttgttgggggcctatgcaggctcctgaggggtccctccagaatgcctcttgtggggaggaggctaccattttgcttttcacccacttctgcacccctccagggcaagacaatggctgcccccagggcaaagcaggccccaaatttcaatatgaaagagtggctttccctctaattagctcagttcctttgtccccaaagaagctattggagtcaaaaaaaaaaaaaaaaaaaagcaccaggtattagaagaaaagaaatcatctctcctcagttctgccccttgaaaggtcccagaaaacaggtcatcgagctggctgcaagcatggtctgctccaggggactcacatccacacccctgagtggggcagctccattctggccactttgggcaggtggtggtggtggcggcggcaatggttatgtaagagagagcggtgtcagccggttagactgggagacagcacataaattataggcatcatgccgcactccttcctggccttgctaggaagcccagggtggggcagggagtggagccacttccagagaacctgagaagagcccaaggagactgcctccctcaagtaatggatccagagaacaggagcacctgcctttgatatcccaacaaaagaccagagggcgctgggggagctggagataggaattgaaagggcccagccctcgcatcagatctttctcaaggttgctgaaatcaaccctatcatcatcccttccttggagaagtcatttccatagttgttttcctcttgatgtgtacctgtgggagccgcctgcttcatttttagtaaaggccattatcgaagactccatttgtgccctgaaaggcccttgcacccacactgaggatcccatggcccctgacacatcacagtgaggcaggacctgtcatgtcattacttgaaaggaaggataatgtattatggcacgtttggtgtgtcagatcttaattcctatcatccatcttccaaaataaactctgccatatagagctttcacctgtgggaaatgtgctgcttttccctgtctcattctgaggaagccacaagagccctcaactgcccccaccctgccttggggcctcctgcacacacctcacccccaggggcaggatgctgcagcctcctgcacacacctcacccccagggccaggatgccaggacagctctgagtccctgcctgacttgagggtcctttcctcagtaggaattttgcattctgagagcttgtgctggcccgacccagggactgttcccagacccctttgggtctgtgctgaaggagcccatgaggtggaggggatgagtcttcactcagtctctgcccacagagtgaagaagaaaggcccaggtagctttccccacattctgagcccagctcagaagaggagccctgaacctttgcccagtgctggctgaaaccacaaggcaggaggaggaggaaatgggaagctggccagggcaggaatcacctcctcagccctgttatctctgcttcctgcaaaagaagaatgctggtggccagagagaggggctctgagatgcctgtctgatgccgtctgggtgtatcctgggggctggctctgtcctccaacaggaagacccagatttctgcgggcacaaggtcggccagtgcctgaagaacataactgtgcaggatggattaaagctgcagcaggaaccatttaggtggaagtaaattttcagctaccactgccccacccatcatgcccctggcagacattgctaatcaattaggaggctttttaacataatgcattagtcagttactcccaatccattggcatcagtgctcaagctgacatctattggccatccctggattcaatttaagggagaatttcctaatactgggaactatgagactgaaaacagatgaccaagggaagtagggatgtatctttctctgaaggaatatagggaaatatttgccagcagctgccaggccttgctgaatatgatccttgctgaaatagtagctaacacttactgtgtgttagacactgttatgtttttatggaggcagtgtaacatagtgattatgagcatgggctctggggccagaccaactgcaatcaaatcctggcactgccactttttgctgtgtaaccttagcaagtcacttaacctctctctgcctcagtcccctcatctgtaaaattagaacagtaatggtgtctgcttcatatggatgttgtaaggtatatgtgtgtatgtgtgtgtactgtatatatatattttttttacttaggatatattaattcatttaatcctaaaagcataaggcttccctagatgatgcccaaaggtgttttgcaaacctttaatttttttttcttttttagaaaagaaaagaaaaaacttttttgggtgagagagtgagaggcagggtctcactctctcacccaggctggggagcagtggtgcgatcaaagctcactgaagcctcaatctcatgggctcaagtggccctcctgcctcagcctcccaagtagctaggactacaggcgtatgcccccacacctggctaatttttttaatttttttttttttttagagacggggttttgctatattgcccaggctggtcatgaactcctgacctcaagccatcctcctgcctcagtctcccaagtggctgggtaaaccttacattttaaggaagaaattatgattttgtgcatttttattaatgaattttattgttttatttatttctaccccatctcattccaagaaacattttagggggattgacaagctacataaggaaacagaaggtgaggggtggagaacagaggcaggaaagcaaagggaatccggagccatggcactgcaacatcctgtgcacatgagccacacacttggctctgagcttctcggtggtcagagcaaagaggaaaacagagctttggcaagggtcgggctgcagtgaggtaggagcacgcctgatgcttgggcgaagcacagtttttcctgagaatggggcctgaaataagtttccctcatgtgtcctcgtaagggtggcacgatgtggatgatgtcggttgtaaggacacagtaagcaaattgccccttctgttcctattcagagtagacccactgcatgaggttggaccctcctcaccctggcgcgttcccttccctgggatgggaggtcactaccccacttctcagcccactctgtgacattaggggacaggaagtttagaagcaagaggaagagggcattggttgagcactaaagctctggtttaagggacgcagtgcctgggctgtccttgtgggggcctgggaaagcaggagtgttgccaggttcctggtatccgcaggcagattcattcattcgtaaatgtgtcttgaggattactgagaggtccacattgctgaggcactggggacacattcgtgaatgaaacaggaaagtccctacctcaggagctcacattttagtgctatggggcaaaaccaacaacacggcgggatggcaactagtcctgtccccatgaacgctgtagccccacattccccaaggactccccaccgactggtgggtgtcactgcaccaccattgacgggatgtcctcaggaacaaacgttagaagggttgacttactcctggtgctgcctgaacttttctcagcagccctgcagggatggacttgtctcccagggaacaccccaagacctactcctggttctgcctttggtttatgggaacagtgggatgtctggaaggagagaaactgtatgtgacagcagggtctctggagggagaaaccaaggccagccccatgcccgtctctggccagtcctcctctcttctaataatcatagtaatagctgcatttatttaggatttgctatatgccagccgctgtgctcagtgctttacatacattctctcatttgatcctaacagataggtaatgattattcttccattttcaagatgaaaacactgaggcacagagagaccaagatacttgctaaaggttacccaagtagtaagtggcagagccaagaggtgaacacaggtgggctttcttcagagccagaactggaaggaagctttataagccttagcgatcaaggctcccccttcgttttgttcataaaataacaaaggcttacccaagtggcatgccaaggtcacacagctggttgagacagtgttcaacagttaggtgttacgatacctgcctgacctacgtaaacgtcactcttcatttcagggtcccactggaagacccggactcccagtaagtcacttttgtttcttctttcctttgcatctcttttacgtgcttttctcagtctgaggactggctaggttgggtggctggtttttctccaggtgtatctgggtgacaggccactctccagagtccctgatctatagcttagggtgaagtcacctcagctccttcctcctttgagatctagagaggaccctgctggggcatctttagctacagcccttggtgtgcctttgccccaggcagacaaattacagcatgcagatccttccaaagctgcagctgacttccagactgatgaccctaccatgagcagctgcagggatgggcagcccactggcacactgactatccccctgcataccagctgacattcaaaccactgttcctcctatgcctgctgataagagagcggactcaaaaactttgttttctctcaattaccacgtcccaattctagagaggctgtgccaagtaaccatggggactctgggacaaaaaatatagccatctcttattgaaaccgtaagaagagccaggtactgcatttatcatgtttcacacattcagcttgttcaatacctcagtgaaatgggtatgattataaacctgttttatacatgagagtcaggaaggtaaaatagtttgtccatctgtccaagcttcaggtggggacctgttagaggcccgtatcatcacacaccattccatactgctgttgcttgtggtctgtgctccaccttcaaaacccacctttaaagtcttttaagactttgctctgtggagtctagcctggggcatggatgagttgagtagtgggtatgtgtaccgggtatgtgtaccatgggccctcagatgtggagtgacccaggtaagatgctgcagccggtcagggggccggaatcgggtatggagagcaccctggcctgaggctggcaccagtctgccctgtctccctgtaccaaaggccacatccatgagattccagacccttacgttcctccctcttacctaatgactccccttttagacatggattatactgtaacctttggactaatccaacagcttctaaaattcatgcctagcagtggctttcttaatgaaatgcatgtgggggaatgttcagacttgcaaatggaaactctcccagtaagagccccagcacaaaggaggacgggtgaatcggtcccatgaaatccaaggaggggaaacatcagatgaccgaggggaatgtgggcagactttgtttctttcttacaacatccacctttaaaaagcatttagggggcaattgacagagcaagggctgctgcacatagtttccagtccctggccattccacacccatccctaacccaagcattttatggccaggactgcaaagagcattagttttaaaaaagaaatgaaaaagaaaccaaaacacacatcctgaaatatcattcaaaagcccaagagtgagtggaccgtggggctgccacagccgaccacccgccctggcctggggtccttcgcaggcagagccaatttcggatccacgggtcatggtcttgttgatgcttccgtgtgaagggtcctaggagtaacactcaaaaagactgtggatgtgagcccctggtgtacaaagcaaaaggtgtggagtacaaacatgctgatgaaattcacctgcccacagctgtgctaggctttacacaagcagatgccatttattcaacatcaaaggccaggcactggccacatgcttctcagagacagcatcatgtggcatcctcccagcaactccatgagaaagaagctcttatcacccccactccacagaactgatgctcagaaaggttaagggaagagtcagtgcttctaatctgcacagctaccctgccattctttagcaaaagtgaaacattttactcaaagccaccgttggtcttgaccttatgtgttaattttaagagcctaatttcagaaataattgcttctctctggtgtgccccacatacatggtggatgctcattgttcctcaaggcattgtgcctcagtggggttagcagacgcagagtcacccgagaaatgcccatgcagtcccctcctgtccagcaggctggacaaaccacctgattctccgcaccctattgctttccatccttccaggctcccagcaaactctaggccccaccccaggttttatgatgtctgcatgcatatgatggcaaaaaaatattttctaccaaaagggggaggaacaaaacttaataagcagatttccagagtgagatgtaacccctggctacaaaacaaagcatttcccttggagcatctgcaactcgtgattcggctgaatccacatggctcgtggtccttcctgtcagtactggaggtggccgagaggagggaggagtggagaaagactccagaggttgctttctcaaaccaggggctggggaggagcactgctctccagctctggcagagacagaccgaggaaagtgattcacccatctgtcacatgggagctgccagtcaccctgctctgtgccttgaagttgcgtttgataaagatgaggcacatcctggccatggctggaattgatgcaacagtgaagtctaagggagcaagggccttggaaaggcatagggaaactgaggcccaggctgggaccagactcctccttccatgctctttccacaacactcatgcctaagtacacatagccatagcagtggctgcttgctgaatagtccttgggagctgcatagggagtgtacctacatgatgcttgggcatcatacgggatgtcgtccccgctgcaaactgggttagctgtgccctaaatcaggtgcacagtttgcctatagggtccttcacatgctagcctggttccaaccacatctgactgtttctgcctccttcatcatcagggggacaaaggtgccattgggatgcctggacgtgtggtgagttggcccgtttgtacctgctcaggtggccattgcttgcttctccgtgctggcctgtcctctaaaccatggcaatgtgctgtctatcccaggcccaaggagggggtcagcactttcccttccccaagccccagtgtgctttagggagggagaagaaaggagaagggaagttgtattccagtccttcagacctcacagtatggcactactctccagagagctgccacagcaaaggaaaaacctaataaagttgcatgaacaaagccctttgccagtcacctgctgggaacggcaggaacaaactgagcctcgacattgggaggactgccactccgccccccaaagctggcagctcacccttagattcacagctgctcctgcaaccacccctcggtggagccagggttcccaggggccttctctgtagacagagatgcactaagagatggtgaagacagggcttggtcccaggtggcacctccaagtcctcacgaggaggctgagagttaaaacattcctgtttcttgcaggaaagtgaagatagagaaggggagatgagaacgtttgatggagagggtgtttcccagaaatgggaaggccagcctcagcccctgagtgtctacaaagggctataaaggcagtagtctaaggcagtgatggccatgccccaccctcaccactccccagcctgggctaggacagtggcctcagccactctccccatgtgactcctaacttcccatcaacctctgcctcacctggctccccaggacccctgaccacccccatgtcattctcagctttgcctcagaatctcatgggattggctgtaggagtgggtgtagcatccttgtgtgaatttgcttgcctggtgtgagtctgccggtgctcagaggttgagaaaaggcatccaaatgatagctgacccttgctagtgctaactgcttgctggcgttgtgctaagagccttatgttagcttactcagacttcacaagaactgcatgaggtagacatggtttccacccctactcttccgatgagaaaaccaaggctcagaagctaactgtccttcccaaggtcgcacagtcaggaagtggctgagcagaaatctgaactcagacagcccaactccaaacctgcgctcttgatcctgacaatattactactccccactaaccacccacccccactggccttgcagctctgaggagggtctgatccttagaatgaagccccagaggcctgggatatttcagagttcaggacaagtgttccatgtcacagagctttgctctccccagcgcccacctaaggcctgtctatggaggcatgcaggctgggagccctgggccgccccacgagaagctctcccaccacttcccagagcagagcacagtggaattgctgcccggccctgtctgttttcttccgttctctaactccagatcctgagtcctcccaagccgtcacaggctctgtacagagcagggaaacgtgattcaaccatcctttcccaagggcctgcgcatgtggacctgagccagtcacctgcgtcaccatagccctctgagcccctgtcttccaaatgaagatgttgagactcactgcacccaaaatagggtggagttgggttttgtgcccaagccaactgtgggaccccaaagtccctgctcccagggaagcttcaggagcctctcccctgagtgcagagacaggcccacagggaaggctgcaaaatgcaaagtggcagctctgggccttcccgtcctgtccgtcctgtcctccttcttgggccctgtggacacctcctcccaggaagtgtccacacttccctcccatagcagtgggggtagaaggaggggagctgcaggaggtctccctacttccttcttagcaggtctattttcaagctactctggctgctggtgctattttaaatgagacaatgggcccatttggctgcccattaggggtcctggcatgagccacctgataagcagtgaggtggccagtaggtgtgacatgcctgggtcatccctggggttgaccagaagtggccccactggcctgtccagagcagggtggattgggactgtccatctactggtcactgttgttacaagggacccttggccgcctaaccagcctcctctgcatcactgacctgtgctccgttcttccagaggtgtgtgtcctgccttctggcctcctgtgattctccacgccccctccctccaccttgcccggccaggtccaaggactccaggcttgtctagcttggcaaagctttgttcttggtgttcagctggacctgcaaacctcctagacaccagcatcacaacacagtcctggggcaattcccccgatccccaccccaacctcagagtgtcctggccagctggggccatggcttctggggaggatttcctgacttaggtgggatcttgttctcttttctctatctctgtctctctcccattgtctggctttctctctctctctctctgtctctctctctctctctctctctctcacacacacacacacacacacacacacacacacacacacacacacacgtacgtgcctcaagagggcctcttacggccccagccactgtttctcagttatctggagcagctgcacattgcagcagcgccttccacatgccacatgctgtgcttgttggacgtggacctgccatgtgtcgacatctgtgttttgctttgtttcttatttcacagtgatttcttctgtttggttgttgtgctatgaacatggattctcgtgtgggtgcctctttctcatcccctcttttttctctcccctcctttcccttcctgcaccctgtgttgcatgtggctgccccagggagtaaagggccaaccaggcgagaaggtgagtccacactttccccttctgccctgcacccagcctcctcctccaggtggactcttgatgggaggctctcagccctcccccccatgaaagccgcagcagagggtgctggctgggcctgctgccctcactgcctctcacggccccgtttcctaacagcttccataacatcgggcagcagtcttgggattcctgggcggcggtcccagctttcccagctgaggaggtcttccctgccttgccctgccctgacagcatgaggcctcatcgctctggccaatcgctattttgtgtagctggaactgcccagggggacccccgaggctatggaatagagcccccctgggaagtcagaaatccagaagccatcctggaacatcagccctggggggttcttgagagatttctgagagcaacacttcttttttttttttgagattgagtctcgctctgtcacccaggctggagcgcagtggcgagatctcggctcactgcaacctccgtctcctgggttcaagcaattctcctacctcagcctcccaagtagctgggattataggcctgtgccaccacacccagctaatttttgcagttttagtagagacagggttttaccatgttggccaggctggtctcgaattcctgacctcaggtgatccgcccacttgtcctcccaaagtgctgggattacaggtgtgagccaccatgcctggccaagcacaacacttctaaagagttcactctgcaggtgaggaaactcatctgatgcccaaggaaggagcagggctggcccaagatggcacagcaatagtgatgagcaggggctccaagccagacctcccggtgcccggctctgtacttccctgtctgtaatgcagtatttctgcaatagtttcccatctccaaaataacaatctcaacaattataatacagttgccatgtattaaacacaaattgtgtcaggtgcgggtttaagtattttgtctgttttcccaactagcactgacataaccttttcagggaagctttaatattctcatttacacgaggcacagagaggccaagtcacatgccccgggtcacacagctagaatgtgacagagatggagaggtgccccagtgtgtctgactccaaggctggggctcctagctaccatgctattctgtcctcatattggaactagactgtcagctccacattggcatgaggctaaactgcctaggagaaagacacatgaccccttccatggaccaggcattgttttaagtactttacattatcacatgacatcttcacatccaccctatgagacaggcgctatctgtatccttacagatgagaagacaggcacggggacattaagtcgcttgcccaaggtcacacagctggtgggtagcagagctgatcttcagacccaagcattctggctcttaaccatgacactacaccgccttgtataaaaattattgtatcattgccatgacataaacagttactaacttgaaatcatccctcgcctgcctgtaaggtatgacattttccaaaatgcgtttcccgtaagggcaacagagccgctctcagcattcctgttcccagaggaggtatgtgggctcagagaggttttgtgacttttcctggcagagtaggaccttgaacttagggacacacacacgcacacatggcacttgtctagctagctcagccacccttgacagcactttgagctcatcattcagcagcatctgccttcctctcagagctgacattctgccctggccttcacccctccatgtcattctgaaaccgggactagggaatttgaggcagctcaacctttcagggtcagggatgctgagttcacacagcacgcatgttgctcgtgtccccctcctctgttttcacagtcccattctcgggcaggtcactgttcagcagttgcagggtgtgcggccagatgggtatttgcggagggggagctggaaagcatcctgggctgggccggggagagactcaggcctgggcagccttgctaagtctcccctctctccctgtgtctccctgtttcccgccactccaatggatcctgttcttctcgcttccccggcctggggtcccaccaccctgtctccccggaaccccatgtcctgtgttctcactgacacctcttctcctttccctcctgctgcttccccctactacctgcccttcccaacccattctgaatgctccctccttgcccctgtgccctctgtgttgactctgctgatcccctcgtggccctccacgtcccctggcatccctctcctgtcccatggggccggcctcctgctcctggccccctgccagctccttccctttggttcctctctttcccgctcctcttctccatacctccctgcccctcgctccctctcccccttcctctctccccgcaggggtcccccggagacgctgggctgtccatcattggtccccgcggcccccctgtaagttgtttttgctcttcctcggggtgttggggggatgggtgagttgatgaaaagggcttttaggctggggatgaggggacagcgagggcggctgtgcccctgggtggggaggccaccgcatgtgatgtggtcagcccagccaggcctcgggtgccgatgttgatgttaaggaaagtggcctggctaaatatacctaaattacagtcccttgggagggttctgagggacctgccctctagccacgaaactacagcagctgcaaggcggccctgctgtttacagacagaagggagaaagggctcgctctcctccggatggggtgatccggctttcccgggaaccagcctttgtttctggaagcccatggagcagatacgagtccgggttcactgacccaggcacgcactactggtcttgccggagggccagcccacactcaccctcacagatgcctctgtgtgcagtgctgggtcctgtgtgttcactagcaccctccaccccgtggctgggagcttgagaaaaccagcgaggctcccctcacatgtgcttccttaaggaccaaaacaggggtgtgggtgatgaagccagcaagatatcgaggctgtgggaggaagggcttgttattttcccagagccctgaaccacggggctttaataaaatcaccacacgtcagggtggaaaggatcccagggatggtctaacacagccctctcagaaggggaaactgaggctcagagagggggagcgccctcccgtgtagaggctgggcaggattagaaccgaggagccccggcctcaccacagcagcaggccgccggctccaccttctgcacttttcctgacccgccgtgctcagtgaggggtgggagcagagggctagcctctgggagactgagacccacagcagagggagaggggccagagaacgaatggctaacttacatccaagggagggggcctgcagtgagatgaacagccaagcgaggggttgtggcgagtgcagggagctgaaaggtagagccagtttgagaaggagagcaggggcaggagagccaggctggcagacatgtcaggggctgggtcggaggcagaacttgagtggccctgggctgagtagcatggcctttacagcaaggttttcttctgggttcagaccataatgaccacgcttaacacttcctctgtggtggtcttatcttaagacttttacacgtattcactcacttaatcctcacaaggactccatgacatagggactgtgatcacctccattttacagatgaggaaactgaggcacagagaggctgagtgacttgcccagagccatagggctggcacgtggctacactggtagctgatcattcagccagaccatctggctccagtctgcttctggttcctgctgcagtcatagacgggccaggcctgatgtcactgtcgcatgtgctcctgggctcacacggtggctgccccgatgggcttcaagcctcctgtgtcctggaggaggtgcagcaccaatgccctggccaaattggtcctgatgaaggtggtgatgggaaggtcatagaaacagaagacaggctcccaggttctaacatcgaggactgagcccggtgtgttaggaggacaggggagtaacacagcatacaggccctaccctatgctgccatctccgtctgccttctggtctggctactgatgttctattgtgtggatcctgctggtcctctcacaccctttcagcaaattatgtcaacaggctaccaaaaagttattgaaaacctccactgctgtaggtgtgttcagggcagtagagcctctgctcctcccggcctctgcccagcatggataacctaatcagaaacatatctactgcactggatttgactccagtagtgaaaagcaccttctgctcaggtagcaatgacagcttctgtttcccaggcacctgtcacataataggtctccttcacagctgtgaggcaggccccaccagcccattttacagaggagagaacagtttcctaactcgcctgtggtcacccagctagtaagttctggagcttgggtttggccaggttatcctcatcccaaagcctgcattcttgcctcaataccctgttccatgtttgaaacgctacgtttaaaatgatatttacttcaggagaaaaaagtcctccaggtgggtgcctacattggcaccaggaaaggttttatcataccaggagtcttaacgaagcccagcatcctctgactttggcccccatcacccagtggctcgagctatccctgctgagtccccactacagcacgggcagccccctcagctccttccaggaagctgccctgagctaatgggagcagggacgggggaagacaaagggtccatttgtcattaaggggtagaagtcaagtgggcacccttggtggcagccagggatgatggagaacatgaaactttccactcagccaggaagggtccagcatagatgctgctaataagaaccagccttgccactcttaggggccacctgcctcccctcttggagtttgataaatggtccaagcaaagggagaaccctccaagcactttggaggagggttcactttctaatgaagtgagctggaatacagtgttggggcacgttgactttaagggaggctcagtaaatcgagggggagcctggacctccaagatgctggctggcccagcaggccctgggcagaggatctgccagtcctaggaaatgccctacctcaaagtgtgcccattccctctctgagctctccagcttctcttctggggcgaggagatatctgaacttccagtcctcatccactaggagccaccccacaccaggtagacacacctactgagtgtgtctcaattcactccattcatatttgttaagagcccagtgcctgctaggtgctgcgtagaaacctgacctctgtcagcttgccctctgggcacatgatctagtgggtgacaccagtgatcacataatccatgacaatgcagacagcaagtgctaagccaggggatggttagagagctgtgggacaaggaggaggaaccagccttgtggaaggagggcaggcagggaaggtttcctggaggaggggataataactgcagtcaaggacccatgagaagcccttacattatggtcaggggttgggctttgtcctgagggtgtgaagagcctgtaggttgtgttaggctgacgtgggacatgaccagatttgcagtttacaaggttgtagaaggtccagcatgcagcatgtttagaagagactgcagtgggaggctggctggaaggcacttgcaacaaccaaggcctggactggagcagaatcggtggggctggccaggagggctagacttgcaagctattttagaggtggaattgaaggatttcgtgatgataaaaaataaggattgagggagaagcaagaactcaagatgacaccacatttctgacttgagtaacacagtactctttcccagaaggaagagcagattttgccaggggagatgagttgaatttgagtgtgatgagttagagatgccgtaaagtccaatgggaactgtcatctgctgctggaagtcagagcatgtggtctgctggagctgtcttggacggctggcaagagtggaccatgcacacctcacctcctcccagctgctttcagtgacctcatgttggtagcttgaaatcggctatggtgggtgtatttataccacagacattggcaggtgctctatgaggcagggctctcctctccaccctcccccactcagctaatggttaaacatttgccggcaaggagtcttgttggtgagggaggcagaatgaggctgcccctgggcagagacacaactgaccatctctcaagggtcaaataagagaagggagacttcttggtaggctttttccaacaagaatcttctgtctgtgtatttgcaagtaggagaaagacagggaggagtagacataggggtctgctttcagaagtggggacctccttcggctcccttttcactctgaccttgaattaagggagaagatttcagagatcaatgtaaagcttatttcccttgttcttgttcagaaggatgtaatattaatccatgaattaatgtacaaatacatctattttgtatacatttaatgtgatcctaatccctgtgcgtgtcttatgaggttggaaatccaacgaaattctactagatatcaaaatgtattacaaaaacaggacaatctaagtaaacacatgaacagaacagaatggggaggccaggaataaagccaaatgcatgtgtcaatctggtacatgatcaaggcttcatttcacaataggaagagaaagctcaattgttcaagaaatgacgctgggacaaccaataagccagttagtaaaaggtaaaatgaaagacagttgtttggtttttttattattaaagccaatttattcattatattggaataaattccaacgagcgaaatacttagatataaaacctgaaactgtaaaatacaaggacaaagcatgagtgaacattttataattctgaaactggggaaggcccttttaaacatgacacaaaacccaaaagccataggagaagattaagtttgtctgtagaaatataaaacacaccagaaacaaaataaatgccaaatgccaaattagaaagaataatcatgacaaatatgactatcaaagagttatttttcttgacaaagtgcttcactcaaatcagcaggaaaaaaacaacctactagaaaacattggtaaagaaacaggcagagaaatattggaagagatgtctaacctcaggatataattgaagagacataaattaaagtgcagttccaagtctcaccacatgcctttcccaggcccagcccctccagaaagtggtgtcccagtttccacttggtccgtgacaacattcttccccagatctctgaaaaagccttggttagccctggatttgatcctggttggagacattcatcctgctaccagggcaggctctgtaattaacaaactgtgtgattatccctaccacgtaaacattgtccctagcgggatggaagatgtttcttggaatcctctcctcctgaccttttcttcaggcctcttggtgtgcagagtagtttacagaaagtttacactgggaggcttcagagatgacattgtgtggtttccgggttttctccttgttttattcttagcatcacttatccttgagaggagaaaagccaggggcccttccgatagatgagtgggatctcctccctcgtgcccttttggttggctgccacaagcccatcctaagcctgtggcagacttcaactcactccctgttgaaccagcgcacccaccctgatggcagggtgcccatcctacccagctgacgtgttccctgagcacaggccactggacacttatattcgtggcttcagggaggaccctagcagcctggagatgttttagggtcatagcatgtgaatccagagaaatcttctggagaggatctgattctaaaactgctgcttgacaaggacaaactttcattgatcacaagacatattgggctcaaaagcaaccttgctctattctggagcttccctgttcagttcagttcaacaagtgtctgatgatggcagctaccatttcaataggctttacaaacataattaaatgtaatttgatgatcctatgaggttatactgttacctctattctatagatgaggaaactgaggctctgggaggttagacaacttgctgagggtcacacagtcatagtcggaggcaggattagaatttagtctgccagtctagaaagcccatgcctgggaagagattctggctgtgtcagccaaaggagaccccaggctgagaactgggcatgtttgtttggtggtgaacggcgggtgagccagtgtgtctgagcatggaatagatggaaagatgtggcaggaaaggaaactaatatggttgatggggatgggattgagggatggccttgaacatggtagaaaggagcctttgctggttcttgagagggagagtgacaagactcacgtttcttagctctccatcacccctgaccacctggccatccctcctcagccctgcatcatcacagccttgtgcttcttctaatctcatcacatcccctttgtcctgaatcttgatcataaaccactggatcataaatcactgtggtcagtgaacctgcttctagtctccgtcctaaatatttatttatgttgcactctgcacctccaggaaaataggcatagattgctctgcatcccacaaagattaggggatgctcagagattgcccaactgctaggagaagcctgctggctagagtgagaggaacaggagcaatctgactagtctagcctgaaaacacacattttgaaggtcaggttctgatatccaagccatccttagataagtggccatgagcaatgactgtgtaaataaaaaagggcttagaggatcgccgtccaggagttccatgtgctgcgggctgagtctccgctggccccactgtcccatgcgtttgtttacaagccatgcatccacagcggtgaggagctctccaggagccacttcccagaagtagacccagaggatgctggccccttcctgttcctttcccacccccagcccctgcaggagatttcctatgatgttccatttcatctttctccatcttccctcccaacccactaaccacagtgagtgtcccccaaggacgatcacacaaagtgagagggatgggagcaaagatgaactggaggcctagggattggctctgtctcctccttgctcaatctcatgtgtctcttgttttttttttttcagggtcaaccaggaactagaggtttccctggatttccggtaagtggagaaggctgaagttagctgtgtcccaggtggtctgtaggcctgattgggttaaacttcatctgaggtcagccccggttccactctttctctcccaaaccctggtcattaaggacttgcttctacagccattcatggacaccaactcaggacagtagctcagcagtcaggtcatgatgcaaggaataaatacaggggagcaaatacacaaattaaggggcagcaggacaggccccaggtgagtgaagtcacaggctgataaaccccagcattgacctgggaatatagaatggacgatgccctgtgggagaacaccctgcagctcagcctgtgcctgagctttgagaggagatccagcgagggggaggcagaggggtggccatctgggtgtccttgacctctgcttatggggcctaaggcaggttctgacaggcagagcagagggagcagttccccctttctcccaacctcaatgcaggccagcccctgatttctaggaacacaccacctactctgcactcaggacaagggtgaggtccttgacattaatggggaggccacccattgggttctctcttgcgctgtgcacctggcatccaacattctattattctcaaccccatttcaggatgggaagttgaggcctaggcttacccatagtcacattaacaagtacgtggtcaagcagggccttgagctccaacttatcagaatccagaatctgtgcttttccccactgcccaggcagcctctttggcaggagtcctgtgatgctcagtctttacatctggcctttctggtttcagggtcccattgggctggacggcaaaccggtaagtggacccgctctctcccctcactgcaggtcagtgatcctggatctcttggtcattctgcaagatattgaatccttggaaaatgctttacttagaaagaaaagtcctggggctgaaggttgtcactagtgggaagtggagggggccatttgagtcacccctgaccccagtggccttccccagggcacaggtccccagctgctgagcttggctttcgaagtccaggcgagagccatccctagaatgggtgattctgggtggggtgggggtgagatcaggaggcagtgaggagagtggagggtacggaggtcaaatagctggtctgaagagcctggccactcatgcacacgcttgcccctgctccccagcacctgtgtctcccatggccctgtcctcgaggtcagggtctccctccccgattgagaccccacacgtgtgctcaagtccacgtggagactgcttcccaccatagctcctctcttcgttcatttcaatcctttggacttggttccctgacacaaatgttcatgggagaaaggagtcccctccccagtcctaggagcaagtcagctggaagggagcatgacccatccaaagccctcagggtggacggaatgcagccccactcacagccatgcctggccccgccactcgcctctctcagttgagggaccctagcaccacccagttactccccaactgcaggccagcgagctaagtgcagcccaggggtgccagcaatcatttccactcatgtcacgggaccaggcatcccccgaagctaccctggacatgtgaatggcatgagcgttggggtctagggagactacccccacccctgctctctgaagggcaggcagctgctagtgaggcccagcgaggggcagtgagcaaatgaccttgccttagggactgggtgaaggagtgcacaagccagaaggtgcagatggagcacaggggacagggaggagcacggggggcagggaggagcacagggggcagggaggagcatgaaggacagagggtggaacttctgggctgcgaacagtgcacctggtactcaccctcttctccttccagggccacccaggaccaaagggcgacatggtaagagcccagctttcctgccttcccgagatgggtgggggttggcccagcctcacaggcacagccaagcactgcaaagtgggtcccacagggacaacaggaatggctgtccatgctggtcactccccagctgtgtaaaccacatgccctggatcctcacatcaatatgcagggaggagaaatgggcaggggcttctccatctgaagcatgaggatgggagatccagagagagtgcacacctggctggtagcacacagaggtcggtgtccagcttactgctctcaaaccacactcgcatgggccttgggagacaaggtttcatctgcactcacaggggacactttctctaggagacaccatttctactgagcctgaggtccctcaaggcctcataaccccttccgggtgctggctgtgccctgagccaccccaggactccaggggttcctgccccactggggctggtggtgcccagtggatcatctcagctgggggtgccacatgcatcatcccaaaggccccttcccctctcccttcctgggagtttctgtttggaggttgggccacttggcaagtcaggagcaggagcaaggtcttctcttccatgtcacagcatcccgcggccaccacccagatggatctgcccagggtacctggagtgcctcaggccccaaaaaggtggagagacaacatttggcccagctttctcctggcccctaccttctgcagagctttggaaataaattttctgtctccacagaccatcccttccagaagggaatgaggggctgcgcactctcacggtgggccagatctcagcagggactgatgggccattaagagctaatgggcccctgctcccacactgtggagtgtattttggttttcaataaatccctgctttaaaaaaacaaacaaacagacagacaaacaaaacagccctgggctggggtgcatttctgcctcctaagatccaggtcgcacctactgtgagggaccacctcctgctccacaggttggtgggccaggaatttgtgcagggtggtgaaagcaacgcagcaggctccccctgtccctgttcagtgggggcctggctcatgccttgctccaagcgctggtgtgaagacaacccttgacccatgactggggcactgccagggcatggagggaggcaggtaatcatgtgggtggaaagggggatggtggagtgttggctgcaaggcctgggctccagcctagctcttcctaacttgccagctccctctgggccccaacctgtcctcttgactcagatccaactaatatttattgagggtttgccacgtggttggcactgggctaagcactttgcatgactgtctcaatcctcagcgtaactctgtgctccaggtcttgctagaatcccctttgacaggtgtggaaaccaaggctcagagagtctaactaacttgcctgaagtcacacagctgaatgtccaaaacaagatcgaaacacagttctcaaattccttccctccctttttttattaaggttttattaccttcctccctttctgtttccctcactctttgtcagccttcctgccaccttccttcttttaatgcattttttatggagtatctaaaatgtgctgggcactgcttcaggtgctagggatacagacgggagcaagagagagactgttcttgccatctgtagctcacagtctagtagggagacatccttttaaatgatcactcacataactaacaagttgctttgcaatgagtgctataaaaagataatccttagtgccctggaaatcttggtataacaaaaacctcacccaggccaaaggtcggagacggcttttctgagaaagagacttttgaactagtgcctgaagaatgagcattcaaccgagagaaaatagaaagggggatgggaatgtgctttctggacatgggagaatagcacgtgcaaaggtcctgaggtaggaaaatccttgacatgtctgcagaaccggaggaagggcactggaggcagaaggccctggaggcagtggcagaagagctggcgctggaatccaggttccccagcaaggtttcctctccatcacagctgcctccgctgcaaatgcatttccccccgcccctaccccattcccaggcatgctgtgcacatgcatggagtagtggagaccgaggcaggaagaaactgccatgccacattgttatagaggcataaagggcttggggtgctcatcccttcagcctgagcttctttccctctctggcagccttatgctaccgtaaggcagcccatggccccccagaagtaataataatggtcatcctctaggcagcactctgtcatcctcataacagcttatcatccccacttcatgagaggggaaattgaggcacagagtggctaagtacattgcctgaggccacaaagctcctaaatacaacagctgagattcagacccatgcagtggagtcttacccctcgatcacacctcctctcagcagccagcactttgtcctggaggaaagggacccttccatggggccgcttttcctgccctcattctgccacaccgtccctctgccccacacacttgaccgcctgtccagggatcagagctaactcaacagaaaaggcaggcccaccccctctctcgtgagcccacatcagtgggatagatcccctgtctgcctcatcaaatccagcaggccacagagcatctgattcctgtttggcttggcatgggtacccgagctgttagttgcccaccgctgtccagcatcattaccttgccctgctcttcatctgtctgtctcctgccccagatgctgtcccctccactggcgtcccactggggcactggcactcaccctcattgtttaacctgtgtcctcacctctcaaaagggagtcacctctgccccacccccccacttcacattattcccaagaacctgaaataaggtgttgaagtgttgggaggacacagttgtataatagtgtagttggggggtggacaagattgggggtctgagactcaggaatgacataagggctgtaaagcaaggcctggactgagtccaaatctcacccaccacccacagggctgtcgagtgaggagcgccaggcactcagaacatgcttggcacccgagaagcagacaggcgccttagctatgcctcagtggcggttagcacaggcctgctggcaagtgctaagcacatcaccggtggccatggcccttaaaggggcaggtgctgcctggctgaagataactggtaccatgtgttgttggacctcgacataattaagagaaacttgaaatccaaatttttatttgcactctgcttgctctcttaagtattggcaactagttgaaataaaaccatgtgggacaaacaaaatccctatgaagaccacgattgtcccctgggccaccgtttgggatgtctggtttcaattgtccaagtctctgcagtcctgaaactccgcctgcccctcccccatcacacttatatctctgtcctgacagaggatgacctggtcacctgtggtctgggcccgggttccctgccggatgaatcatgtgctgcagaacttcattctaagcactctgccaggccgagcgcggtggctcacacctgtaatcccagaactctgggaggccagcacgggcagattgcttgagtctgggagtttgagagcagcctgggcaacatggcaaaaccctgtctctacaaaaaaatgcaagagttagccaagcacggtagtgtgtgcctgtagacctagctatttgtgaggcagaggtgggaggactgcctgaacccaggaggcagaggctgcagtgagcggagatcacaccactgtactccattctggacaacagagcgagaccctgtctcaataaaacaataaaagaccaataaacacttggccagccacatgggctgggagtgccacatggatggtcccaaaggccacttctcccttccagtgatgctcttgggagtttcccagtttggaggtggccctgttggcaagcggggagcaggaacaaggctctggcacatcacagcatgctgcggccacctcccagatggacccacccttggggatctgcagtgcttcaggccccaaagagactggtggctcaaagggacctgcttatggctctagccaagtctagaagccctgactcccaaggtctggcccagttctgagcatttggcagtggaaacagctggaccttggccgtcagacaaacctgggctcctgtcccagtgccacctttcactgagccatggggccttgtctctgtcacctcactcgggagctggagtggacacaagcatctccctcacagacacatacctgaagagccagcctcagggtggatcctcagcccataaggcatttgttttctcctcttccctccaccagccttggtgcagcctcctaagagagccagagcatgcggggccctccccagacagcaagggtccctcccaaccccagctcctttcctagccctgcatggacaagacaaccttgaaggaaacttcaagacccctcatattccttggagaagtccagaacatggcttcagttgccaacttcctgctttctctcttttgctgaaggtttctctaaggcccccattgtctgaggcaccggcccagcacccccaggccagaagttcttctggttcagtgggcttcactgcagcctgggaggcaggaggtggaatgtgctagtgtctcccagaggcttgatgcatgtgaggtagggggtcccatggagcagaaaactccctgacctctaggtagagcccctccatagctggcccatgagatgctggtggttggaggaatggatgaaagatgccatctgttcttcatcacagccctagtcctgcccactggggggtgaagcagctgagactctgtgaataagacatcttgaatgtggtgggcatgggaagacctggccatggctggtagagcccagccttcgggattcagccccaatccccacccaggcaggtgtccctgattgcctgtcttctgtctgcccactgacctgtgtgtgtttgcttcccacagggtctgacgggtcccccaggacagccggttggtacctcatccatctatttcccagcagagaagcttccggtggctgtgaccttagctttggtttctaactctctcatctccgtctctttgtagggaccccagggacaaaaaggagaaaaggtaagagcagtggaggtttcctagagtctccatctcaggaaatggcctcccagttggtagaaaggggtcaattatggttattttcaaacttcagttttaattgacagaaccaggaaagcccccgaggtgccgcataatagattcggttgacaccgctccaggggacatccttttcttggagtgaggggtcctcctggaggctggtccgggtgacatcctttccaggggtcctcctggagcctggccctcttcagcctctttctgggcccctcccagctgtcactccatggtgttccctgacacctccatgagcctctgggattctgagaggcatcaacctgtaaaccactggcctggcctcctgccctctctgtcttgttgaatttctgatagagacactgctgtgcttgcccttgggccgctggtacaggggcctggcgctcccagctcagagaaggtggcttgggacccccatggtgccggctgctcccatccggtggctcctgttcagggctgtctggtgggcctgcctagagggtcaacctttcgccaggcatggggcataactcccgactctgccattatggcaagtggtataaggcgaagccccacccctaggctccctggggccacttccaggcaggccatggaagtttcttccctgctgctagccaggggcaagggagggacttagttcttctgcctcagagggctcagaccaaaactagagcaggagggctggtgagcggtgacatgtgtggcatgtcctgaagtgctgggggtgccctgagaaacaggtacccccaacaagtgcctaacaccacctttcccttccctctccttcccagggtcagtgtggagagtacccacaccgggtaagtgaacccctaaaatttagcagggcactttgatccatccctggggcacagcgcccagctcagcctcatctccctggggtctccagttactaacagatcatgggggagcaggagcacccactgccctctgcactcagcagtcagagaggggagcttgggatggtggtgcgtctggtgggaacagctgatgtgtctctccagccatgtgctatatggagccgctcatcacccgtgcgtgtctgtacatccgcccctttgtacgtacgtctgactcggtatgttggagtctcctgctgtgtgtctggagctctgtggctgctctgcacatggccccctgtggcagcgtgacttgtgtgagtctgtttgactccccacccaacaagcatgtgtgtgcgtgtgtgtggcggtaggggggtggtgtctggcagcctagccgtggccaaaacagtgggacttttctattagtcactgtatcagatgatggtgtttcacatccaaacctcgatgatgggagataatcggggactgactgcagcaattcaaggataaaatctctccttggcctctttaaaagcagaggaaacccttctccaagcagggtggggatttcaggctgagatggttcctctgcccacccccgcctgctccttccttttccttgctccaccccaagacacagaacccaaaagactgctgttgtcctgttaggaatcttcaaacttgtgtcccagcagcagggtcgatcttgggacaggggagagcaagatacgcacagcttcctccagtaggagccccagtgagctggacccagaaaaaaatgcccctcattttgtggattggcctcgttgctcccagacctggacagcagggatggaagatgagcatctttaggcatctctccccgctgtcatgtgccccatggtgctcagcttccctggctgcccacccctgccaggcaggtccgggtggtgcgattttgggagtggagacagacataagccaggctcagtgccagcttgactctagaaggctgtcaggagggcaatgctagcagggcctagcctctgcccagaccctcaggaagctggaaggcaggcctgaggtctgggttcctgggccagggaaccactgtgagcctggtacgtgagaggctgggatgggtttaaggctacggcggtgctgggcccgggctgaggaaggcaggccagcagcagcacagtcagagccacagcctgtcagcggcatgtgctccagggatgcaggggccctgctgttccggccagcctgatcctgatacaataatagaaggtcagctgtgtttatttgaaacgatgggctcacggggttattatgttacccgaaagaaagacaacatcccccagcacaaaagacaacacaactgcagacgctttggtagtgtgtctcccgttcttagtaagtgcttggggtggggtgggggcagggctctctgcccctcagcccaacataaggaaagggaagagcacagtgacagaaggctgcagaatacccctggccacagggtgcagtgaagcctgacctcatgacagtggcactctggggaacatgtcaagcgtggggtgggggcatagatttgggattccagctgaggggcagaccaagtttatttagaagagggtagaaaatcaggggccttctagagatctgttggctttccaaggggttgggttggggtggcaggtctcggggcctggaagacaccaagaaatccaggtggcccctcctccattccagcctgtggcttccccagggagggagaggagaggggtggggagcaggggagctggtgtctgtgggctctcccctcacggtccctgtcgccctgtctctgccacctccatcccctcccaaactaggagtgcctaagcagcatgccagcagctctgcgctccagccaaataattgccctgaaggtttgtaggttctggaaggtctccgggcccctctccactgagaggcttcctgaacatacagcccaacattgcacatccccaggccccggcagtgggagcgggtggagctctgtgtgccactgctgtccaagaaggcagcagctgtgacctggaaaggccacacttgggctccccatccccagctgggcgcattcgcagcccaagcagctcctggttcttaacactcatcccaggagtctcgtgtgatttaagcgctttcaaaaacaagcagctgatgacagtatatgccatctttgttttcacatgggctctgatggcctcctaaagccacgggttgctcagcttcaatgggtagagggactggaagctgcaacaatttccagaaatgaaaatcacattagataatatgactgcaagttgcctcccgcaaaaacgtggttgagctttctggagatatctttgcccagcctctatcttccaggccccgcagccccagggtgagccctcagcagcacttaacatgtgcccacgctggcctcaccctcagccagctcaaaccccggggaactgggcttggcactgcccttgaccaccctccccagatgcgctgacaccagcctttcttgctcaaccaaaaaaagaacccaccagccgcacaccagcccaacttcaagtaccaatttcacgggcccggtggttccctggccagagcctctgagttggctcccttctgtcccccaagcagggatgggtggggctggcagtgcaacgttgggctgtgtgtccagcagcctctgcagcccagcatggccacggagggcaagcctggccatgtgggagccactgtcccattccgggggctgctggtcaacatcccaaactctgacctggaggccgaggccgggtgtggactgagggccacaactcctcctaagggacggctgtgccatccaagggcaagctccgctctgcatcctcaagccgtgagagtgccctgtccactccttccctcccactcctcatgtgcacgctaatctctcttctctcttcctctgctccggtccctcttggttgccctgccctcctggtgacttttggcatcgatctgaatacctgtgatctttggcctttgccctctggccctccaactcatctttctcctcagctgctgcctctcctcaattcagtgcgactggctccacccccggtcataaaaaggcggacgttccaggtagacacctcccgtttgtccagaccatgtgtggtttcccaaggggcccggcaagcctgctggggctgcagacaaagccagaacctctctctaattcagtgaaattaaatcagacaaaaataggcccacgtataccatagacatggaaatacacaacacacaggccccagaagacccacaactaccaccacacaatgattactcaaaacagccatcaacaagagctgtcagtgtgtgccaggcaccctgttacccatttcacaggcctggttatatttcattcaccaacagttttatgaattaggcatgatcatccttatttcacgatgaggaaatcgaggctcagagaggttaaccaagttgccaaggtcacacagccagtacattgcagagtggggatttgtacccagtctctctgcctgttactagctgtgtcatttggggcaagttacttgacctgtgtcccagccttctcatctataaaataaggataataacagtgtctatttcacagggttgttgttgatatgtaaagcatttggaatagttcctggcacagtttaagagacataattgttagctgtttttattactattatccatattttggagataaggtaactgaggctcagagaagtgaattgatttgcccaaggttatactaacagtaagaggcagaattgaaactggccttgaagcagaattgaaattgaagtcaggtcttcagacctcacatccagggctctctcagctggacctacctcctctctacttagaaatgcagactgcttagcatctgatccctcgtaacctgagtttggggagcaagggaatttgtggagggaatgtagtccacaacccacattgtgagcaagtgcttccttcttcttcctgccttcctaacccaaggaggcttggataggagcagatcacaaagaacaaagccatctggcctctgctcttcagagatcacagcttgattccaggctggctggcccatggctgcccctgtgctcctcacctttctcatgctgcaccaggtaccccgcccagcacagggacgctagcagtggcagggctctgagctgctttctacaagcctgaccgcagagcctcaagcaacaatctggcctgactcaggagtcaggagcccaagggcctagatgttcaggcacctgattgaacaaggctgaaaaatccctccaattaacagctaaaaatacagagggacacgtgactccagtgccacccaagcctgcaggccacatatctcattacgcctggccaaatcctcgagagcctccgtgtgcccgagcactcaccagagcatggctactcaggaggcccactggcagcttagagaagtaccaggcccacccctgtcacccaccccaggctgtgccggaccccattccaggagagctgagtccacactctcagaatagccattctcctgggccccaacagcgacctcccagccttaggtgtatcagctgttcttttttgagccctcactgggttccagacattgttgtgagaattctatgcaaattatctcatgcattccccacaccagccatctcactatcccccgctttacaaaggaagaactcaagaggggtgcaggattccatccaggccactgcatgttactgcctcccttttcaagagcaagaggtggtgaagccagaactttctgtgctaccctgacctggtttccaaagtagagaaagaagacgaggcacctctgagctacctgctgcagattctgcctccagaatcaggttttttatgctgtcagccactatgggacataaaaatgcttgtccatttcttatcaataaaccaatattgattttacaggctctacaagccgcttaaacattgggtctaagattcactgaaaaaggaagctttatatgaaatatgatgtgcttagcagatggtgttggacgtcatttccaaagagcagaaagtgtagatggtgagccctttttgctgggggcttacttggaaagaatagggagagtctgcagttccaactttgggtcctggcgccaccctgaattcccatgtgactttgatcagagaattcaacttcttggagcctcagttttctcttctgtaacataggacttgtgacgttatgaagattctagaatttcacagccagaaaggagctcgggagtttacttcagactaagcctcccccatcttgtgaatgtagaaacccacaaaaaatataaacacacaaagtacaggattctgaggaggttccgggacccaagcagctgaatcagatttgatgtggttgaaaaggaggctgcactggtccctttttaaggcctgaggcttagtgaagcctttcttggttcagaagaaacactgacacctgagacttatcaacaaccaacatgcagccgggtgggggacctgcagtcagggcagctgccacagtgatttcaacacctgctcctctgccatggacaccctgagccctaaagtggcttctcagagggtgtggcaggataggacccaggctccagagtgacactgctagatgccatctgcctacaggttttccagccaaaagatggtgcaagcaggtcttgctgaaagcttacatttctcattcccaggttgtgcactcctatttatcaccaccacttccctctagagtttgcagcaagcatcatcagctgccttcctcgcatggggaagcaggagacccctcaggtgtgtcataggggcttgctgagatcctctgagaaaggtgggccggcctggaactccagccgcctgcatcccccagcctccaccctagagctcccacacctgccaggaggttctgcttcagcccatctgcagggatgggcccctcctcacaagagctaagcccagattgatcccagagaggtcatttagaaaataacaaaccaaggagccagacttggtttagatctaagatgactttgtgttgccccagccctgaaatctgggtcacgtgcaccaggccatctcctcctccagggggagcatgatgccatcgctacctccctgggctcacagtccatcccgtggacaggcatggtgggaaggcgggctcagagcagctggctgaggagacaagggaataataacagcctccccacgcagcataaagcacttccacacagcttccaaactctttcaatgaaaccaaagattgcaggctcaattgccctcccaggccaggcagatcaccttaagtaacagaagcaggctgtgtgtgagaagggctaggagggagaggacaaaagcagccagagaactcaggccccacttaacaggcagccactccttggacgtaggaatgtgggcccagctcagccagggttcccagtgtttcatcagaagccaccaattcaaattttatatgtaaagtctcttgctcagttgtttagtgagccaaataaaattccatgggctttgacctaaggatcccatttgatcctctgggtcagataaagacagcaaaaagctgagacaggaaacgagggctattgttcccattctatggctgagagactggggcttagggagaactgtgcctcgccacacagggagggtgacagaggcaggcccaggctgaagattcaggccatctggccaggctgggagcaggcctttggttgggccaggggctgtctcccacccactcctctgcctctgcccccccgcagaatgtctctccgcagcaactcctctttggaagccccaccttcagggacctaacatcttggcgttcttctcactgccaccagcccctgcatgtcatcaccactaccacagcatcatcaccatcatgccaccgcttcctccccccatcaccactccttcccggcagaaatcacagcaggccttcactgggtgcatggcctgagggtgggggacggtctgcagctctgggggccttccctctaacattcgtttccatgaacctcagggcgaacagagccaggccagcatccaaggtccaccagggcccccaggcccccctggaccaagtggacctctggggcacccaggactgccagggcctatggggccacctgtaagtattcccttcctctctccttcaagacttatcccaagaactctctggaaacctccaaaccttgaataggcagtgggtcccctacaaaaagcagaaatgccttggcagggccattggatgtgggtgaaccatgcaaggggctattcatccccatcacactcaccacctgttgcactctggctctgaaacacaacctgggccatgttccctgccttccagggaggagaccgccaatggcctgcctgccccgttcccagccccagcagagaggaatttggaaagagaattcccaagggcacctctgatggctatccctgagccccttagcaaaacctgagtcaggcagtgggttctgaaggaggtagtgaggggtcatccaactacctggcaccccagtgaacatgccttccaggggcgtgtgcaggtttcacactgctgggccacctgccagctgagctgaaggtccagtcagccaagagccctgcgccaagcctgaggatgcatcaagcctgcggggcctgcagggtcactgcctggaggactccagagaggccaactggcacctctccaggctggaccacattcaagtgacaggtcaagcccagcggccgccaagtcacccatgttcaagccctggctaagactccactctttcccagcccaatttatacaacaaagccccaggacagaataactcagtgggtacctggacttcagagaaaacgggtcttccacccacccgtaagactaatgttattggagaggcaggtaaagggcaaaatgctttttaaataatgtttttcccatgtggtagaaaaaccaaaacaaaacctgtttttccttcttatgacaaaagcaccataaattaattgtgaaaagaatggaacatagacaaagaaacataatgtttgtgcgcatctctgatagttttgctggaatagagtcccagaggtggaatcactgggcaaggatgtccccaacaattagcaccctgtgtgtacggccacattctagatggcctgtttgcatgtctgggccccttggctgcccagctttcaatctcaaagcttgttatagggtcttcctgggccgggccacagctatggccgaacacagcatccaccttggctgggaaggccagcacaatgacccctgcaatgcttgacccctgaaatgaattttaaatttttccacaatttcgccccagcaccccagagaggggggttagtcttatttccaccagtttttagatgggaaaacctgaaaggaagggaaactcaggaaacggaaccaaactaaggcaagaaaaccaaaaagtgctccaaattcactttttgctgaccgctgccctttctaccccacccccctcctaacacttggggctctcatccactgaacccaagccaggtggttttctttgttaggttgtttataacaacaacgacaaccaaaaaaagaaaaccagagagcatgtttcttaacccaattgcaatagaccagactcaggcatcacggctttctccagcccacgtttgctgtccacacctacacccaaggctgcggtggagccagcagccttccctggcctctccctcggctcacaccacctcactgtggccagctgccatgcccacagcaccatgggcagaaggagacagagggctcctccactggcaggcaggaccaagggcaaaaccgaggctttgctgggcaaggccggctttctagggaggggttccaattaggaggtgggtgaatgaggatctggaccaaaccacactgtcaatttagcatgatgctgctgacctactttccatgggtgagcacagcagaattgcccgcggcccccacatggctgcaaagagggacataagcctgttatccccacgtgccctcagcaggtttcagatccccttctaggatccactagagctgttggctatagcatgcctattctcttgccatagctattgggagctgctctgcccctagggtctactgtaagtatggctagccccaaccagctctactcaccttttcttttttctttttttttttttttttgcttccacagggcttacctgggcctcctggaccaaaggtgagtgtccttctgggtgatgtgttgaacaggtgggagaattccctgcaggagggagggggaggcagcacagaaggtgactgaggcaggagcagagagggatctcagctgagagacagatcaagcttgacccacttacaaaacaccacccttctcaggaactaacttgattccaacaagaattgcacttcttgggtgctcacgccaatgaagctagtgctacgggctggcattgaaggcacagtccaccctctaaggagtatagcgtctagctggaaactctaagctcatgcccagaacaccgtcacaatatcccaataaaatagtgttttataaggtgtcagaatgggaagagacctctagggtaatccagtctcctgtgaaccctcacccagaagcccacaatgtcaaacaggctctccctttgaagctggggaccctggggctctggggacaagaagatgcccagtgctgattgtgcctaactatcttataaatgcagaagctaagagccctgtgggaaagtgacttgtccatgttcaatagaatcaggtctcctgggtctcctgggtctctacccaagtgactcttcccaccattcctcagcctctgcaaagtggagcctgttctcaagagtagaacaatctgtgttgtcctcagaggaagctaagagctattgctcctgggaaggctggagatgggtgttgaaggggcagtggaacttggagtcatcgagaggaagagggatggtattgtgtggggaacagcacaagtcaaagtttggcagtgggaaaacctctttaatggccttctctttgttttcccagggagacccagggatccagggctaccacggccggaaggtaagatggagggggaggacccaagtggggcaggactttggacaaatcagtggcctactggacctcagacccaagagggtctctcccttccaacctaggtggctgtgcctgtagtgaggcaggccaggttctcactggccccccgagggcctgataagtgggagccaaattactgggatccacctaggcagagttctttctgtgctgagccaggatgtaggacatggaggggtccagctcttacaggccagagagtcagaagcactcctgcacaaataaccccagtgaaggcagactttattaagtgctactgtcacaaggcactgcacgattacaggaggtggagagacaaatttcaggttgagagaagtttgggaaatattctgggagaagacagcctgagaactcaaccttgatgaatgggcagatgtatcagttatctattgcggtgtaacaaaccattccaagtttactgactctctgtcacaattctgtggattgacagtctgggaattctgctaatctcacctgggctcactcatgcagtcacaccacatgacagatagaagggtgggaggggacaagatggccccattcacatgtctggtggtcaatgctggctgtgggctggggggccctgttctccacatggcctcttatcctccaggaagctagacagacttccttacagcacagcaggtccagggcagcattcaaaatgggcaggtcccagtgcataaagacttgtcacgtatctgcttgtatcacattttctaatgtcttattggttgaagcaagtcacatgaccaagtcatgtgagtcagtgtgggaagagtcttaggctctacttcttcactggaggagtagaaagcatttgtggcctttttgtttgtttgtttgttttttgtttttgtttttgttttttttgagacagagtctaactctgtcaccaggctggagtgcaatggcgtgatctcggctcactgcaacccccgcctcccaggttcaagtgattctcctgcctcagcctcctgagtagctgggactacaggtgcacaccaccatgcccagccagtttttgtgtttttagtagagatggggtttcaccatgttggccaggatggtctcggtctcttgacctcatgatctgcccacctcagcctcccaaagtgctgggattacaggcgtgagccaccgcgcccagttatggccatttttaatctaccactgtgggccttccactagaaaatctgaatggaaacaatattttagataggtaaacaatttgagcaaagacccagaagcagtcattataataactgtaatagcaataataattttatggtagtcactacttactgaacacatactatggtctaggcactatctttcaacagaaactgcattatttttagccctaaaaccactctgtgaggctggtatgactattctcctatttaaaaaatgagaaaactgtgtgtcttagtccatttcatgttgctataacagaataccacagactgggtcatttataaagacaagaaatttatttcttaccattttgaaggctgggaagccgacagtcaaggggcccatatctggtgaggaccttcttgtgtcatcccatggtggacagtggaagggcaggagagggcgagagaacacgagcaagagaaggctgggcttgctgttataacaaacccactgtcgcaatcacacacccactcccacaataactaacccacttccatgataactaacccactcccacaataactaacccacttccatgataactaacccactcccacaataactaacccactctcatgatgactaacccacccccacaataactaacccactctcacaataactaaaccactcccatgataactaacccactcctgcaatcacaaacccacacccatgataactaacccactcccacaataactaacccactcttacaataactaattcactcccacaataactaacccgtgataactatcccactcccgcgacagcaacattaatttattcatgagggcagagctatcataatctaatcacctcttaaaggtcccacctctcaacactgttgcattggggattaagtttccaacacaagagctatgggggacacattcaaaccatagcactggagctctccaaagtctcctggctcataagtggcagagcaggagttcagttccaggtctgggtccttcccatggtaccacctgctgtaaggagtgcaaccctgccctccagaccctggctgggaagctgctagagccttccaggaggagaaaagaggcaggaaggaaaggcagcagcaggagaggggcagaaatgttgggaagggaagaagcactccctccaaagcacattcctcgcacactgcagtcatgaggttgccataaccacatggctttatgggtgcctggtgaatgaaatggcaagacctgagagatctttaattagttctacataaactaagacatttgtattgtatcaggaagtggaaatcagcccccgcagttgcctctatccactcacacagactcataaaatttactgcctcctggtgcaacgcgggatcagtttttcattagcagcagggccagctctttcaagctgtgaaggagttgcagggcagcagagggtctccaggcatcacggcgatgcccttggctggcatcataccatgacaggtgtctgcattctgctgcaaactggaagagtgattcatccagaaggggcatggggtctgctgtcctgagtacggagaatcctctgcttggggttagggtgtcctgacgctagagggcctggtcccaggacagtggcaatcctagactcagattgtaggaagaaacatgtaacccaggctacattgaatttgcagagaagaccagtgtagccctcctgatgggggagcacttccggtccccaggaagcgggagatttgctcagagcctccctgctctagtgtggaagaaggatcatactttcttttgcatgactagaagtagagcaagtgccaatgaataaactctacaagaagagtaattccagctccagaagagggagcttcctaatcgccagatgccttgggagggagggagggagttctggtcaccagaggtgttcaattagaggctggataatgactggtctgggatgtgtttagagaagtctctgtatcagctgggacactgaaaatcccttccagctcagggaagtcatagcttcatggggacagagttggctccatagccttaagagaggagcagctctgagccttgatccctggccttgagaggaggctctgtctctttgaaccttcgtccatgtcttttctccatccacatccagggcttgtcagaagcatccccactcctaggtctcatgaggcactgaggagaagacccttccccttcatgctggactcttgcctcccaacccttctgtctctgccagaccaccctctctgctcttctccggtagcctcttctcatggaatctggaggggctgtgaggccatcatgccccatcaccgcctctctgggtcactggaaggttcccattgcttccactgctcccaacctgtcactgagtcttttcagtaggtgccactggagccactagccttgcaaagccaacagcccatggctggtctgggcaccctttcctctgttctggcctttactctgctgggacccttatcttgccactaactctccactgcctccaagtccaccaaaggtcagagggctggcactgggaactatgaccagcagcaggcagcctgccacgaaggacttgaggtcattccttgggaggctataaatgcctatcccactgccccagcctcactgggacagcagatatcttgacccccagtgatcaccatgatcaggcagaagtttatttcccctctgaatcttgagatgaagtgatttttcatctttgggcagtgcagcaatatttcacatctctagtttagaaagttcatttattccaccttattcagttcttaccatggctcagtggttagaactcatcctgattgtctaaatgagagagactttgcccaaggttgcacagctagtaaacagccatgctggaatttgaaaccaggcctcatcaagccctgtggccagtctgtctttgcaccctggtgcagaagttgaatatctgctcaggggactcaccccaggctaagctaactgcacagaccaaccctcccaacctccacctactaatggtttctttgggatgtggagggctgtccccctacctcccttctattgcccatcagtcctctcttttattctctcctccatgctctgctctctgcttggagtaaggcctacggaggaggcactaacacgaagggtggcttggtctcaggggctgggaagatgagtttggcctcccctaccaccctggggaggagcagtgccagcagctggggatgccaagctgagacaggggccatgtgactgcctcttgaggtcaggatgtgagcgggacctgtggggtaactgatgggccccccacatgagcttccttgcttcaccccagagatctgacccacttggagggacacctttctgacaccacaggctctcagtctatgaagtttgctaatgtccaccaccacccccagcagctggactgggcctggtatcctcttaaaagccagccagacccgcaaggcaggcttctccatcagttccttgagatcaaagcccagtgtggccagcagcccctgtgctgcccccatgccccagtcagggccagccctcctgcctagacactgcgagtattgttgtgcacccatgtggtatctatttgatccaaatttatgacactgatctactttaaatatgttgcaagatgcaaagcgtgtttaaaacattacaaccttggctctctttcaagggggttgacgagtattgtcagattgtgtgtggatcacaaaacctggtgagagcttatcttttaagtacgcagaactggtctgtctgtctcactttgggggcgcatttgatgcctgtggtggcctggatgttaagcctcatggtttgcatgaaggaccatggctgaaacacacattcccctctttcaggctgtgggtttcagaccagaggaggaaatgagagcttcaggctagagctgtttgcaactgcagctacccctcctggaggccagtggggctccccagaaacaggaatgccctggggaggagagtggatgggccctatgatgagatggctagagggctggggaagggcacagggacagaagcccacccacccagccatctcagccttcattctgtggctgtgctggcccttccccttgccccttctcaatgcttcagccaaagggcatgaggattctgatctgccagccagagcaagggcccgtgtggtggacacacttctgtagaatgataactcgtgcaattgtaactaccttactggcttcttcaacaagccaggctgtgtactaggcactttgcatgcatcaacttattgaatccttgtaacaaccctgtgaggtaggttttactcaattcccaacttatggatgagcatactgaggttcacagaggccattttccccgaggtccacagctaggaaatagagaagccaggtctgtgtgatcccaaagccttgctctgaatggctttactatctgcctcttagcagccctgggggaccccatgatgatttccagtagaccttcccccatacccctccatgaatggaaggaaaggaggtggcagctgagctgttttcgttcttgtaagagaaggctggattcaggcctttctctgagtctccaggctccctgggagcatgtctgcagagtctgcagcagagaacagggagtacttggtgtgttgctcttgccaaagaattaaggaagtggagtgctttgcccattggcactgactccatccaaataagtccctcagggagttgggatggtttcaggactcccaataaagcctggaggaggcagcttgccccaaccttccacgacagctattcctgaaaccttcctgcacccctccggctcctgtaggacctgagtagcccatgcggttcccactcccactgagtgctccgtgcagatggaagccctagatgcaggagcctgctagtgcggggacagcattttctttgaaagctgtgaaatcctagtggggaccattcgcattaaagataagaaaactaagatctgggcctctgatctgagaccttgtggagactaaagcgaccccagcccccaccctgagcactctgggctttgtttttcatgcactccaaagtccaagattaattagagctgacttttctttttggaactaactacaaaatcaaccgatctcaaattgagattataagccagctgcccttccaaagccctggccttcaatggggcacccgaccccggtaattccccggatcacttcctgccggccctaattacaggaggaactaggatttccgcggttccggtcctctctggtgtggaagatggctgtagcagggaagcaggaactgagctgcctttttcccggaaggaagacctgggaactctttatagggagaaaaccgttagccctccacacctggcttttctggcctagggaaaagaccctggtccaggcttgaggcttgagctgtccaccgaccgccccccacccccacccctccccgcaaactccccacactctcaggcgggccttcctcctcccttacagagaacaaagagcctgtgccaccagatgcatttgctcagggccttccaacccagacctggctgcagcagaaaccaggcctaatcttagagaacttcatttacttccccgtgcttccctggcctgaccttggctgggagctgaccgtaaagcccccttccttcctctagactgtgctttcttgccaagtccctgcccagcttgttcaacaaacagtaaatcgccaattaagaggccactcccacaggagcagagcttggctggtttatgctccaaggagctcacttccattctatcatctctgtaaaggatgcatcctcccacctggaatcttggaccagaacagaggacctatcaatgctgtgtggtgctcaggtgcagtgcccagctggggagtctgagtggcagcctcaaaatcagggatgggacaggccttcaaggtcattcaaagcaaacgcctctctacccacttgtgctcccctagagccttctcagccacaatgactacaatccatcccttcctgcattggttcttggcactgaggttaaaaagccagccttgcagaggggtggctggatgttggcccaggagtcacagcttctgccatcacaccatgcacgtggccaagaccttttgtaaggctcagagcacccacttccccagcccaagtaaggcggctgagagcccccaggggaacttctgagtcccttctggggagacaagagggggcagagatagaggaggtgaattgaggcctgtgggctttgctggactgagtgagccaggccctccaaaaaccaagacagtgatgagtgagtggatggaaactgagcacaattactaatacactttttaaataggaaaacctaggaggggaattagaaaagaaggagcccttagacaggctcacacaaagacatgccccaaggaacagtcctctgaacagaggtgggccactgtcctcctcgggcaataaccacgccctccccctcccccgcctcctgcctcctgcacatgggccccagccacagcgacgacgctggagtccttgataatgactctcacctccccatcatccaggaaccaatgtttttggctttaggagaagccattccccagttcagaggtcaggcaggggcaggtccctggagacaagccccagggagtgagcctaatgagagtggagtgagcggcagagcgaggtcagctgggggaggccagtgggggcgcccctgcttcctgccaagcaagggggtgggagggagggaggccctgccatggggatcaaggaagcccgggtcacttgcgaaattaagagaattgacccagagaggagggaaggggcgaaggtcagccaccctaacaaggagggctgcctcccgaggaggctcctggggctctgatttcccctgagtacctgattgtgtctttacacactcacatcaacaggggctgaggacaaccccaattagcctggagactctcacgctccggggttttgctctgcacagtttcttccaggattggagacagaagcccagagacaagcttgaagcagacaccacctcctccctgcaggagcacccctctgggcaggaggaagggagagcagggacccactgagacccctcctagagctgcatttttaaccaaagctaagagtccctccccaccccacagagcctttttctggagctgccaaccaagccaaatggcacctccccagctttggcctctctccttccaaagggctgtgcaggggagcagagaaagggctggggtgggtgggaagagacaggagcaccagtggatgggaggtatctgatctaaccgcactttgcaaccaagaaccctggaccagtgggagaaagtggcttatctgtggtcacctgcactgccagcccagctcctcgaaatggaggtgggaagaagagggcagaggcattgagggaaagcaagagaaaagacagagaaagtagaagagagggatgacgggggcctctgaatagtcaaggactcccaagctgacctcccacctgcacccacaccagaggactgtgggggcctctgtactgagtcaaactggtctggtcattcagaatgctagcaggggaccctccaaaggaaagaatgacaggagccctcagctggtactactgagagggcttggagaccgctgtggcgggagtagccagacttcagatgaggtactgtcacgccctctgctggccacagagcggctgtgcacacaggcagtgagcttttctgggcatcctgcgctgagcggcccccacactctgacccctgcacccctatgatgggccacagacctaaggacccccaccaagcaaagaggggctctgctccgctttcagcctgcaaaggctgtttggtggaagcagacggaacatcagtccatctgatacttgggttggccaagagaaataagtaccttggcataacagacaacagactatccaaagccctaggctgcatgaccttggcaatcatacctgtcctctgtgagccgcagttagcttacttgtgaagcaagaataacgtccactcccacattggaagggattgttggagatggaagagaggaaggttgtaaagcttttcagtccagtgcagacacatggcagctgcagtaagtggctgtgcccttctctctcagtcccacaagaaggaagttagtgtctagagcaagccttgggctctagattttcagccatggtaacttcctgaatttagctctgccatcccacctatggttcaggggtcactggtggggtcatgctgagagagggctctggcattgggaactaaagattctaggccttctgtagaatttagagacttggcccaaagaggataaaagtgaagccatctcaggcagacataaatttgtgtgtgccgattacaaacgctaagtggtccctgtcgcattgaggatgcagcgctgagttataggggatagcaaaaagcttcatagaagagataaaagggccccactcccatcaaacagcctctgcaggctgaaaacagggcagagcccctctctactcagaggccctcaggtctgtggtccataggggtgcaggagtcagtgtgcgagggcagctcagcccagggcaccagacaagaactgggtgctctatcaaccaagactccaaatgatgaatagggttttaagttgaaatggaagaaagacagaccgtggaaatgggtagtgttttcagggacacagaaactagcaggacacagaaactagtgatatcatgacatgatatcaggtgatgaggctaggaaggaagcaggggtcagaacgtcatgctcaggaacctggtccttttcctactgtcaacagcaggccaaggatgttttaaggcaggggtctcgctatccagcctgtgtgttaagaagcttaactggacacttgcatggaagacccatcacggaggaagagggtggaagtcctctagccttggtaaggagaaggatggacgaggacctcctgtaagatggcaggaaagggagagtgtggacagctgagaaggaagccagagaacaccagatcccctctgcctttaagcctatgggaactgcagcctggcctggcagccacagcagtcacacccaatggggcagctgggccgggagcaggattgtcacactctgtgttgcccatccacagcgctggccttcagatggaggaagtggcagcaggctggctgcagtcacctgttgctggacaccatcccgggccccagctggggcttcgtgctcaggcactgcataggattcaactcccagagccaggagctgccctccccactcccctgatgtagccgatgatagtcctgactcacctgctcttggcctcccacttgtccctggctgtcatctccaactccacctccttgtggtgtgtccttcttcctgatctcaccttactgtcatagacttggcatttttctggagaagtaaagatgttgaacataaagatagggcagtgccacgatggtagagcgaccccatgctgtcccagaggagcaacaatggacaggtgaccctacctgtgcctctggacaagtagggtcagaaatggggtgcagataaatgggcagggacacatgcccttggggagagttagacccagaggacttggaagggaaaggaaccccagatgaaaagagaagagagctcctgtctggctcagccagaaggtatcatcctagcaaagctgctggagtgaaaatgaggcaagaagtcccaggcagggaccagagggaaggtgtgcagtaggtaagcagccaatgggtggctcctgcccctggtcccgtcccacagcccaagttccaggtacagctcaaccacagggtggtaggtagatcttgggccagtcacttctcttgctgaacttgcattccactaggtaagcctctctgtctgggggcctttcctgctctgtgacctgtaattggggccctcctgcaagttcacatagctgaggacaggggcccacacagctgccaccagggcagggtcctcagagctcaacatgaaccggacagccatcccagcctccagacaagacattctcaccgacatccttgcaggctgacaggccccgagtctggtcctctcctcatgctttctcatttcttcctccagggagaacggggcatgccagggatgccaggcaagcatggagccaaggtacctcccccttccccacatcccaggcagccccaaggcccctcccccagtgcccatccctctctcctcagctctggggacactctggagtcccagctctttgggcctccttctgcctgccctggttctcccagctgcagcattgtggtctctcatcagtgccccctgatgcgggcggcctcctcctgggcatccctgggtcataaaaagccatctcaggtaccactagctccactgcagtcctaagacccaagtggagagtaggggcccccaaaaatcacctccacttgagatttgctaaggggcactttgggcatcatctatctctcaaagtgaaatgatatcaggtgatgtgaaaacagggttttcatatcagctttcacaaagctgatatgaaaacagggttcactccagccactccccagtccatgagggcagaggtgcacagagctgactgtgagggtaatgccaaccaaacactgggggcgactgtccctggtgaaatcagcccctttactttgtcatctattctgcacccctctcccgtggctttccattctcctgccgtctcccttcccatctcctcctcctcctcctcctttcatattccaacgaagctcccccttccaccccagggaccccctcccagccccatctagtgccccacagtccccactgtgcctcccaggagaggccaggagccatgcaggtggttgggaagcccagggagccccgcagactgagctacacaaagccccttcctcagggtccattctcgtggcgtcagctcagcgcccccacctcccaggtggggttggtggttgcggggttgggaggagtgagcggtcctccttctcatcacaccatggggaggctgtccactgccccccgccccctgctgccccctcgctgcagaatgtcttcagacctttttttttctctctctgccagggggcgcccggaattgccgtggctgggatgaaggtcagtggactgttgtaaccaacacatcagggacagggtgggagagaagagagcgggcagagctggaaatcttagactcagtggggtggctgccagaccaatgagggggcatacaggatttggaaacatttttctcaaagtaacatttgtgccaggtgcataaccttgagccacagatgtgtaactaagccttgcaagtaagtagcaatggtttcctgcctcaactcactagcctgccaatgcaccaaggcagcaggaaggcagcccagatctttcctttatgctctgtaattgggcagctatatgcttccaaagcttcagagagagcaggagttcatctccagaacccccaccctaactgcccatttggttggcaggcagatgtgaggacagcctggaaaaacaagtgctcaaattctatcttcacagcaggtgcacttacagggggcaccatgtccaaaccaaatgtccattccttcctctctttcctcctgggctgcctcacttatgctcccacctgccacacccctcacctggggaagaataggaccctctaagggtcagtagcctgataggcctcctttggcctgggacctgatgcctgaacagagaagagccggggctggccagatgtttcactaaccccaccctgactgcccccaaccccacctccaccaacaggtgccttgctcatttgtttctgctttttctgtctctcacatttgtttctctttttccacacagggtgagccagggatcccaggaaccaaggtactgatgcagagagaatgttccgggctgcacagagcatcggtcatgggcagaggtgggaggggctgctgctgttttgctcttggtccccctgaggctggcctgggactggggacctggctaagcagagaagggcccactggtcaggagcacactgcaaatgcctccccctccctgggtcctggcctgcaggcatgccagctgcagcaggcagtgactattgtcccctgcacccacagggttctctttccctcttgtgtgacaataagaggtgtgacaataagatatgtgacaagaaaaaaagtttgagaaatgctaggttagaaatattacacaggtttctttgctgcagaccttctcagaacctttaatttgctaaatgtgcattgaggagctctcaaaaggaaatatcttatgtggcattttcaaaacgtttttgaccagaacacccttttttaaagaggaaaagcttaagggacaagtattctggaaatgctggtcaatgatcactgcccatcctacccctcactgcctgccccatcttcttatcagtgactttctcttcttaccccaaagggagacccaggagcagaagggaagccggggcccccaggtttgctgggaaagagggggcagagggtaggatatcgtgtatttgagtgtgtgccccttcatcctagcctcaccattcccctactctctggccttcctccatggctggtgtgtcgcctgcagcgtgctgttggtgcatgtgttccgagatgaggggagtggcaggacggcctggccaagcttcagaaacccacactcaagagcacacccactctcctgggcagccttgattacccagcagaaagcctagcagaaggaggaacttgcctccttccacctctgctccccaaggatccacatcctttccttctccacatggcctgcttccgaaggatacccaaactaagcacatctgcaggagcagcccaggcaggacagggcagcaggggctccctcccactgccagggcctctgcctggccctccacaacccctcttggccagcctcaggctactttaccgttcagctgctaccctggggcaggtgccaaggagacgacaccaaaagacttggtgtggcaccttctgtggctcccactggaatgaatgttcattgagacatctgaccaaattataagcccagagccctcagctcacattattacacatgagaactgcctctccccagggccatgggtagcaaagcttcttgtgctgacctgataccccagccctgctggtggggtgctcttggacactcacctgatattggacactgctgtgcactgaatatgtccatcccagacccatatgttgaagccctcacctccagtgtggctgtatttagatagggccttggggaggtcattaaggttaaatgagaccataaggtcgaggccctaatccaataggattggtggccctagaagaaggggaagaaagagagagacctttgagagaccgttctccctctctgccttgtgagaacacggcaagaaagctgtcatattcaaggcaggaagagggctctcaccagaacctggccatactggcaccctgatctcagacttccagcatccagaactgtaagaaaatacatttctgctgtcaaagccacccagactttgttatggccgcctgagctgaccaatacagctgctctgtgaaaagaaggcagagcatcagggagacgggctcgacctgcctctgccactgactcagtaaggggttggccaccagtcacgtaacctcttggggcttccctcaccaaatctgtgaaatgagaatggggttcagcatctctaaggggctctttgattcatgtcatgggggaaaaagagttcttccgtagtggaagaagctgggtagggaagtgtattattttgctagggctgtggtaacaaagtactacaggctgggtggcttgagcagaagaaattcattgtcccacagttctggaagctggaagtccaaaagcaaggtgttagcagggcgggctccatctgagggccaagggggagaatctgctccaagcctctctcccggcttctggtgcttgctggcaatctttggcattccttggcttatagacgtatcaccccaatctctgcctccatctccatatggcatttccctgtgtgcatgtctgtgcccaaatttctcccttttataaaaaggacatcagcacattggataggggctcaccctactcccatgggacttcatcctaactcattacatttgcaatgaccctatgtccaaataaggtgagctggttatagctagaggcggagaagggggtgccagaaaagactgggagcccttagttgctaagcattaagaatctgaagaacagagtggtcaaaaggaattgcttgcccaaccactggcgttctgaactgctcacctctcccaggagaccgccaggatggactagatgcttctggcctttgttatgatctgtggccagtgtgacttctccccagcatgaatgacaagggcccgggccacatgggaataaggaaagcagtcatgcaggtgtcaccaacgcgaagtgacccatggaagtagccagtcaggatgggggccgggaggaagtggagcccttcagaaagccagctgggggcaggggcaccgaggcaggagcaagggaaggcaaggccctaagctgtggagctggtggcttcccaaacctgctgcagaaacagttcctaacccccacactgtctgcatctccctgcagggtgagaagggggctgaaggctcccctgggcttcctggcctcctggggcagaaggtaggtgttgctctgaatggagggttcaagtccttcgtcacccacatcccatacctggccctgcacatccacacaggccccagcattggacgtgtctgtctcccagactgcaggaaaggcagctggaacacagccagattctgtttgtcgagggagaggtgccataggcaggccctgattggcaaaaataaaatgccgaaatgtaaagaattcggtagtgatgacctggtcagatttcttggtaccagctctgcaaatgcatcccacagttcatgaactctgtaagatatttaatttaaaaattaaaaaaaaaaagatgaggccaaaataaggggagacatgcataataagatgggacccttggaaagtcacagtgctcctcagcctgttagaggcctgagcaccctgcagtgatggggtctgcaaagcttatttaatgtttcatttcttacatagtttggccaccaataataatgttattccacattttgaatattctcaacccactgaacagtgttccgtggaatacactttgagaaacacggctccagacccagttttgaaggatcccttgtgtcagctctaaacctgctgcccttcagtaaacacttccaatctctcttcaaatcccacagctggatcagataaatctgggattctgaaggcccctggtccccagacatcctggggcccacaccccatagtgtccctccagtgctcagcctagaccttcctccacaccagggatgctaactccaccttccacccccagggagagaaaggcgatgctggcaactccattggaggaggcagaggggaacctggccctccagggctccctgggcccccagggccaaaggtgagtgttccctggaattggtgttggggaggtgcttacctggggactttgtcttcagcctgttctcggggactctacgtcccggacatcccgccttctctagccttcccctgctccagatgtgtggttttccccatggattccaaaaaggccatttggacccagctcctgcttgcaagcagataacagtttgacctttcagaggagatgtcttccctggggcagatggatggtcccagtgattcagatgactctgatgtaactgagtcagggcgcaatggctgcaggaccttcatggctatgctgtaactgagtcaaggattgatggctgcaggaccttgatggccatgctgtaactgagcaagggaccaatggcttcagggccttaggacaggcaagaggccccccaccttggctctgagtaggttgcaggtcaactatcagctggccccacctggtaccagcacatctggtaggtggcagcagtggaggcagctgcaaatggaaactgccctcactttccttttgctgcttgaaaagtgcaatggtaagatttgggttccccaaagcagatggctcctatgttgcttggtttactttagcagcactgagaaatgaagggggtctgtttcttagctcagaaggaaagcatgaattactctacatcatctggggcaatacactcattcattccgcccatatccacctgccatgggctgggctctgtgtgggcctaggagggcctggcagggcagagtggacaccagtaaagggtacagaatgcagggaaggaaagcaggagtgggcttccagaggaagcaagacccaggctgggcccaagcatgggtaggagtcagggaggtggaagagtgggaggtgcagaagccatcagggaaagagaagtccaaggcaacatctaggcatgagcggcaagaccatcttttccctcataagcagctgtccaggtgcccagcatgccctcatcccaactctctcctcttccccagggagaagcaggtgtcgatggccaggttggccccccagggcagccaggagacaaggtacagagacccccacatcccagagctgcaagatgagggtcagcttgggaggtcaagaatcatcccggccgaccctaggggtatccctcagggcacaaggctgaccggccatgaccactggcttccctaattcctggttggcttgggctttagagagccatgcactgagacagcagtcatgcaaaagccagtctagggatgggacatttgaccagggagtgacacagagcttcccgagccattggtaaacgaggggctcttgcttctctccagctactccctgtgaaaggctgctgtgtccctcatgagttcacagtggctaaagtgttgtggcagtggaggagaaagagagtgggttacctggaggcagcagtggctccacgtcccgtgagcaggttcatcaggagtcacaccaaagtgttcctgtttcctttatttttactttctatcttgatttttttcaattgtctttatcccagaaaaattgaaactgcgcttggtttttcacaagttacactgctttttcatttattctccatggctctgtcctgtttgcaacaggaacaaatccttccacccgcccactctgggaggtgggtgctcatacacccatgtcctcctgagaccctcctggccctccacatttcactcggcattctgggtctttcacaagtagagtaggcagcaaaagaactgtgtgggctctcgatggcaactgacacccagacaattggcaaaaagctgctgagtcctggatacctgagcaggatggaattaaagagaagcaaacgtccctgctccaatggaggcaactgacttaggggactggggaaaaggtgtgagagagacaaaggggagtccctaacaatgaacacagaacagaaagaacgccaccgagtctgaagtgggaggcagcccagagggactcagagggacaggagtgtgggtgggtgttccctggatgtttcctgaaggggtggaacctgcacttctatggactaagagctaagatgagcctcctggcccttatcacatggcccatctagggacatcaggctctctgtaccaactttatccccactttgctccaattttgtcatgcaacagggggagcgtggagcagctggagaacagggaccagatggccccaaggtatgtgcctctccctcctggagtcacagcgtgaagcggctggtaaatcaaaaaagcatctgagacaggtctcaattaatatttagaagtttattttgccaaggttaagggcacgtgcccaagagacaggtctgtgccttttgccaaagatgattttgagggcttcaatatttaaaggggaaaagcaggctggaggggaaagaggaagggtatggtaatccacacactgcaagggaaaaggagcaagtagcggaatagttgattatgtattagtctcacgctcagtaaatcggcactttatgtaagctgtggtgaacatggagcagctacctgtggggatatttaaccttttatctgtagctgtctgattaggaacaaaaggaaaggcagcttcttgcatgactcagctttcagctgaactttttttcttttggcagagtgaactggggtcccaagtttttatgtccctttcacaggcttgaccttggggtcttgacgaggcaggaggggaagagcattctggccctcaggtgggaggtctgactggcagcacaggtggacccaatcttcccaggtcggcctagcccagacttctcacatggagtcttctcgatttgttctgcaatccccgagcatcctctgagagtgttcagaatccccagggccccgctggctgttctgggtccacccatgtgcagctaggtgcagccagtgtgggctgatagagagcaggccacagttgccctcccggccctcccggtccaggccgtgggttgagatctcatttgccttccagggctccaagggagaaccagggaaaggagagatggtggattacaatggaaacatcaatgaggctctccaggtgagcagggtccagcccagaggccaagatcctcatggatctcaggctctgcaccatgccctgatcagggggcccttccacacagccgagtaggggccctgccctcaggccctcaggcagcgcttccaggagagctgcttcctcgctttctctcctttgacctcccgctgtgtagcctcctgggaaatggccccattactggcatccaggtggccggggctctctgtctgggcccagctggccagttatcctgcctcagggcccctgagtgccatagtggaattatcctggcaccccacaagttacggcccatgcagggtgctggggccccatttctttaatgcatgtataaccccctttcatgcagcagcaaatcttcctggaacgcatctcctttcgtgtcagtttaaccctgtttcaagttcatgagctcccgctccccaccctttaaagcagggtttcccagccttggcactgacttttggggctagagaatctttgtggtggggggagagtcggtcctgtgtgttgtaggatgtgcagcagcgtccccagtctctacctgctagatgccagtagcacccgagcctcagctgtgacaaccaaactatgtctccagacatgaccagttatcccttgggggaagaaattgcccctgctcaagaaccacttcttcaaaggagtctgtgtccgtatgtgactccatttacaaggtgtaaaatcctcttttaaagccaacaatcatctccctgatctattttttgagtggttccatattttgctatattgtgtctgtttaaagggaggtgcgtggcaactttgaaatctgggttctgggagaagaggaaagaacaagggagggtcctcagaaggtgactagaaagaataagaggtggtgcttccttcccttcagtaaagtgaagtaaaggttgcagtccatttagggtgtgcctgagtccattgtaggacggcctcagagtataatcatgcttaggagatgctacgtattctctctccagtgattacaaacctcagcgagaggtggggtgggggtggtgtgagtctgggggccatggagcccacctgcaagcgtctccctccacccacgctcctttgaggggcctagctcccatgtttccatgactgtgcagtgagaaccttccacttggctcttggtttgctcttcaactgattgcctggtgttggttttttaggagatccggacgctggccttgatggtaagttttgctcctcctggctttccttgggcactggacgggggggctggggatggcagcctggaagcaaggatttgatttctcccctccagaaagcaggtactgggctgcagattagggttgacccaacagggctggggcagatgatgatctgagctggaggtgatgagtcaggactggtaggtgggcctcgagagctgcccgtgccctgggtcatgggtgtcctctgtgtaaaggctcttcaccaatacagctgtgctctctggtgacaatacaaatgctggattctatttacagctgcgtgaaggaaatagcagtactgaggaggatgtttttaatgtttctcttttttcccaacttttagctaattaaatcctgaaaaactagtagcaacctaccacgtatccccctttcctggaaatcagtttcattatctgcacttggaaaaccagggaatttcaagtctgggttttgtacaggtgcctaccggtgacaggctcttggtaaatatttgtagttaaaatgactaccaccaagtttaacttctaaggtagaggatgggaggagagatcatgaagttctctgactactgaaatttcaattcacctaatattttttcatggctgtgagccacagaacacacttagggatggcacaaactcacaatcaaacaccacttctgtgacgtcccaatcccagaaattgctatcaacgacatggttctggaatcaatgagcttcatttggagacattaaaatatattatttggcagggcacagtggcttatgcctgtaatcccagcactttgagacactgaggtgggcagatcgcttgaggtcaggagttcaagaccagcttggccaacatggtgtctctactaaaaatacaaaagttagccaggcatggtggcgggtgcctataatcccagctactcagtaggctgaggaacgagaatcacttgaacccgggaggcggaggttgcagtgagtcgagactgcaccactgcactccagcctgggtgacagagtgagactctgtcttaataataataatgtgaaatagctattggaaataaaaccttcccagaaacattttttttcctttaaaatcaaccttgaggtgtaacttacacataagaaaaggtactcattttaggtgtagagtttgatgagttttgataagtgtatatacccaagtatcaaccacccaatcactctagaaagtttcttcatgcaccttgggagacactcccagccccaggccaccactgctctgcgtcacttctgtcactgtagattaggtgtgtcttttgtctcttctagagcttcatgtaaatggaattaaacagtatctgtgcctggatgcttctgctcagcagaatgtgtttgagatgcacccttgtcatcagcacttggttctttttccctgctgagtagtatttcattgtatggatgtaccatgcattcccctgttgatgggcatttgggttgttttctggagatatttttaagtcattattggggaaggtcagacttagcttcttggagcccaaagggcgaccagagatgccctagagagaaggagagggtattggacatggctctccgaaccccacctccacttcaacccagtcacacttggtgcttatatgttttgcattttgggttccccatgttattttctttgcaaaaaatgcatctctatcactggagaaaggtctgtaaacaacttatctgtacaagccagcctccacatatagccctcagggcacaggctaccctcctccatgggacagttcttccatgtgtctttcctttctctcctaggggcctcctggtcttcctgggcaaattggcccacctggagctccagggattccaggccagaaggtaaatcttatcttgacaaagggggtgaagactttgcaagggcatcgaccccagggcttcccctccccctgtgaccctctcatcttcccagcactaccaccataccctcctgctgctccaaggcaccaggggacccgcccacccacctcccagctgctgtggctcttctagccaacccttgccatctgcttgggctcctgtaattcacagagccttctgatgctgtggggcctgggtctagacacacccctgcccttgccccaaccagacccacagcgggagtgaggaccccatcagggacctcggcatctgagcccctccccaatcctcccacctcactccctgcccttgctttccttttacactccacacacctgtgtttttctcagaaggtctgcccctctgtctcccactcatgaggtcctctcccctgcaagtctttttccatcttacctttctttcaaagcccttctcatctttcaagcccaattcaatagaccacctcctccttgaagcctccctgatctatcaggcagaattccctgccctttcctctgcttctctgggtaggacctacatcattttgccacctcccttaactccccacctgacccaaagaaggggcttggtttgtgtgaagatgaaaggagcaccctgtggagagccagggcaggggttctgcattcaggggagacaggaaggcaagaacccttctgcaagggagccaagggcgcctagggctcccagaggcagcagtgggaggttgtggctaaaacatggacatggagccagagcgcccagactgggatcctggctcctcagttcactaactgtgggcctcaggcacacaactctgtgctttggagtcctgtctgtagaagagaggcaatgcaaattcatacctcccagcaacacagttagaattaaatgagcaaactctatgggaaagtgtggagtgggatgccgggtgcactaagcaatgcgtaactgatggctgctatgttctctgccctgagagtcacctttagttgttccggttacagggggagattggactgccaggccctccaggacacgatggggaaaaggtatgaacagacgtcctctggtcaaacctctgaagacagtcttggccctgggggcaggaggtcgggcaggaaggctctagaattggccctggtgtgagcccagtgggcaagggaaggggagatgggggggggcagggagaggggcccaccctgcaagccccaggaggagccaggcagacccaggctgggctgtctctgcctgccccagacaagcaccaaagagccaaggcctttggacttttctactctctctccctctctcctcttttctccattaatgtgtctaagaagcgtttttggtattttctaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggtgagtggcagggctggctgcccttccgtgcatacaccactcccaagcatgacgccagctttgcagggctttgcactttgcatgatgtgagctgctgcctgggctagaaacctggggccagggcttaggggtggaggattcactcagcttcccctcaagtcactcactttatgaaggccagtttcccgactcaggagacctgagttgtgctctgtcatctgtatccttgggaaagccactcactgttgcagagtctccgtctcctcatctctaaactggcgataataatgttttccctggatacctcactggattgttgggaaagagatgaagacatggtttagagctgcctctttggaaagtgtacagaagccctatacccgggagaggctgcatgtacagaaacggggccttcgcccagtccactaggctgctaacttgacttaggggccttctctgggtctcaggggtttccatctgtgaaatgggtgccatcctagacacctacccttggagcaagggagccacatcctgtgcaggccacagttggtcacactcagcaagaccaccttgagctccactaacagaaatcattgtcagtctgtagggtctagatggcccaactggggagaggagaacatggtggccagagcagacccagagtggcaggattgcctaatccagctgggctcctgaggtttacagtgaagccagagggctgggtgtcaaggttgcctgcaggcagccacagatgagggtcctcctgggggccaccagcctagtgggtgcctgacactgtgacgaggctgccctaatcccaagcctgccgacccagcctgggagcaggcagggagggtcctcttaacaagcagctacttcatttgagtgtaaacaggagttgcatcttccttggctcacggtatgatggcctctaggagcaccaacctagttcgacggtgctagaatcttggtctcagaattctcctctaggaagtggaaagagcctcagaggtcaaccagtcccaagtctgacccagtgcaggactcctcactcaaccggcacaggcaggcagctcactgcctccagacctgtccactgcaccatggggcagccccaggatggagggagcattcctggatatggtgtggaagctcccttgtcagcctccccgagttgacccctcagagcctctggcctctggagccatatttattatctattgctgcataactaatcactgcaaacgtagcggcctaagaaaatacacacttattggcacatagtttctgtgggtcaggaattcaggcacatcctagttgggtcctctgcccatggtctcatgaggctgcaattaatgtctcagccaactgtattctcatctggagctagggatccccttccaagctactggtattggcagaatccagttccttgctggaacagaactcagctcctagaggccacctacagttcctgccacctgcgcccctgccctccccacctcccgcagagtagacagttcacattatagcaactggcatcttcaaggacaaggccagcagtagggtctctctagtgtctagtgctagcaagacagagctgtgtgcacgtgtgtttgtgtgttcatgtaacatatttgtaacataatcttaatatatgttatatgtcaccatctgtatgacatgtatgttataatctgcaacataatcatagaagtgaggtcccaccacctttgccatgtgccttactccacggctaagaaacaagtcacaggtcaccctaaggcctgtacgctgcagagtccacagagagtatcagcctctcctcccctgtactagagcctcagattctgtcctgcaggctgacacctccacatcctccatggtgttccttgttgacccctagaccagtcacgtcccagtctagtttgtcacagatgtgagggtgcgtctgtcccaggctttcacaagggctggcattcatgcagtggtgttttgtgcccacagggagagaaaggagaagccggggagaagggcaatccaggagcagaggtacatgagagataatttgacagagactcatcaagcgacagtctctgcagcatgcacagtatttctgtgctttagaatgaagcttgcaactgcctgatgtttacgtttactgagcaccaccataggtcaggcactgatcctctggactgctccagtcttcccaaaccacatctctcagcaaccttcacagagcacctcccatgcttccatcctggtgctagagtctggagatacgaaaataaacagaacttgccgggcacggtggctcacgcctgtaatcctagcaatttgggaggctgaggcaggcggatcacctgaggtcgggagtttgagaccagcctggccaatatggtgaaaccccatctctactaaaaatacaaaattagccaggagtggtggcaggtgcctataatcccagctattcgggaggctgaggcaggagaatcacgtgaacccaggaggcagaggttacagtgagccaggattgtgccactgcactccagcctgggcaacagagtgagactctgcctcaaaaaaaaaaaaaaaaaaaaaaaaaaaaaaaacagaaccatccctccacagctcacaataccccataatgggcactagcatgggagcaactcagggaatcgggcaagcatcccaaaagactttctatttgggcagagtcttgacggctttgtaggagtttgccacaaagtttcagaggtaggctttccagatagaggcattattcttttgagaagtgtggtgaaaggaagagaaaacagaatggctgagtgagaatagtcaggatggaggcaaggttttcaaaagacagcagagaatcaggcatatttgcgggctcaggggcaagaacccggaaagcaacggagatcaaggatgcgtgagagacaggatgtttggtggcggggtctgggcaacccaaatagcacctcagacccatgggagagaccaccaagccttctcagtccccatcagggtgggttcaccttgccaagccccgtctgaatgtagtgaaacaggcctgattgtacaatgtgtatggtacttgtttcgaaatggatagcctcctaaagaaatgatcctaattcaggaaaagcattatacgcacattgtccctccaagaagtatttaaaataaacattagaaacactctaaattttatcaagaaggaaaggattaaataacttatagtaataatactaatagtaataatagtcaccacgtctgagcacttccctcgtgccaagcaccgcactaagccctgggtatgtaacaactcattttcactccacccagtgaatagcacagcaccgttaccaggaagctggtggcgaacatataaaaaatggaaacatcagtttcacagtaagtgaaaaagagttgaaaacgaaattttatacatatatgaaatcataagcatatacatatatgtatatacaattctacacatattatatgtaaatatcaaaagtatatacatatattcaagcacatctgatacatcaagaaaatgtttaaattttctctttaaagaaaattttaaaaattctttttattctttttattatttttaaaattaccacccaggtaaaattgacttcttctggaatgtgtccagttctgtgaatgttaatgcatgtagagatttgtataaccaataccatgattaggatacataaaccacttacttataataagaattaaaatggtaaacttttgttaaaaatgggaagctttttttaagaaggcagagtttccaaagactgtgttccctccaaggagactgtgatggagcgacaaagtccacaggtccaggaaacaatagggacctcctgtctgcccagtgtaggggtgccctctgtcgtggcctggcacaggagtcactcccctggccatgctccagggaattctacccctgggaagacgaggcacctgaggagagccctgaagccgaggcggggtgagcagctcagaaggacccagcagtggctgcctgtggatgaaaggatgtgtgtgttcatcagagacagaagctgcaatgggcaccaccctctgtagaggaggcagccctgagctcctccatcttcactgtccagtcagaatctcctctagcacaatctgcatctgctctcaagggaaacagagaccagcagtccccatcctgtctgtaacaaaccttggggacttgaggagcaatctccaggaacagctcagtctccccacattccagataaccaatctctgcttctctaagccaagggtctcaaactcaaatgtctacaagggtcaggcctgcaaaaagtgactgcaagagcgctggatcaaagacaataaggagtggtgaggactggggtaaactgaaggtgtcatgccccacctagaggggaaagctctaattccactccaggctgttgttgccatgcatgaacaagaacctagtgctgctagatcttctggtgttttttttgtttttttttttccaagaaaaatctggaagaatagatctttagggacagttcctggaaatttgctttttcaacattgagcagtccaccgggttgctatgagtttttgacctgttctgagccttttttgggggatactgtgctgggcagtcactggctgacctccagtgggcagccatgtcctcctctggccttgcagtctccagctgggctctaggccctatcaggagggagggccacttcaaatgtaacagggctcccctttggcttttaggttcctgggctgccagggccagaggggcctcccggacctccggtaagtttggagggcttgtcagtggccagtccactaatgtcccctctccacagcagtcactgggctcaacctcagccttagtcactatcacctcttcctcccagggagggattttctggtctacaaacccctccccgctccttttccctcccatgttaaacagcaccatactggggacaccaaggagcccaggcattgcctggtttcctggaaatagctgactggtagggcagccccagggtcccttgtctctaagctctgcccaacatttacctcaccctttgccatcaaacatctgcttctcccattcctcatttgaaagtgactcaccggtctggcacagtggctcacgcccgtgataccaatctggcactctgggaggctgaggcaggtggatcgcttgagtccggaagtttgagaccagcctgggcaacataatgaaaccctgtctcttctaaaaatacaaaaaattagctgggcgtggtggcacacatctgtaatcccagctactcaagaggctaaggtgggagaatcacctgggccccagagatcgaggctgcagtgagccaagatggcaccactgcactccaacctgggcaaccagagtgagaccctgtctcaaaaaaaaagaaaaagagagaaagagagggaggagggagggagggagggagtgagggaagggagggagggagggagggaaggagggaagggaggaaggaaggaaggaaggaaggaaagaaggaaggaaggaaggaaggaaggaaggaaggaaggaaggaaggaaggaaaggaaaggaaggaaggaagggcgagccccagccccactggattggctttccttggctacagaaatgtaaccatggggcccctgtgcatcacccctagagggcccccaagcaccctgaagcaacagatgctggcccatgcctctgtgtggttcatggtccccaaggcactgtgtgtcctctgttgtggatggtagaagtagcagtaggaataatgataggagccagcgtttattgaaacttattggatgctagacactgttccaagcactttgcctgtattaatttaatgtttgctgtgttacctccgtgtctttctttcatgagactctgggtcaaccatgaggaccacagagagattttctgtgagccctggctggaaaagactggctcagactattccctaggaagccccaagcatgacccccacttagcatttctttctacctctcatgggcagggaccccaaaccatactctgcacccaaaacccttgttcttctgtgatccatttgtggactaggcagttgtgttaactagagatgcagttctaatgcaccttgctttattccaaatgcaggggctccaaggtgttcctggaccaaaggtaaggagaagtcacatgacaggcgctgtgtcagtgctagtagaaaagagggaaagtgcacctgagaccagctgaccctttttcctagaaggcattaggtgacactccagccaagggggtccagtcagggcaggaggaagtcctagattccctttagcatccatcattgacacctggtgtgctttggcttcagaagcttcccatctgtcaccccacaaagggacaggttagattcttagccaatggttaaaatccttttcccatcaaacctgccctggccccttcactcatgccgagtagaggtgggagagagacagcaacatagggtgggacccctccctgggtcaagcttggggggactctgcactgggctctcccggcctcccctgaaccatttcaaatggatgagggggctgggggctgttgatgtgacaatggccctttcctcatgccctggtattcaagagacttcggggcagtttgttctcccgactaggctgtgagcctcagggctctggaggtagcatctcaggcatctgagcaaatctctgtaaggttcccattctcctgccatgcagttgggcacctgtgccaaggcctgacctgtgggtttgtccccaggccacctagtccttttctctgtggggctctcaaagctcccacaggatacaggggctactaactgaggcgagagtaggctaagaattcagggattcttggtatcctcagcctgccaccctgacccctccttcctctacaaatgccaccccagcctccaggaccccagaatgcaagaatgaattgtctgggacatgtccttgtgtgatctcgtcccctctccctttcctccagggggaagcaggactagatggagcaaaaggagagaaaggcttccagggagaaaaaggagaccgtggtcccctgggactacccgtaagtaccttggacccagcaagactggtgggtttgatgggccaggggtgtgggctgggactgggggacagccagcggaaagctaaggttctagagtctgagcatccagagttccatgtggtttgtctttcccacctgggcaagaccacaggctctgattctcttcctcctctgggcccaggccccaccttggtgctggggaaaggcaatgctgaagaagacaggctcccccaccccaaggggcactgagctgggagggcagcttcaggccctgcttgagcctggttcagaagcaatcaaagcctgctgcctttacggggccaagcttggagggtttggaagtagtgggacaagaagatagtctccattacagtccattttcccagagggaccccaagagaactcttgctcccccctcttaagcactggtcattgcagaaaggcacagacaaagtcagactttgtggtcccagcaggccaaggccgttcatctcctgggttcgtggagatctctgatctcagcctgcccagagccagaagccccaggtcagaggtggggagctgctcagaaggtgttcacatgtcatgatatggggctgggctggatagggctgatggcctcttcactgcctcacctgtgtacaggtgagcgcatcccaccaccctccctggagcccgggctccatgccccctaaccctccactgaggttggcattcttccaagagctggaagggatgttagcgatccatcccatcatttcactgatggtcccagagaagaaagtgggtcactggaggtcacatacaaagttggtggccaagccagaggctgatctgaggccatggccttgcaaagcgactccttccagccactcaggcttcctctgtcctgggctcaaggccagttcccaccccaggtagccataaagagcagagaaacaatggaaagcccagttacccccgcttggcagagcttgaaggcctggttaatacaatcacagcaaccaaacagcaaatgcaggaggtataattataccctcatgaatgcattcgaggtaggaatatttaagaagccaatctgcttgacagactacagaaaactgatgactttagcaggcattttcccatgtcttaagctgtgtctggaatgattaagtgctccttactattaaagagccttcctgccccactcaaccacaaacctcttcttatccacattcatggccccaacgaccttgatgaacactcgagaattcagtcaggggttgaaatgcaaaaggcacagcgaccaaacaggtaatattaatataaacaaggaaagtgccagatgaaagacaaagtacctactctatcattaattttctcacttttgatagaggcatgggtacagagaagtatttttttttagtttaagtaaacaacagaacaagcattcatatgagacaactgacacaaacctgagggagacactagggagtggaggggactgtggtgcactagagaccgtgtatcccttcttaaggggaaccgtcccttctcagctcagctgactgttgccttggaggaaggcggagctggtatttctggatcttcctatttttcaaaggaagttaaacatctggtgttttatgtgaaatctttccattttctaatattagatcaaaattatttgcaacactgcagaccataaaaaatatgtcagtggcccacatatggcctgaaagcctctaatttgtgctttctgctccagacctctcaagacaactgagttttaatgctgcatttttttaaagtacatggatatttagctaccattctgtttccaggtttcacctggatgttttattctatgtagtagcagcctgcttctccaggcatatcctggagtgttcccccatttgccctgcagaagcaattctcaatgctggctgcacactggaatcccctgagagcttttcaaactcaccatcaccccgggcttcactcttggagattttgaattgcatcgggctgggatggggtgggacccaggcatctgttttatttaacattgcccccaagagattctaatgtgctgccagggctgagaaccacagctctctagcccagtgagtcaaggtcggtcccagaatcgtgtggtcctaaatctgagaagagtccctgcagagtccttctacccaacaccttttccatgaagcagcagctcgttgcctccttcttgggacttccttttcatttgaaattctgaggctgaggctcagttggaagcagttttcaagcactcagtccttaccaggccagagtattgccgctgccttctccctgacttgtcacattggaatcattagaaaagggtccctgggttttcctgggtgggtttcagaggcagcttcataacccagggttggaacaggagtgccaccccacccccgacccaccaaccttgtatttcactggacaagagcaagtaagggtgctgatagcaggttggtctcagtagcttcccacctgctgcccatttgctctgggaaatacatggccttagacctctgtcccaggccgctgcctccaaagcctttgcctacacaagagcccttgtctgggagcatatgaatggatcgagtttaggttgagcatctcagactgtaaagtgccagcgaaatgtcaggcatcatttgtaatatcatctaagagccaactcattcccccagggtgaaggataagcagaacaactcctacccagatttcacaactgggtgctgtcacccagggctgagaccctcaggggcaccccagcatggcctgatccaaacaggaatgcaaagaggctgggagagccgtcctcacctggggcccctccccagtgaaacctgtcctgggaagggtgcacagctctgattccaagacatctctctaagcattcctttctgtatccctttccccataacactgaagggagaggggtttctgagagggaataaagggagagaggagaaggggggcgggaggagcaggtggccatctgcgccgacctccacccagcctgctcagcagccagccactgcattcagtgtctccatgttttcgttggtttccatgtaaataccattccgtgtcctcccaagcttatttctccagttgtgtttgattaccagcatttatgtctgtccagagtcactgctttactcacctcttccctccccattgttccctttttctccctcccaatcctctcttccccttcttttggtcaaactgtgcccttcgtccagggagcttcaggtttggacggcaggcctgggccaccggtgagtgtcacttctccatcacccctcaccccactccactccacacctggcctgtgatcccttttgtctgtcccactgtggcctcattttcccagtgaatcatgcctggtcccacctccgacaccagaaaggtgccactgatgctctgaagtgccttttctggcctcttgaccaaatatggctggccttcatctgaatgcccctgtccacagaatacacccagggacctcaaacctgccaggtgtggggtgggaggccactccagcagcaccgctcctgattccacaggaatgctgagtccagcctgggtgcccagccctggaggtttgagccatggcctctccccaccaaacacaccagtgtctgtgtgtgcccgtcatgctgtgttgtcttcatgctgtgagctctgtccatctcctgtcttcccacgagggcctcctagtcttgtgcagccaccagtctggtatatgtggggtaggacagctttgaaggctgaggacaggagtagcctgcagaagcatagaagccagtcccagctctgtgtcttatgcacgttctaaccacccttgcactgcctatgacagcacagtcgccctgcaacccaacatggcagttcactacagagcaagtgaggcacacttgggtcctctcttcctccattctttctgattccagaaaacaggcatcatttactattgactagaaagcacctggcccttctgcttatgactaacaactgaaggatcagaggaaaattccctcctgtccacctccggtccctcccgtgagcgccctctgaggtcaaccttcccagggtattgagctcactcgccctcaagtctcgagtccctgctcggacaccatcacgagagctctgtgcacccagccccttccagccagggaggccctgctctgtcctgcagagggctttcaaggccacatctgcccatggcctgcatggagttctagttagctggctggagccaccctcaggggaggcgagaccttgccagggttcatgtgtgcagcgtaggggacacactgaagcacaggctcacaggtcttcccaggtggccgggggcacttgcaaccggcaccaagagaagcccagagcttttagaggtaggagggtcaagatagacctctgtgagagccccatcctactgaatgcctattctgtgccctcataaataggagatgacatggcttgcccaagatgacagacttcttcagagccccccacctccctgcactgatggagttcacactgtaaacccttacatgcagagagcatgccctggcttccaggagttattatggctttgctccttcgccacagtccctccctctccatccttccccacctagcaaacctgtctcaggtgcgggcagggctcggggatgatctgtggttgcaatcagagaaaccaagactttcctctcaatggcttctcccttttatgttagaccgagggaagcagtacaaattcatacactctgtcccttaggaactgagtctttattttcctcataaaatcagtatcctaactttaagggaaaatgtggggaaaaaaaataagccttccctgccaatattaacatttattgagcacttcctacgcgtcaggctcagcaccaaatgcttgctacgcattcatgcatggaaacctggcacggtcaaggaggcagacacacgtggtacagacggggaaaccgacactcggcaaggctaaggagcttctccaatacccaggagtttgtaggcctccgaggcaaggccagccacatgactccgtggcgctgtgcccaaccactggcccgagctgactccttattgtttttgagacagagtctcgctctgtcacccaggctggagtgcagtggcgcaatcttggctcactgcaacctccacctccgggtttcaagcgattctcctgcctcagcctcccgagtagctgggattacaggcacccaccaccatgccggactaaatgttgtatttttagtagagttggggtttcgccatgttggccagaccggtcttgaactcctgacctcaggtgatccacccgcctcggcctcccaaagtgctgggattacagccgtgagccactgcgcccagcctcctttttctttctgctgtgctattatggatgcctgcagccttccttccctccttgtggttgcaaaggggggccctgaggacatcttactcccctctttgtctcacgtgaagtaagtcatgccccgccattcacagatacattcagagcacaggaaactgtccacagcccaagtcaactcctcctgtcctcatctgaggccaacaacaggagacgctgaactagagacttggtctggccaggctgtgaactgggaacgtgggaagatgttggaggaggccagagcaagccctgatgctccatgtctaagccgtgagctccaatggctccagcgcccccagccccgggctagcagagctcatgacacgcctccctgccaggccggtgtcggtgcagacattgaggcaccctaattcaccccccgatccagccagttccgcaggcctgtgagtggggcgagaaggccccggccagagactgaggccagggctgtgggtctgcggtgggccggtggggtgggtgttggctgaacaaccctctctcgtctgcccctgtgtgtgcatccgcatccatctctgtggcatgaagaccctcccgctgcatgtggagctgcaaagcaaagagggtgccagcccccggcccctgccccgggatgggtccactccctcccaagtgcttctgggagcaaaactaagcaaccattctcccattgttttcagccttggcaagcttggttgtgaagcaaaagggtttcagtccacaaatctggctctgaggcatggggaggtgctctctccccaacagcccctgaacccaaagaggatcacggcccagtcgaatgactgccctgaacgagcctggcctcgccaactctgaaaactgggccttggaccttgctcatctctaggcatcaggtggggcacccagggctccccagagtgtggggaccctcacctctgctttctttccccttcccagggtactccaggaccaattggagttccaggcccagcgggaccaaagggcgagagggtgagtgtcactgagccaggggcctgggcggccaggagggagaggcatgcctgggacccaacaccaggggtctcagccctcatgccttccttcttccatctcttctcctggtcatcctcacagcagcctgggacagggggtgctggttgtgtagctatgagttgacaagacttggagggatcaaggagatggagaggccgggcacgttggctcatacctgtaatcccaacactctgggaggccaggttgggaggatcacttgagctcaggagtctgagaccagcctggacaacatagcgcaacccagactctacaaaaaatttttttaaaattagccaggcatgatggtgcacacctctagtcctagctacttgggaggctgaggcaggaggatcagttgagcccaggaagtggaggctgcagtgaaccattattatattactgcactccagcctaggagacagagcaagaccttatctctataaaaaaaaaaatgaaaaagaaaaagaaagaaagaaagaaaaagaaaaagaaaaaagaggaaaagaaaaaaaaaggaattggagaacttcctccactttggcttctggccaccttgtgtccatctcaggttcagtttggcaaggccctgggcgccattgtcactggacatgcctaaactttgtaatgatttagggaaactgcatggaacagagggccaggtggtgtttagataattcctcgaggacagcaggaagtcaggaggccagagccataggccaggctcccacggtcgctgtcgatggacgttggccatgtcacaggacttgcagttcctggcctgtcctgctggaatgggcatgtccgagggtgagggtggagggtgtcagctgagtggaggcaggggagctgtgtctttctatatcagctcttcccagccagcccctgggttctacacactcagggctcggaggtccctgtgtgggcatccgtcgagttctctgcctgtgtgggcagctccctgcactccccatccgcccaccttgctggctctgtctcaggtggggagggcaggagcttctgcagagggcacaagcttctccgtgaccaccagcttggggaaaccaggaggctgctctgagaggtgacccttgaggctctggagaagaaagcaaagctctctttctcttccctttctctttccctgccttcctgccctgctttcttcgcccctgtttcagcctcaggccagccaggcccaggacaccacgggtcattctgggaggccttgggggataggctctgctggagggagagtgaggggggcttctgagccccctccccaaggcagtgttcgcatcagcagcaccccacctttcccatagcccttgcttcccggagggctcttgaggggactggagaggtttcctgtatttcataccaaagtagaaaatggcaaggaagattgttaccgtgtctggcaggattcatgcatttctttctcccatttcagggcagcaaaggagaccctgggatgacaggaccaacgggagcagctgggcttcctgtgagtctcttgggatcagaggttcctctcctcccacccctgcccccattagaaatacccacggccggccgggcatggtggctcacacctgtaatcccagcactttgggaggccgaggcgggcgcatcacgaggtcaggagatcaagactatcctggccaacacggtgaaaccccgtctttactaaaaatacaaaacttagccacgtgtggtggtgcgcacctgtatcccagctactcgggaggctgaggcaggagaatctcttgaacccaggaggtggaggttgcagtgagccgagatcgcaccactgcactccagcctgggtgacagagcgagactccatctcaaaaaaacgaacacacaaaccaaaaaaaaaaaaaaaaatcacctagggcctggagcacaaatccagggccaagggagaactctcatttccatgacagacaaagctgccaagaggcaactggtgataggctagcatgccctgctgggcattgcgctgtgagaggaccagggcctctgccatggggaccctgtaatgggatgtagcccctcccactgtgttaagtgcagcctgccctcagcaatgtgtgcgccatggcccctgccctcagaaggggcagaatcaaatccagacccctgtgataggagaggcttcatgagcggagcagctgggccttgcaggggacacctggctttccatcacggcatgctttcccaccactgtgttacagaagttgagtgtctgcctgagagagcccgcactttagtttcccatccactggaggctgtgtgtgttggccaggtacgcacatctgggccaggcttgtctcatgctaaattcccctagctgtagaatgaagagcattttgcaccttgaaaagagggtctagcaagagcctggcaggagagccttgggaactcccctctgcctagagcattcctggcccccacaagcgcatcctcagaactgacccctcacctgcggtagtgacctcgggaaaacccagccacaggccaggacctgggctggagaggtgagaaaaccagaactgtgtttttttgttttttgttttttgttttgagacggagtctcactctgtcgccaggctggagtgcagtggcatgatctcggctcactgcaacctcagcctcccaggttcaagcgattctcctgcctcagcctccagcgtagctcagactacaggtgcccaccaccacggccagctgatatttttgtatttttcatagagacgggctttcacctcgttggccaggatggtttcgatctctggacctcgtgatccgcccacctcggcctcccaaagtgctgggattacaggcgtgagccaccgtgcccagcctgaagtgtgttcttggctttgcccagaactcatcatttgcctctaggtcaggttttcttagcgatttgcttctctgtcccctttccgtgtagtgggaataactaaacctgtctccagtgagtgaggcattgggagagtttgatgagcctggaagaaagcactgtacagctggcctgtgtgtcctcattaacatgcctttcttcctctgatctcttgcagggtttacatggaccacccggggacaagggaaaccgggtgagtctgagcccctgcactcgtgctctagttactaatgtcttcatgatggggtggaatgatcgatcggtgattcctgaccaacatggcgaacagtttttcctgataagtcatcctaaattgaaaggctttacaaggagggccttaacctgtggcatgtagggagcctggggcctgatcctcacatggaagcctgtatttttccacacagcaaggagagactgaatcccatggcagccaccagcttagcattgctatccagcaacaagatccatgtgtccagctctttctaggttgccctgattgtgggcccctacgtgatcattttagatccattgctaccttgtccttgccctctgaaacttggttttgccaggcattccaggccactggtgagagagaaaataaattccagctccaagaacaagcagacagttgttggaagcagccaacccttttaaaaaatattacagccactatttctcttggaaagagtcggcagggctctgaaaggactgcgccttctcagacccttgctgtccctttggtttctgccatcttcaccaggacacacttaccaaatgcccatggcacccacagccacataacagggggtggcaccgaccacagccttcagcatttgggcccagcagggagaatttaactacatctgaccaagagatggcctttgggttcccctctggagggtctcatctgctgctgcatcatggggcttcctggagtggggggcacaccccctagaaaccaagtgtgtctcctagcgggtcctaaaatccaaggcgcttagaggagaaggaacagatggagaaacaaggcccagacaatgattatgtgttctgggatcccatggagagttagaggaagagcacacggtctccagaacccaggtcttgtggctgatctttgcacactgataccatgttcatgcacagaaagtgccagaatgcctatgctcctatctggcaacagtgaattccatctcttcaactcaagatctatttactgagcactcccattttcctaagtgctcttcactggcagctggtcaaaagcaactcagtttgtcccgcatcttctataaacaagagggagcagcagcgccacccctgcccatggcaagaccaggtctggaaactgccggaataaacagacctgcttccagatgctctaagcacgctgggaaggactttcctcagtgtggcatcaaaggatttaggcctctaaaatctttgatcattccacctcttcattggcatactaacttcctttcaaatgtctttctgacatgttctagttttctttattatattcaattagtattttctaaacctccttcttcagactttttcagttggctggagacactgagccgtttgaaggctgcaaaatcggtccttcaagggacggtgaccatgttgctctagaggtggaggcaggacaagtacccttgtcacagacagagggagggtgggggctggcggctctgatgctgcagcaactgaggttattgagtcatccacggaggccccaggaatcagtgggaaagtatttctattccccttccccttcccgatgtttgacacactttcctccatcccctttacaaattaggaatgtgtcacttagtaaaagtcaagttcagaaaacaatgaggtggcacgcacctttcttttgagcacaccataaagagccaattgacttattcccaaagagcaggtttccaactcaagggcagcttgtcctcttcatgccggggatttgactctcaggatgcccaaatgtcctggaagagtctcccctcaatcttgcctcccattctgacctttctttgtttcttcgagacagagtcttgctctgtcgccaggctggagtgcaatggcgcgatctcagctcattgcaaactccgcctcccgggttcaagtgatttccctgcctcagcctcctgagtagttggaactacaggcatgcgccaccacgcccggctaattttttgtattttagtagagacagggtttcaccatattggccaggctggtttcaaactcctgacctcaagtgatcctcctgcctcggctcccaaagtgctggaattacagacatgagccaccgcacctggcccagagatttgttttatcttacagtgaaccaagatacaaccttacaggtatgcttctccatgtcccatcaaaggatggtctcagagcctctttcctgttcatggaaggaaagtccttgtcatggtgggcaaaggcccggagccccagaccaggagctttctaagggacacacacgccagtggaaagaatatcctgaccttgtcactaagggtgcttccctttcccctaagtagctctgtgaatttggcccgggagccacctttagggtaagaaatcagtcaaaagataaagggtggcatgaatctggcaatataatcattcaggaaaattggatgttactgtggagctgcctgcaaaccagccagctgaaaaggtctgtgtgcatgcagtgaggctgcttctgctctctgagatgcccaactttgggggggtggggggtgcacgcatgtttgtgtgtgtgtgtgtgtgcgtgtgtttgtgtgtgcgtgtgtgtgtgtgtgtgcatgtgtttgtgtgtgcgtgtgtgtgtacgtctcacttcctaagtccgtcttgtctcctcacttcttcctcctccactatctcttttggcctcttcctttactgcttctccccccagatatgttcattccgttataatagtcccacgtccttcatcctttcccctccccctcaccagctgtcagtttatctcctccaaagtccactgttagacatttacttatgtttttaagaagcctttgccccttgactttatttgcccctttctcccttaccagctagggttccctctgtgcaatggatctcttttgtgtcactgtctgggggtgggaggcagggagaacgcaggcaacgttactactctaatagcctcaaaggacaccggatttggggcaattgcacaggttcttagaacacaactccccatagtgtccgttacctgttgtgaaagtctggaacacgccaaccctctgttacccccggggtatcctggactgggatcccccactctggcagatttgcccggcttcttcattaggaaactgctcatgacccagagaatgaggggccacactcctgagagagtttaccagggggcttccccacccaaatagctagtggttttgctggtctaccatttggggatgatttgtgccatgatgttcttgttggcagacaaaacttcaggccgatgggaatatacctaatatgtgcatacatatttaaacgcatgtcgttttctaagtaaggatttgcatttttagaaaattcatttagaataatgcactggcagttgcagaccacctctgaaatagagaaatttgagtaatttccgaagatctggaagaacatcaaaaatattattttgtttgtttgtttgtttgtttgtgagagtctcactctgtcacccaggctggagtgcagtggcacaatctcagctcactgcaacctctgcctcctgggttcaagcgattctcctgcctcagcctcccgagtagctaggattacaggctagtgccaccacaccaggctaatttttgtatttttagtagagatggggttttgccatgttggccaggctggtctcgaactcctgacctccagtgatccgcccgcctccgcctcccaaagtgctgggattacagacatgagccactgtgcccagccaaaaatattcttatcctctgccttcctctaatgaacatctaccctgcagccttccactgcaggaacagtgcacatgacaacctctgaccccaacctttggctcctatactggctaaaaagaaataatgaccattattatcattatgaagcagctatcgtttactgtgcacatactatattccattattaagcatttaatgtgcacaaagaactcacaacatttttttttcagacagggtcttgctttgttgcccaggctgaagtgtagtggtgcaatcatggttgactgctgcctcaaactcttgtccttggctcaagtgatctttctgcctcaaactcctgagtagctaggactacagggacatgccaccacacccgactaatttttttattctttgcaaaaatgaggtcttgctttattgtccaggctggcctcgaactcctggcctcaagtgaccctcctgccttggcctcccaaaatgctgggattacagacatgagccaccatgcccagcctcacaacaaatttttgaggcaggtattattgtactcattttacaggtaaagaaactaaggctcaaagaagtaacttcacaaagtcacgcagctaactgtcagaaccaactctgactgcaagcctttgttctaatacgctgcccagcattcagtgtcaccctggagtgacacagttgaagtccccaagcgttagataatcccccttccatagaggaggggagctcccaggaagactccctaggggcatactgagccccctttttaggaaacacatataaaaatgcaaatgcaaattcattacagaagtgatgcttcacttttaaaaagaattccccacagcccttctttaaatagactctgacacatacaatataggattcaatttagaaaaatgatgtttactgtagcttttcagaaacaaatgaattccttaaaccaacatattcatatacaaataacggtctgacttcagaccaggatgaaccagagacacagatagaacaggagaagccagctgagcacaaggggccatccgtgagctctggacacacacatacatatgtgcacatggacacacatgcataataaaggcacacacatgtgttcacgtgcccaagcacatacccacacacactcaaacgtgggcacacacacacatatacacaagcacatacctgtatactcatacatacatatacacacatgtgcacaagcacatatatgcatacactcatacatgctatgttcacacacatcccagggctccaagcaaaatcaccttgcctcctaatagaatgtcaaaaggataaacattaattggggaaaaaaaaagttttcaccccaaagcctttcaaaaacagactcaaagagaaggaagttggtccctagccactgtgttcagcacagacccacgctgggcttagtattagcaaaaccggccaccaaaatcttcagtctgtggttccctgcacctgcagctctgagccctctgcctgtcctcccctccccctcccacccaccttagccaaattctcaggttcctggggggtggggaggaggtgggtattgactccaaatcctactggggagaatatcctaatttaaagcatctctttttccctttttaattttatttttctttttctgtcttcaaccttaacacatgaatgatcttaaagttttgatgtttttttctcggactaaaccattatttacagggggagagggggaagaaaggctctagagggcctaaaggggataagggagaccaaggagcgcctggattagatgccccctgcccattggtatgtttttgtttatcacttgcattgttctggtttttgttcttgaggtttgtaagttggaaacaaagaaggcaaataaactaagatgagaaccaaatgtctacacggatgctaccaaaatctctctgttcatttgactggtgaaattctgcccgctgttggatttgctttgtaaccacagctgcaagtaattctggctaaatcccttgcctttgaatccttttcctttgaagatacagagcaatcgatgtgtggaagtgaggaaaccactaggaaagggattttcagggaaggcctcagctcttagctccaggatggctttggaagccagtgtagcatttgtgagccacggatttgccttcttcgtttcatggccacctctgtgggccagtagttcaagctgtctgaatcctcacttgatcaggatgcaggacaccagagttagcgtctcctcagggccactgatgctcaaaactgggcagaacaaggccagatgaggggcttctaatgcacagcctcccaacactcaccagccatccagctgaaacctttaaagctgcagaccagaactggtagtcagacagacaccccatgggaagccttctcaaaagagccagcaattaatgatgaggcacttctgctgggtttctcaagtgcctttgaatccatttgaaggttctaaaaattatgatgcactaaagttgaagtttgtctgtgtttacactaagtgagtctgtagagagaggaggatcaacggagagggggcaggttgtatgtgtgcaaagctgaactctccagagcacaaagagagcacaaaagctggatttgggagatgggggatcacctgggatttagcccctgtttgtagatgcctcaagggtcctgcatcctggccagggtaggactgggcctctctattccatggttggagctggccagccttgacctgaataatcatcgtggttggttttgtgaacagggacaccgaggttttaaaggagagaaaggggagccggggttaccagggctggacggactggatgccccatgcccattggtatggcattgcccttgcttgcctgcatggccgatttgggcttccccatgtgtgtgattcatactgggtttctccccagccaccctccacactcctcctccatcccccccaggctccacttcccacttcttcattctgtaaatgccaagggtcaccccgcctaggctagtactctgggggctcccagtcatgccaccctcttgcatgcaaagtttactgggatgtttcctggcttcctgctgcagctacctctaaagcacagccacttgatgccagccagctctcccaccctgaagttggttttggctgcctctgatactcatctccaagctgattctagacaaagctgccaccagataccagctaggaaagtggattctctggactggttttcagaaccatgactcacttcttttccttcaggcagtgaagttagttcagaatcactggctgagcacctagcgaaacatgtgaatgagatgcctgatcagccctgtatcccctgctcctccatcacatgatttgggggacagaagggcatgattacagagtagactgagaagctctagaagtgagctggaggaggggccacctgcctattcttccaggttggatcgtgggtcgctgcccaggtgacaccatcagaactaggggatggtccaggattaggttttcggatcctaaagggtttgtccttcttgcttaaatctccaaagacattaccagacccttcctcgtccctttctttcatgatcagatggcttcttactgaagagtctgggagagacggaaaggtcaagaatgtagttaaggaggaggcagggagacagctaaggacctctcttccaagcacgtcccaggcgaagtggtagcagtttattcccgcctgcccagtccctctctaggcatggacagtctaggcctccacgctgatcctcttactgcaaaagaagctgaagggaacacttcactccaaggctcaaggggttacagctctccccaaatttccccaataggtttggagttcaagagctattttatcataccagtaataagagaatttggggtctcacatccccgccctggggtcacacaggaattctctttgaacaaaagagaaaaagatacaagaaattatgctgtgtgaccctgaaaggtggtcgtagagccccttgaagggcagtagggactttttaggaggagcataggcaacaaaaggagagtgcagagcaagcaggcgggtagcatgcttcctgtccctgctggtcctgccaaaccctgcgcttgcagactgcacagccacctttctcaaccaggacttccaccatccacgcaccaatgggaatgccgctctggcccgcaggggctcccttgagcactggccaggtcttccctcagccacaatcccctcccacaatctgggcacctttagttctgccagcagctgccttggcctctctgttcctcaccatacattacttttcattctctgcctgccctgccctccatatccccctgccaccatccacacaccaatgggaatgccgctctggcccacagaggctcctctccctcccggcatccatgtgacgtgtgtcataccgcaccgtggcaggctggggaaggggcacagggtcaccctgaaactgtggaatgcacctcctccccctgcaatcccctccccaacccagaggggaaaatgaaggtcaccctgatttgactctccatgtaaaatggcattttcttccataacatcccatatcaatgtgtcaattttctattaattttactggggaagtgtcttccccttgtttctcactctgcctcctcctctgtgttattatgggcttgaggggcaggggtagctattgctcatgacttttactacaagataaccagacttcctaagccctccatattgggaccaatttctgctgaatgccaggtgatgagaggtttcagcccctggcgtgggtggatgacgtcagaccagggcagcagaggactctcattccacaagctccctcaggactgagcacttgctccgggtctcctgaagccccatgtccatctccttgtctgccctgccagtctagcagacttgggctgagaaccagacctttgcccttggcccagcctcgccttccccactgggtctctagatttctagattccccatagggtatgccagcaaggagaggatatgagggcccaagaaaactcaggaaagtttctatcaccaagggcagaacacgaacatcttgaggctaaaggagctgcatggttgctaccaacaaaggagaccgacggtgtgcagttgattcccatgtttttactgcacttcacccccaaattcccagcaaggtctaaggcttcgccaggaacccttgtcttcttgccaaaggcatgtcagggccatcctgcaatactcatgaggttgcctgtcccttcatgcccctcaccccaccccaggattaatcatcaaagaaggactgtctacatgtcctcctccctgtgcttaggaagagagacaaataagagaatgagaaggctgggaaggcccttagcggtcacatcaagcaactgtccttgccaaggttttatggaggaggaaactgaggccgccttgtgctgagtggcttacccgtgagcagccggcactccatagggccacagcagagactgtttcttcgtggcacggaaggacatctctgcttgctggtcccacgggctaggacagcccctattgacgttgcactatagctgcatgtgacctttaaccaatggtaaaatagccggatttgtttccacctccttctgaggttctgacctgtagtagagaaaagaaatagacaagcgtgggtgggccacatcctgatcagctgccaaaatgcgtgtggcccttgttacccctgtcctgcccacttggtggaccattgcaggaagtctgagccctctgccttcctttctccttgcagggcgaagatggcttaccagtccaaggctgctggaacaaggtaaggcttcccattggtgtgcactggggctccgttctcagcagtgccataaagcttccacaatttccattctgccttgctacagatgaggcagcaagacataggtcaaatagtcactgtctcaaaggcagggtgcccattaaacatcccatacactgcatgctgttaacaaacattttaaaatgcttcttagaacatcagtaaaccctaggcggaatgtccatgcagccacacaggtgacatctttatgctttgtgtgttcaatgtacatagtgtctttcccccaaggaacttccccaaggagttccagatcacactcatagagttcctctaaggtcgtttatgccacgtgatgacatgtcttagacgtaggacatctcagttgctttcactctgaactcacatgctactgtgcctcccctaggggctgtgctcctcaccactctaccactccccttgcatttaagctggcagagcttcatgccaccacacatgtgacctgcagccaaatctctcctgggctcccagagttcctaccaacaatgagttttcattgattcacactggccttggcatttgccattgttagagcagtctgacatcataggactgtgcccttgcatgtgatcgccccattcaaccatggctccccagagcacagggctgcccaggcagacagaggccatctgcttgctaactaatccagaagacccgccttggtccccagcaatggtggcagccactatgctgccccataccgtctccctccaccttgcctgtcactccaagtcttctcaccaaccccccaccaccattgtctcaaggttcatcctcataaagggaccggagactccaacatgttcaagaatctgtgctcaacgaatccagtcctgttccagtggcagcagagtcacacttacaatgagatgaacaagctcccctgtactaagatgccagaatctcactagtgcactgggttgggtaaaagtggtgaaaccaccaagaccccaggccaacgctgaccacctacctgcctggatacctaaagcaccccctaacccaagaaggaaaagctcaacactcaagagagatgcctccccagaatccatccctggaggctggcctcgtcctcctgccaagctccacttagacctagttaaagcgccacaaaagcaggtcagaggtgtcataagacctctgaacccttgacccctaaaaaaatttcctctttaaagttgctgccaatggttaggagacagaaatggttgtgcttagcaggggaagaacagccactaccaagagctgcaatgtcttggagaagcaaccagagagcttcaagactactcattcacaccttaagtccaatctgggacaatgcagtggttacaacaatcaggcctccaaaggcagcagagaaagagagtgccctctagtgaccacaaaggggattcacagagaggtgaacttggtttcctcccttcagggagctaaggtcgccaccagtttctttcacctaggggctcagggttcccacagttctcctgtccagaactcccatccaacccaggacaagatttacctcccttcctacaaaggaaataaacctctgcagacccactgaaactaacagaacattgttttgtttttgttttgcagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatggcaattc

SEQ ID NO: 36997 - DNA, 425 bp, Homo sapiens
atgcctgatccagctaagtccgctcccgccccgaagaagggctccaagaaggcggtgaccaaggcgcagaagaaggatggcaagaagcgtaaacgcagccgcaaggagagctactccgtatacgtttacaaggtgctgaagcaagtccaccccgacaccggcatctcctccaaagccatggggatcatgaattcctttgtcaacgatatcttcgagcgcatcgccggcgaggcttcccgcctggctcattacaacaagcgttcgaccatcacctccagggagatccagacagccgtgcgcctgctgctgcctggggaactggccaagcacgccgtgtccgagggcactaaggccgtcaccaagtacaccagctccaaataaatggacgcatgttcaaacccaaaggctcttttcagagccactta

SEQ ID NO: 36998 - DNA, 381 bp, Homo sapiens
atgccggagccagcgaagtccgctcccgcgcccaagaagggctcgaagaaagccgtgactaaggcgcagaagaaggacggcaggaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcaggtgaggcttcccgcctgccgcattacaacaagcgctcgaccatcacctccagggagatccagacggccgtgcgcctgctgctgcccggggagttggccaagcacgccgtgtccgagggcaccaaggccgtcaccaagtacaccagcgctaagtaa

SEQ ID NO: 36999 - DNA, 375 bp, Homo sapiens
gagactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccctttctatcaataaaaggcccttttcagggccacccta

SEQ ID NO: 37000 - DNA, 354 bp, Homo sapiens
atgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccctttctatcaacaaaaggccctttttagggccccca

SEQ ID NO: 37001 - DNA, 439 bp, Homo sapiens
atgtctgggcgtggtaagcagggaggcaaagctcgcgccaaggccaagacccgctcttctcgggccgggcttcagtttcccgtaggccgagtgcatcgcctgctccgcaaaggcaactatgcggagcgggtcggtgctggagcgccggtgtacctggcggcggtgctggagtacctgaccgccgagatcctggagctggctggcaacgcggcccgcgacaacaagaagactcgcatcatcccgcgtcacctccagctggccatccgcaacgatgaggagctcaacaagcttctgggcaaagtcaccatcgcacagggtggcgtcctgcccaacatccaggccgtgctgctgccaaagaaaactgagagccaccacaagactaagtaaagaccgagttgaaaagcgcataaaaacaaaggctcttttcagagccacttca

SEQ ID NO: 37002 - DNA, 227020 bp, Homo sapiens
gaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacaggtatgttagctggaaggcgaggtctgggacgcgagcgggttcgggtttaccgctgcagtttccgagttgaattcgcttatttcaaagcatgttaactttcagaatggaaaaagggtgtgttgcggggggggggggggaggaaataatgttttattctggaaaggattcttaaaatacaggaagccttttaaaaatgcagaagcaagtagcttttgtcattgaatagaaatcaaatagcccgctaatcacatggcactttttaaggactgtatatgcaatagatgagttcgcagaagaatgaggtgaatcatttgtggttgaatagattgactactcccgcttttggcatcctctgatatgtgtctttttggtgccatttatctgtttgctgttataatgatgcctacccaaaaataacatacagcctttagaatgagaggatacatctatgagttttaatcagtgtggtttcgttattgaaaatcgagaggaaaaatctgagattttatcgttacaagacatgagctttgcaaatgagagtaatttagatgaaaagacagcagtataggtgaatataatattttacagattaattcaatgttctttgtatttgttgcataattaggagactgttttaacagtttaaactttaaacttggtaattcctggaaagatgccaaaagcatttccattttttcaccataggtttacatatttttgttttttttttaaaagggattgaaatcattagcaaatgagtttacatctttatatagtattggaaaagctacctgttgtacatcaccaagaaacttaataagtatagttactattattgagcatttatgaagtgcaaaacattttacacatactgtctcagatcctcacaagaacggtgtttggctggtgccattaacctctagagatgagaaatctaggcatatagaggtaacacagcttcacatgtctagttaagtggtagttctgggatttgattagatttttgagttttcagtgctgtgttctgcacgactaactggtaagtatagtggttttaagtaggagagtaagagcgtacaccctaggttttctgaatttttggattagtgatatgctttacactgggagccaatatgttggagacaaaagtttcttgtccttaatgcatttgatgcattcttctctcttcttttctgttctcttccttcacttcttgtctgtcttctcttcgaaataatctccaagctactacattggttttatgacgtgttgaacactgatctgtaatgttccaatgacacaatactttgcttcttgatttggcttcagaggccacttctgtggtcaaccacttgaaaaagttctgttatgccttttgttttctcagtttactaccagtgataatagatagtactttaggaaaatgtgtgtcgggagaaaaattgttttgagaggatttattatggaacaaagtggtatcaactattttcatagaatggaattaattgaattttgaccaaatgtgaacaaattgcattttttaacactggaaaattgttttagcagtttcatcacttttgtgggcaattttcctgaacttaacagttacagtttaacatattttaattgtaatttgttggtgcggtaattctgtctgtcctcttgtaagtggaaaatttctaggcttcttaatcctagtgtggtgctctttccatcacagcatagctatatatgtatatagctataccaggtagcttcaattattgtttatattagaggaaaatacaatttgtgcttctaaagagggtgtaatttcttagtgcagaaaacccttattcacattctacttctaataggaacatttttgcacacttaaagtatatgtgaatagttcagggtttatacatgcctacctaatattctgtctacaaaataattctattttgacattactagaaaagggtatttttaacttagcagatactatcataacaagaatgtttatttatgcttgttccagaagtctaacagtggatttgtgctttttgtttgcatgtatattatgttaaatatattgagaggaaatcagtacttttatggaagtaaaagatcaggagattttctgattttcaaagtgttgtatatgacaatggtaaaaacacttgcttgtttcagaaggtgaaggaagatgaaaagattttagatgggacctgacataggagaaaatgtcctggattcatagacagaggattgaggagtcttggcttaactgtttaattttggaaaagtctgtgaacctttctgaatcttagtatcctgtcaaattaagggatcctagtagatgaattctgtaatatcttctaattctaaaattaaattatataataccttctaattctaaaattaaattcttttagtttacacttttggtaaggtagaaattaaaataaaataagatgtcacaaactagtagttcttgaagttttacttaaatgttgaatgttgaccttgctaacctatactttccaaggtataataattgaaaaagatgagcaaatatcctgtatattttggataggactttaaaaaagtatatgggggttcatttgtaggatggtaacaaaattattacatgttcatttccttaagaatttaaacatttttattaacctctttgaaagccacttaaacttctatcaatagaaatgtttttaattgtagaataatagatttaaagtagtttttaacttttgggatgttatattactgtgttgaaaaataatggcatgtttgtaaaacatttgattttataattagatttataatatttgatttaaatgctatatatgtatcagttcagttcttaactaaggtttttttttttttttggcaaagcatttagagatttgaagcccaaatctaggtgctgttaatggtgttctgctttggtgggttaatggaaagaagcactgagtttgtagtcttatctgccaagaatcagcagaaactaataggaagtttaaaaaaatcagtcgtctgcatagaagctttaatcagaattaaacaagctacatttctatgccattttaattgcatattctacagtgcaattttcagcttttcaatgagatcactttgtgtttgactaggtaaatacaaggttttgaaaggcataagttagtgtgtgagatatttttctatacctttagtgctaagtgctttctaaatggttaggtaaatatttaaaaattccgtggccctaatgcccataaatattacttaaagttttaattttatttgaaaaaggtatacatatgtagtgtgagagcctaaaaaagagagttttttttaaagtgtggttatttactcacctaaggaatttgcaaggcataattccctgttaatttctttaagaatactgtagtatttgtgaaatttattttatggcttcagtgagtgagtgttttattccaatttcatgttactattttgtggtaaaatatcagcctacataataattttatactttattttgtaaatatagtatgtactctgccatgagtattatttttcaaaaacacagatttgatagagtcactctgttttaaaaatctcttatggcttttcattgtccacaggatactgttcatgcccttgacccttgcttgcaaagtccttcataatctgcactctgccattttttgttttatttttttaaaaagcattttattactaatgggacactccctctccacatgcattctagctatttgagggctgcttcttgttattgacattgttgtgggtttttctcttttgattttaacatctccacttgttgaaatctcctttaaggaacaaataagattaggaagactttaggcagtgcactgatactcaaatttatgtataagctgagaacaaattatagcagaatgggccatatttaaaaataaaagttgacaaaccatatgaaacagtgctgatgagtatttccattatagtgcattagatagtcacatctccataatttgtttttatacacttagtagaaggtaaccataagtaaaagcataaagtttgtttttcattgtcatcagactctgtcctcctcagtggcaggcccttctctcattctttctcttttccctttcaattaccaagtcagcttatttccctagcacactcttctaagccttctgtaccccattcaaagcaaaaatttattcttgccgaaaaagcctatttcagtataaatgttggtatagatatataaaatataggacaggttcagagtttatctaatctaattgaaatctgctcattatatattgtacaaggaaaataaattgaactccagagagataaaaatactggctgagggttattctgtgagatatttggaaaacggggactagaacctaggtctttactcctagtccacttttactttccacaaggagcatatatacttcccatcatagccttccaaggctgtacttaattttgccaggtatctccaattatgtgaaaaaaggcagtgtctctggttaaaggaggtaggcaagaagtgagagagagtcagttaagagggactcttgaaaatcctatagtttgtaatgaccttgatgacaaacttctgatacagttatttcagagtaatttgtaaggatgcagctggtcgcaaactcatgtacctacataacatttattttatatgttgaagacagaggggagggtcaaaaggagagtaggaagaatggaagtgaactgactattgcctgcttcgcttaaaggcattcagtttaaacaaaagaaactgaaaaactgttagctaaacaacattttggaagaactgggttctgtctgtgggtggttcctgacagtttataacattgacttgttgttcatcttgttatttacaagctgatctgcacttatttaggttgttgttataagcctgttcttagaacttggggcagaagagtgtatctcccacttttttttttttcttttacaaccaacaactttccttctggcattgatttacctagcagataactttacagatttctcctcctccatctgctacagcacgttctttggccacctcttccttacatttcatacaacttgcattcagcaatgttttttttttttttttttgagacagggtctcactctgttgcccaggctagggtgcagtgatgtgcaatcttgcctcactgcaaactctgccttgcaggctcaagtaatcctcccacctcagcctcctgactaggtgggactgcagtgcgtgccatcatgcccagctaatttttgtatcttttttttgtagagaaggggtttcgctgtgttgcccaggcatgtctcaaactcctgggctctagccatctgcccaccttggccaaagatgtccacatttgagaatatgttaccttatgtggcaaaatggactttggagatgggtttaaggattttgagatgaagatattatccaggattatctgagtgggtgcagtgtaatcatgagggtccttaaaaagtagaagagagaggcagaagagattagagaagatttgacagtggaagcagggttggagtaatacagtgtgatacacatccacccttgggaggctgaggccggagaatggcttgaacccgggaggcggagcttgcagtgagccgagattactcaacccatctttgctagctttggtgatgaaagaaggggaccctgagccaaggaaagcaggcagcctctaagaagatgaaaaaggtaaggaagtagattttttccctagagctcccagaaagtattgaagccccaccagcaccttggtttagcttagtgagacctatatcagacttctgacttgcagacctacgagatacatttgtgttattttatgcctttgaatttgcgataatttgttacaggagcatactagtttgctagggctgccatgacaaagtagcacaaactaggtggcttgaacagcagaaatgaattgtctcaagttctggaggccagaagtccaagatcaagttatctccagggttggttccttttgaaggctgtgagggagaatctgttccatgtctttctcctagcttctggtggtttactggcaatctttggcttgcagatgcatcacgctgatctcattcttcatcttcgcatggcattctccctgtatgttcacatagtctttccctgtacctgtctttgtttccaaattttctaatcttctaaggatccaggtcatattggattggggtccaccctgattatccccgtagagaccttatttcctaataagattacattctgaggtactgaggattaggactcaacatatttttttggggcgatacaattcagcccatgtaggtagaaacagaaaactaaagctacgtaaaattgaattgtttttcaaaatggatgctgaatataaattgatacatttatatttttgctatcagtgagtaagaatgcccctggatccacattcttatcaaccagtgcttcctatttactgacttttaagtttggctagtctagtgggtatgaaatggcatttctttgtgattgtaatctgcatttttctaatttctagatttatatgtatgttgtgatgtagagattcaatctcattttttatccaaatggatatccagtcatgccaacacactatattgaaaagtttatttattctccattcatcagtgctgcctctgtcctatatcaaatttcaatatatgtatgactgtatctgggctctattatgtttgatttgttagtttatgcatcttgtgttaataccacactatcttagttataatagctttctaataagacttaatatcctgtattgatagtgtccattgatgtgcaaaagttttcaattttgatgaagtttatctactttttcttttgttgcctatgattttggtgtcatatcaaataaatcactgcaaattcaatgtaatgaagctctcattctgtgttttctttgaggagttttataaaagttttagttctaatatttaggtctttgattcattttgagttaatttttgtatacaaaattttgtataattacagtgtaaggtaatggtccaactttattcttttgcctgtggatgttacatttttctaagaccatttgttgaaaaaaactgttaataacctttcaacaaagtgttggcttctttgttgaaaattatttgacagtacatgtgaggatttattgctaggctctctgttctatgtcataggtctatacgtctgtgtttctgtcagtaccacactgttttgattattgtatcttttagtaagttttgaaatcatgaagtttgagacctcaaactttgttctttttcaagattattttggctatttgagtgtcctttgagattccaatatgaattttaggatgaatttttctgtttctgcaaaaaatgtcattggggtttattttttattgtggtaaaaaccataaaatttactctgttctttatttttaagtgtacagttcagtggtgttaagtatattcacattgttgtgaaacagatctccctatcttttccatcttgcagaactgacactctatactcattaaataacaactacccttccgctgtcccctgataatcaccgtttgactttatgtttcaatgaatttgaggactttagatacctcatataagtggaatcatacagtatttttttgtgacttgcttatttcacttagtataatcatctttgggattttgatagagattgccttgaatctgtagattgcttttagtagcactggcatcttaacaataataggttttctaatccatgaaaatgggatatcttttgatttatttgtatattaatttatttcagcaatatttcatagttttcagtgtatgagtctttcacctccatggttaagtttattcctgagcattttattcttttcaatgctgttgcagatagaactgttttcttaatttcctttttgaattatttatagtatataactctatgcaactgatttgtatgtgttgatttttatatactgcagctttgctgaatttgtttgttctaatggttttttttggtggaatcttcagggtcttaacttagtttttgatccctaaaattagtgctgcatatgtagactcagaaacctcacgtaaaaatttaaattggcctcaggttggcaatgttccaaggcaatggttagaagcaaattcagattctccaaggcctcaaataattcctacagataaaatcccaaggaaattcagcagtgcctagtcaaaaatccacaaatcaggcaaggtaataaggcactatgaataagaacctaagaaaaagtacacaacaaaaacacatccgccctcgggaggctgaggcaggagaatggcttgaacccgggaggcaaagcttgcagtgagccgacatcatgccactacactccagcctgggcgacagagcaagactccgtctcaaaaaaaaaccaaaaaaaccaacaaaaaaaccacacccaccaaagcttcggattatataagaaatataaaaacacgtttattatgatgaaagaaataaaatagaaacctgaaaaaaatgattgggggacaggtgattaaaaaaactgtcgctggccgagtgtggtggttcatgcttgtaatctcagcactttgggaggccgaggtgggtggatggcttgaatccagaagttcgagaccagcctgggcaacatggcaaaaccctgtctctacaagatacaaaatattagctaggcatggtggcgaatgcctatagtcgcagctacctgggaggctaatgtgggagcatcacctgagctggggaggtcgaggctgcagtgagctctgattgtaccactgcactgctgcctgagtgacagagtgagactctgtctcaagaaaaatcccccaaaaccccaaaacacacacacacaaagttatataggtcagaagagttggagaataagaagtaaagtataacttggacttaattgaagttcgaaaaggggataataaaatggagaggaagaaatattagaaaaaaatgtctgtaaaatagcattttaaagaactgatgaaaaatgccaagtttttgtccagaaagctcactgaatctcaagcagaataaattaaaagaaacccatacattattgcaaaattacagaaccttaaataaaaagataactactaaaagaactcagaaaagagaaatggccttcaaaagaatgaatggcagttttactgaaaggtgacttattagtagccacagtggaatccataaagcagtggaatatcatccgacaggtgctgagagaaaataagtgtcaaactagaaatcagtgccccgcaaaactatctccctaggaaaagtgcaagctaaaacaattttagaaaaggaaaaattgagggagtttttaccactgaaagtacatactcaggcagaagaaatgaatgagatcaagaaggtatactaatgataaatataggtaaaactaaacaaacactgttattataagacattattaacaatgtcttctaagagaacagactagaactaaagtgctagaaaacaatagcatttacattggaaagaagaaattagaagagtatgttaaaaagttatatttcaaggggagggctaagagtttgactttaaatcttgtttatatatacacagcagctgtctacacacacacacacacacacacacacacacacacacacacacacagagctagtgcaactgctgaaagagtagatattgtgtgaatggcttccaaacaaatagaggtgacaaaagaattgagggaaaaaaggagaccaaataattaatatcagagaaaaaaggaggtcaaaaaaggaaacctaggcgaacaggacaaatacttaaagcatgtaaaaagatgatagaaataaatctagatactaccacgaatcacaataaatatagaagcaaaaactttgttaaaagaatataaagattgtccacttggattttctgactgtatactctttgcaaacataagaatttatcaaggttggaaataaaagaatggaaaaaggacacaagacactataataaaactggtaatattaatatcagaaaaactgggaaaacactttgctagagaaaaagatgatcattatgtaattataaaagactgaattcaccaagaagataaaatttaaaattgtagatacctaataacataaatgtctatgtctatatatatacatacacatatatacacacacatataattatttccaaattcacctacagtagaaagcattccttttgtatattttatttatacctttaattcattcctatcacattaatatactcttcttatactgtcttaattacctttcagttattagcccccttttttgagcatctcagtgtgctaggtgctgtgggggaaatataaagatcaataagatatggttctatccctaaggagtttatatctagtagactcagatgtgcagactagctcaccatgagacacaattgtgtaactgctgtgttccagtcgagcacctcattgtggaaggcaaatagtgatcagtttttcgggggagtgtattggaagtctttatagaggaggcatttgaaggacatattatataagacttgattaagtagagacaggcgttgagactggtaaaccatgtgatggtaaaattcatgacattgttgtggaaatcagaatggaaagctagtaaagtgaggagtgtagagttagtgtgggaatgttactggaaaagactggaagattggttgagagtaatgtatggaagatattgaatgccatcctaaactttttgatttattcagtggaagatgttggaagattttcagaagagaagagacattttctttatttagtttagagagattattgacaatgggaaaagtagatcagagaatgaaaatattgggagcagggagcccgttataatcatttatatgagagactgagaacagtgggagtggaaaagccctggtgattggaaaaaaggaggtatgaagatgcttaaagtcttagtgactgaaagtttactggtgtcattagctaatgtagggaacattggaagatgagctggtttgggagaaatgctaaagagcttgactattgattaatgcatgttccagttttcacatgtgaatggttgatacctcttttacatctctaaatgggatgtaaactccctgagtgtaagaactaagcatttctgttttgtatttatcatttacattttggagttcacaatggatatctgttattatatttatacttattgtcatttcttataatgtttccatgttaacctttagtgaagaaaagaactgtgggtggagatggatcccaatttcctactgtctttggtattttccttaatagacagttattgcacagtggtgaagctagactgcttgagtttaaatgtcatctctaccacttacagaatgttggacaagttgtttaacttctctgtaccccagtttctctgtgtataaattaggggtaatcacagtacctatcttattgatgtgaaatagatgtgatatgaaatgttgtgaggattaataacctgtaagttcttggaacagtgtctggcacctggcaagttttcaacagattagttgttatggctgttactattaatagttgaaattctcatccttgaattatttaatagtttatgccaagtttctctaaatcaatggtaaaacgaattgaaatttagatctatgagacaatccgtttttattgtctcgatacttctcttgggactggtattaagcaaaaaagcaaatcctttccataagggattatataggggaaattctttcaacagtggtcagtatttaggacaacaaagaaaagatacaaggagtaatttaaaaagtgattaaaaggggggtaatttggatttattttcttttaaagtttcagagttaaagattaagaacctttggtcttccagaagaaaaatgtgtcagctgctacagtcataatttactgtcccataagctttttgttccagtttgtcactttggagttgggagtacactgggaagtcaaacaaatgtctttacccataattcttccttcacagttcactgtctgttaagcatgttgataactatgcagcacctccccaggaatggtaagagggagataagagatacggaaacagaaagaagagaaactgtatgtaaaaaagtgactcttccaaccctctttttcactccagtcagtattagtcactttactttactgcttcaatgtaacactttgttccacttttcagaaaaagtctcctgaagagcttctaccagttagatagtaatcgttaaaagcagacaaaaataaatatggataggaatttttaccaatatatgggaaaatatttttctttacgggaaaatacttacatacacattactaaataccagtgtttatcattatgtaagtcattttttgtttgtttttgttgtaaaaatatgcaccatctacaaataactttaatacctgaaaactcatttcttcagcagcattactgggcattctgctaggagctataaaggctatgaaaaagaatcacataatgtcattattcttaggagtttaatgtaagataaaaagtgaagattatattttaaataataaaacaggcagtgcaattaatattgtagtgtttgagaggtctcaaaaaataacacccaaattccctgcccaaattttgagaagagagtgacagatgagatatcagaatactacctgtattcctgataaagctgttattcgaaggcatggcttgtatcagtagatagttttgctttctaataccaaaccccagagttaaacagacttccctggtcattagcagaataggaccaggaacattttccctgtttgcctggagagcctatccatggagaagcattggagaacttctgcttccatctagtgggtaggcttccaagagcaaaaaaaggggtagaattatgcttacatgattctttagtctaaacttaccagtcaggtaagtcactatcctccttctaggggataaataagtgaaagggtagagagagtccaaaaatatttagcaacagttcttcctcatagaagccataggattgagaaaaaggcattgcctctctcaacacgataatagaaaaagctatttgaaattctgacatcttttagacaacatatattttaatttttgcttgtcgcctttcttttttttttgagatggagtcctgctcttgtcgcccaggctgaagtgcaatggcactatctcggctcactgcaacctccgtctcctgggttcaaggattctcctgcctcaccctcccaagtagctgggattacaggcatgcgccaacactcccagctaatttttgtatttttagtagagacgggggttttgccatgttggccaggctggtcttgaactcttgacctcgtgatccgcccgcctcggcctcccaaagtgctgagattacaggcatgagccaccgcgccagatgtcacctttcttgtaactatagtgtctatatagttgcatggaatgtacataatttaaaaactgagcctagattctgcctttgttcatttgtttctttcttgacaaaatcaagtcacttatttctgtgcatttattgttgcacttaatattctctatcatatttgggttgataggcctttcctgtctctacattttatgtcctttaaattcagggacagtatcttatttatttatgtgaccctggtgcttggcatatatcaaatagtttattgagttggattattggattaaatactgtttttttaaatcacttcgcaggacatttttttcctagttgatacataatactcataatttcatcactgaaagtaacttgaagaacaggatgcctaaggaataagttcttgatgtcacaaaacccagcaaaaatcttcttcagcaggggaagcttacttaggtgaatgcctcagtttataggtgaagcttggaagaatgttgcaagttgggagaatggaaactaatgcaggacattgtgtgcaggagttgcctctaaaataaaggaggagcatggaatgataatttgaggtgaggtcatagtgaggcagtagggttataaacagttttgacattactttttcagatatggcttgcagagttaaaaattcctagatgtttcaatggttctcagttaacaagtgttgatagaacattttcagtgcttagactgcacttttgatttctagggagaacttcatttttaacataaatttactaattttagtagttcaccaaggaagaagatggtagtaaaatactggtcataattatttagcaaactctggaaatgtgattttttaaaaaaacttttctttaagttcaggggtacatgtgcaggtttgtaaaggtaaacttgtgtcatgggagtttgttgtacagattatttcaccacccaggtattaagcctagtacccattagttatttttcctcatcctgtccctcctcccactccggtaggccccagtgtgtgctgttcctccctacgtggtcatgtgttctcatcaagtacatttttgtcaggtaactgaagtttatctttttacaagtaatatctttttaattcaaacacatttttgctgtgactatttctattatgtttacccctatttctgcttaccctgaatagatcttgatgaaaataatatatttctctgaaaagtaaggattgtcattttaaaaattagtaaacatgtatttgacaaaattattagcaggcacagcagaagcagttcatacaatctgtttggtaaactgagtgatctcccagttctgtgttcccccaaatagttcacccacacattccataaaaggttctctttaggcagatgcaacaataccctgaaggcataattgttagctttatagtcagcattaggcaattaaaatcctccgaaattaattccagacttggctgtaaccctaagagccattctggaagacagaggatgtagagtttacgagatcttatgccctgtttataagggaggggaatatccccaaaatatttaggagagttcacacatactgaatgccactaatttcaacgacaagagcttatttctaatattccttatattattgcttctaatattctttttttttttttttgaggtggggtctcgccctgttgcccaggctggagtgcaatggcatgatctcggctcactgcaacctctgcctcccaggctcaagcgatcctcccacttcagcctctggagtagctggggctacaggcacgtgccaccattcctggctattttttttttgtattttgtagagatgaggttttgctgtgttgcccacgctggtcttgaactcctgagctctagtcatctgcccaccttggcctcccagagtgctgggattgcaggcatgagccactattcctggccccttctaatattctaatactagaatattccttatattattctttctaatatttcttatatttctaatatgccttacattagtctttagggctaataggaatagcttctgaagtgcttataatagctgcttcgggagtgtggcctttctgattaaatgctagctgatcacccttagaatataaattcttgttaaataacatatttacatttaaatagcaagaaaggagaatgtaagcatcctgaagataagaatttttgcctgttttgacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactataagtagttcaaccattgtagaagacagtgtgacgattcctcagggatctagaactagaaataccatttgacccagccatcccattactgggtatgtacccaaaggattataaatcatgctgctataaagacacatgcacacatatgtttattgtggcagtattcacaatagcaaagacttggaaccaagccaaatgtccaacaatgatagactggattaagaaaatgtggcggttaagaggaggatagtcgagatggccgaataggaacagctccggtctacagcttccagcgtgagcgacgcaaaagacggttgatttctgcatttccatctgaggtactgggttcatctcactagggagtgccagacagtgggcgtaggacagtgggtgcagcgcaccgtgcacgagccgaagcagggtgaggcattgcctcactcgggaagcgcaaggggtcagggagttccctttcctagtcaaagaaaggggtgacagacggcacctggaaaatcgggtcactcccaccctaatactgcgcttttccgacgggcttaaaaaacggcgcaccacaagattatatcccgcacctggctcggagggtcctagcccacggagtctcactgattgctagcacagcagtctgagatcaaactgcaaggcggcagttaggctggggaaggggcgcctgccatttccgaggcttgcttaggtaaacaaagcagcaggtaagctcgaactgggtggaacccaccacggttcaaggaggcctgcctgcttctgtaggctccacctctgggggcagggcacagacaaacaaaaagacgcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcacccccaagtaggggcagactgacacttcacacggccgggtactcctctgagacaaaacttccagaggaacgatcagacagcaacattcacggttcacaaaaatccgctgttctgcagccaccgctgctgttacccaggcaaacagggtctggagtgcacctctagcaaactccaacagacctgcagctgagggtcctgtctgttagaaggaaaactaacaaacagaaaggacatccacaccaaaaacccatctgtacatcaccatcatcaaagaccagaagtagataaaaccacaaagatggggaaaaaacagagcagaaaaactggaaactctaaaaagcagaacgcctctcctcctccaaaggaactcagctcctcactagcaatggaacaaagctggacggagaatgactttgacgagttgagagaagaaggcttcagacaatgaaactactctgagctacaggaagaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagccttaggagctgatgcgatcaactggaagaaagggtatcagtgatggaagatgaaatgaatgaactgaagcgagaagggaagtttagagaaaagagaataacaagaaacgaacaaagcctccaagaaatatgggactatgtgaaaagaccaaatctgcgtctgattggtgtacctgaaagtgacggggagaatggaaccaagttggaaaacactctgcaggatattatctaggagaacttccccaatctagcaaggtaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccatccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagcccctgcaaaatcatgccaaattgtaaagaccatcaaggctaggaagaaactgcatcaactaacgagcaaaataaccagctaacatcataatgacaggatcaaattcacacataacaatattaactttaaatgtaaatgggctaaatgctccaattaaaagacactcctcacttcaaaaaacctgtctcacgtgcagagacacacataggctcaaaataaaaggaaggaggaagatctaccaagccaatggaaaacaaaaaaaggcaggggttgcaatcctagtctctgataaaacagactttaaaccaacaaagatcaaaagagacaaagaaggccattacataagggtaaagggatcaattcaacaagaagagctaactatcctaaatatatatgcacccaatacaggagcacccagattcagaaagcaagtcctgagtaacctacaaagagacttagactcccacacaataataatgggagactttaacaccccactgtcaacattagatcaacaagacagaaagttaacaaggatacccaggaattgaactcatctctgcaccaagcggacctaatagacatctacagaactctccaccccaaatcaacagaatatacatttttttcagcaccacaccacacctattccaaaattgaccacatagttggaagtaaagctctcctcagcaaatgtaaacaagcagaaattataacaagctgtctctcagaccacagtgcaatcaaactagagctcaggattaagaatctcactcaaaaccgctcaactatatggaaactgaacaacctgctcctgaacgactactgggtaaataatgaaatgaaggcagaaataaagatgttctttgaaaccaacgagaacaaagacacaacatatcagaatctctgggacacattcaaagcagtgtgtagagggaaatttatagcagtaaatgcccacaagagaaagtaggaaagatccaaaattgacaccctaatatcacaattaaaagaactagaaaagcaagagcaaacacattcaaaagctagcagaaggcaagaaataactaaaatcagagcagaactgaaggaaatagagtcacaaaaaacacttcaaaaaatcaatgaatccaggagctggttttttgaaaggatcaagaaaattgatagaccgctaacaagactaataaagaagaaaagagagaagaatcaaatagacacaataaaaaatgataaaggggatatcaccaccaatcccacagaaatacaaactaccgtcagaggatactacaaacagctctaagcaaataaactagaaaatctagaagaaagggataaattcctcgacacatacaccctcccaagactaaaccaggaagaagttgactctctgaatagaccaataacaggctctgaaattgtggcaataatcaatagcttaccaaccaaaaagagtccaggaccagatggattcacagccgaattataccagaggtacaaggaggagctggtaccattcctcctgaaactattccaatcaatagaaaaagagggaatcctccctaactcattttatgagaccagcatcatcctgataccaaagccgggcagagacacaacaaaaaaagagaattttagaccaatatccttgatgaacattgatgcaaaaatcctcaataaaatactggcaatccgaatccagcagcacatcaaaaagcttatccaacatgatcaagtgggcttcatccctgggatgcaaggctggttcaatatccgcaaatcaataaatgtaatccagcatataaacagaaccaaagacaaaaaccacatgattatctcaatagatgcagaaaagtcctttgacaaaattcaacaacccttcatgctaaaagctctcaataaattaagtattgatgggacatatctcaaaataataagagctatctatgacagacccacagccaatatcatactgaatgggcaaaaactggaagcattccctttgaaaactggcacaagacagggatgctgtctctcaccactcctattccacatactgttggaagttctagccagggcaattaggcaggagaaggaaataaagggtattcaattaggaaaagaggaagtcaaattgtccctgtttgcagatgacatgattgtatacctagaaaaccccattgtctcagcccaaaatctccttaagctgataagcaacttcagcaaagtctcaggatacaaagtcaatgtacaaaaatcacaagcattcttatacaccaataacagacaaacagagagccaaatcatgagtgaactcccattcacaattgcttcattcacaatttgattcctggaataaaatacctaggaatccaacttacaaaggacatgaaggatctcttcaaggagaactacaaaccactgctcaatgaaataaaagaggatacaaataaatggaagaacattccatgctcatgggtaggaagaatcaatatcgtgaaaatggccatactgcccaaggtaatttatagattcaatgccatccccatcaagctaccaatgactttcttcacagaattggaaaaagctactttaaagttcatatggaatgaaaaaagagcccgcatcgccaagtcaatccaacaccaaaagaacaaagctggaggcatcacactacctgacttcaaactatactacaaggctacactaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccgttcaggacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacacacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatgacaatcattaaaaagtcaggaaaccacaggtgctggagaggatgtggagaaataggaacacttttacactgttggtgggactgtaaactagttcgaccattgtggaagacagtgtggcaattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggatgaagaaaatatggcacatatacaccatggaatactatgcagccgtaaaaaatgaggagttcatgtcctttgtagggacatggatgaaattggaaatcatcattcccagtaaactatcgcaaggacaaaaaaccaaacaccacatattctcactcataggtgggaattgaacaatgagaacacatggacacaggaaggggaacatcacactctggggactgttgtggggtggggggagtggggagggatagcattaggagatacacctaatgctaaatgacgagttaatgagtgcagcacaccagcatggcacatgtatacacatgtaactaacctgcacattgtgcacatgtaccctaaaacttaaagtataataataataataaaattaaattaaattaaaaaaaagaaaatgtggcacacatacaccatggaatactatgcagccataaaaaaggatgagttcatggccttcgtagggacatggatgaagctggaaaccatcattctcagcaaactgtcgcaaggacaaaaaaccaaacactgcatgttctcactgataggtgggaattgaacaatgagaacacatggacacaggaaggggaacatgacacaacggggactgttgtggggttgggggagggtggagggatagcattaggagatatacctaatgctaaatgacaagttaatgggtgcagcacagcaacatggcacatatatacatatgtaacaaacttgcacgttgtgcacatgtaccctaaaacttaaagtataataataataataataataataataaaagaatttttgtctgttttgttcactgccatgtccaaaataatgcctggtaagagctcaaatagctattgaatgggtaaatatcacactgactttgctgaagtatttaaataattttcagacattataaaaagaaatacattttggccaaaagcttaattaatgcaagagtaaaaaaaaaaaaggtttgaagcatacaatcctatttcagggggctcaagagtttaaaaggaagaaagggggagacatccaggtaagaggacacgtatgctgtctttccaatattggacattatctactttttctgagacagtatcgacgctttgagcatgacacatctttttgtaacagagtcctacttaagctcaatatttaattggtacttagagccaagaaatacatgtgggcctacatttttttgcatgtattttgtgttatagcctctatacaatctaaggacacttggttctttctctcaaaatcctttcctcacttttgagtaatttacttttgaatttataaatacctcaccttattattcatcatattatttgcattatgttaaaccctggtcaacccttaaaatgttaaaggaaagacattactatattttttaatgaatacactaaacttttaagtacaaatatatttgtcatcagcctctgcaaagccatcagatgtttgaaaaaaaattttaagcatgaagcaaagagtctagttttaagaacttagctgtgaatggatgatatcctacccatttaatagagttctccaaatgaacagaaagtatacaatgaaaggaaggtcccttagacatttgaagtttttctgcagcacaatcctgtctgtctgctttattcaagaatttgtagtcattttcagaattcattccagaaaccagcttattcgtttagatatcagcacactggtcttggcaaaagataacacaaaagtaaacactactatgtcaaaaaggatgaaaagccagcgatccaaccagtagaattgttttggaagctgtttgtctcggactgagatcacacattaagccttggctgttgccttccattcttgcacaagcctccctgctcctggggaccctctgtaagagtgagcgtcctaatgaaaatagatggcacactcaaatggctaaagtagggagagtttatgaaggaatgatttataaaagagtgggaagtgttaagagaacatggtatgagtatctgatgagcaacagcagatagccgttatcacctttagacatacaagggcagaatagggagctgttaagactcagagagtagctgtatagagattcatttgaaagaagccgtggctctggtagtagaggagcatcactaaccagaggtgattttacatgagagcaggggtggaggtgggtgggagagtgggggagaataactaccccaggctcacttcctgtctttctgtcttctgctcttgtattccattggttgactccaccccaaagacagagggcaaggggggctttggatataaacaagagtctcctggggcactgaacagggtggaggagaatgaagaatggatctggaggggcaaatgaaatattcgtaacactacctttttttaaattatacttttaagttctagggtacaagtgcacaacgtgcaggtttgttacatatgtatacatgtgccatgttgggtgtgctgcacgcattaactcgtcatttacattaagtattcctcatgctatccctcccccctcccctcaccccacgacaggccccattgtgtgatgttccccaccctgtgtccaagtgttctcactatccaattcccacctatgagtgagaatatgcggtgtttggttttctgtccttgcgatagcactaccatttttttaaggacacagtatctgcagtatcggaggaaggtccttttaggaagaatcatgtaaacaaagggtagaggagtattgaaataaagagtatgttgagaaaatggaaaatatttcagatagtttggagtgtgtgcttaagaagaataggcataaaaatgaaagcataggttagtatttgtagacaaatgttaatctttatattgcatatcctcttatttattactaagtcttgtattataaatgtttttataaatacctgagaatcaatagtgccttcatcattaggtgggagatagttggtcgagttttgtgccttagcatagttatctgggtgatttacacatagcggcttagtgcaaatagtacaaagatcagaagtcatttagagagtggggctttcagttaagaatataggctctggatttgcaccatctgtgtttaatttctgactccagcactttccagcttgatgaccttaggcaagttatctaataccggctcagttttctcattttcaaaataggtacagtcataatagttttattttagagtagttgtgaggattgagtaattcacatatttagcccagagcctagcagatactgttaataaatgttacctattttttgttttttagtttaggagggtattataggtatctttgaatatttgaaaggctgccccatgaaatagggattaaacttgtcttcatgagaacctccagtatcagaatcaggagtaatgtgtataagtaacaggcaaacagatttgggattaatacgagaaaatcttttaatagttatagagttgcttgaattagaataggttagctcatgagataatgatttacataccaagggaagttttcaggaaaacatcaaggggatgttttaaagtattaatgtctcaaaatgagaaaattagataaaagctttaggatatcttccaaccataatagtctattactttatcctaaaaaatttgtgaaaatcaaattttacgtaagaggaaatgtgtttgatttccttttccacatctctgtctgttcctgttgacaatttctgttcctaactaccttccaacaatccagcttacatgtcatctatctttgtttaatgatacgtataatttttttttttttcaagagacagagtctcaccatgttccccagactgggcgcaaactcctgggtaggtaatactcttgcatcagtctcctgagcagttggtactacaagtgcacaccaccatgcccagcatatttaacaatatttattgagcacatacaaatgtgccaggtattgcgctggatactgtgattagtacagtgaacaagacacatcagtctcctgccctaatggagctttaagaaattttagcagagggaaatagaaagtaaaaacacagtgaaataaatttcaggtagttttaagtactgtgatgcatgaagaaaataaaacagaataatagtataaagggatactagggctttggatggtggaggtgaagatggtgctttaggtatggtaggaagggaaagcctctctgaagaggtgacattttaaccagcatataaatgttgagaaggagctggttgtgctgagggaagcacactctaggcagaagaaccagcaaaggccctgtggtgggaaagatcttgacatgcttgttagaaagcaaactgggtggctagagagtggtgggagtggtaagaacagtgtggatcacataaggccttatacaccttgttaacatttacatttcactccaattgcattctaatggcaagtcatgagacaattttatggtataatttatgtttaaaaaagattattcttgcttgtttatgggctattgacggaatagctagagtggaagcaggaagataggaggctgttggagttatccaagtgagacataatagtgacttggactatctcagatgactttctcccccatttatccctggatagaatgtcctttaaaaaatattttataggccaggcatggtggctcatccctgtaatcctagctctttgggaggccgagatgggaggattgcatgaggccaggagtttgagaccagtttgggcaacatagcaagactctgtttttacaaataattaaaaaattagccaggcatggtagtgtgtgcctgtgttcctagctacttagggggctgaggtgggaggctaggaatttgaggctgcagtgagctgtgattgtggtactgtactccagcctgggtgacagagtgagaccttgtcttgaaaaaaaaaaaatatatatatatatatacatatatatatgtatatatatattttatagtgtttaccagatactagtgttaaagtatctttatattatattttaattaggtatacaattggctttctcattagattctgagtttcttaagcacaaggacaatgtcttatcccttttcttattattttaggtagcattatagcactgttattaattttgcacttaatgcattgctattaagtgaattcatgaaacttctatctgaacacagggctttttatagctattacaaatggcacagttaaatacgtaagtgcaataaggtaagctagatttgagatggaattaaaaaaatactttcccatactttacacacagaatgtagtttgtatacagtttaggaaaacctactaagaagggaaaatcacaatgttttattaggggtgaaacacaaatcagaaaggcttagggaaataaaaccaagaactagttttgttggtctatttgttatgataaaggctaaactaatgttaacaagagacaaatatagtggctcaagtaagaaagaagtttatttatcatataacaacaggtcacacattcaggctgctgggtctttcacgggctccttcctttatgttgctctgccacctcttagggtcttgtcttaatctgcacggtcaagctaggacattgtcacacttatcttccagtcagtggggaaggggaaagagagagtccacagagtccagataaataattttattttaaacaagtgaggtgaaagttgcatgtatcatcttgctcatattccactggtacttagtcatatggtcttactcagctactagagagatggagaaatgtagtttttagctggggagtcatagcaaaaactttactttttttttttttttgaaatttaaagaaaaaatctattgaagatctgaaaaacaattcctaaaagatagacttttccagaaaacactagctacacaatgtattgtgtctatcatgttaaaacatgcattagacacaaatacaaaaaccatgaaacaagccaccattcttcaacaatttgagcaaagataaaatgcctaagtaacaacatggatgacttgcaaaggatgggctctttactttaagcaccataaaaaaaaaaagcacaaatggatgagtgtgttcagttatatacactgaattgaacctttggcactaggaatcagagtattttgtcatatagcattaacatgtattataaaagtgcgtagtgtcaaaggaatagaaccaccaacattcaaaagcagctttgtcaactaggcagtaaaacactctacagcatatcctctgttgtccatcattgaatacactggtagtgactttgaaattaaaaaaaaaaagaaaaaggatctattaccccttttattttctttgtttaaaacaaaacagaaaaaaacatcagttgttacacactaacatcttcaaagcacatcgtttgtacaagagatagactaagaacaaaaatgtgtttacagagatccaaacataagtgagtgagagcgcctctcacatggctctcaggacggttctcaggaggagccacttcataatctctggcactaaacaaagttgtagaattctttgccaggtacttcaggaaatcatgaagataattcagtaattaagcaaggctcttctcatccagaggtgtataggccaacattgctccaattcgtacaagtaatctcaggagatgtggcactccatacacctgggacatgggtgccttggggtgatctgcaagaatttcggcatactgtggtctctcaaatttgtagagtagttgggtgcccaacattacgttgaagtattcttttatccctgccacaacttcattaaccgcatactccttattatctgtgtttccaccagatttcttgtaatttgcgtaatcctcaagaatggaatccacatttcttcttggcaggaagttaaaagagctgttttcgtctggtaattaagtcccagtcatcaacaagccacagttttagctcttcaggaagctttactttaacttcaactctgttcatgaatgtttcctcattttcaacagtaggatctacccgggtccttttcttccgaggaggccaaggagtctcactggtactgccaccatctccatttccaggggttttctgtttgttcttttttgttttcacttcaacatttttctgttggagaccagatgtcttctttcctggggcagcccctatcgtcttcccctctgcatactgctcctgattggctttttgaagttcttattctttctgcaaattagtgtccttgtatttgagtactctgctctctggaacccactcatcccaatttttattccaaccactgtaatgtataaagtatttcacttgtttgtccttaatggcaacctttacacactttgtttcatgaagaagaggcccatgaaagcacagcactcactcaacctcctggaatttaggctttgggtcctgttttgaagccatttataagtgatttgctgtctcctccttctcctaccacccccaactaaaactttactaactttgattttcagctaacaatcttctaaagttgctgttatttgaactacttaaagtgaatatgagggtaacaactaattaatttctgcttcttaccctcataggaaaaatattgaacttctatgtagcacttacacttagggagagacatcttgatcctgattgcaactgggatggaaaactgattttattactattctaagaaaagtttttatttgtatttttattaaaaatgaagttatgttcaaatgaaagagagtatgtatgagtcttgaaaattgttactttaggtaaggcaggactactaatttttttattatttttataaagaaacaactcttgctcaccaaagggcttgtagaaatggtgggctggttgccctcatggcaggtataaaggatacggatgtataatatttctattaaggcagtttgggataagggattacttattgcttttaatgtatatcttccttgttatcacatattaggttgatataattcttcatcaggtagaactgaagttctcagagttggagttgaggatgaaaagctgctttagaaccttttaggccttaagtcagtgtttctgttttcaggactgtctcctaaagagaggtaacttttttttctgttggatggtaaattatcacctatttctctatttcttaagagcagacataatctttggggtcgttcctttataatcttgattcagtattttttctttcttatcaatattgttattcattttattttttgcttatttaaaaaaaattcagataatttacatataataaaatgcatgggcctaaatgttgagttgaagttttgatggttatatacacttatgtaatcatgaaccaaaacaagatacagaatctttccttgaacttctttccggtctgttccatccagctcctcagagacagccacttactgatttctattgccatgtatttgttttaactgttttttaacctctttaaataaaattatacagtatgcattcttttgtgttgagcatctttcacttcatatactgtcctgtaatgcattcatattgttttgtatatcagtcgtgaatatattcaatgaatatgttccctgaatgaatatattttatgaatacatcacaatttatttattattctgtcacaatttgtttatacattcttatgttgatgaatatttaggtttccagtttttgccttatgaattaggctgctctgagcattcttgtgcaagtcttttttgtggagacatgtattcatttctgttgggtaaatacctaagagtgaaattaagtcagagtagatgtgtatttaacattaaaagaaactgacatacactttttcaaagtggttgtaccatttacactcctaccagcaatatatgagagttccagttgccctacatcctcactaacatttgatgttgccattcttttattttagccatatagtacctgtgatgttgaatgcctttttatgttcttattgaccatttatgtatcttcttttgtgaaatgttcaagtcttttgctaattttaaaattggattgttcattttcaaaaaattactggtttgtagttgttttagacagtcatgcgttgcttaacagtgaggatatgttctgagaaatgtgttaggtgatttcgtcattgtgcaaacatcacagagtacttacacaaacctagatgttacagcctactccacacctaggctatatgttatagcctattgcttctaagatacaaacctgtacagcatgttactgtactgaatgctgtaggcagttgtaacacaatgctaagtatttgtatatctaagcatatttaaacatagaaaaagtacggtaaaaatatgtacacctgtatagggcacttaccatgaatggagcttgcaggactggaaattgcatttggtaagtcagtgagtgagaggtgagtgaatggaaggtctaggacattactgtacactattatggactttataaacactgaacacttaggctttttagttttccaattactttataaaaaagtaaccgcgtcacaatgtcatgacagctgcaactgaaagttcattatgtggcatgtcactatattatggatgtgagtcctttgccatatgtatgtgttatgaatattttctctcaatctgttgcttacctcttcattttccaaatgtctttggataagcagacattttaattttgtttaagtctaatgcactaatttttttcctttacatttagtgctttttttataccttaagaaatttttgcttaagcatctctaaggtactctgttttcttctagaagttttatggtgtatgatctaacttgaagtaattttttgggtatgaggtaaggtagggggtcaaagtttgctttttccatgtagataaccagttgttccagcactgttttgttgaaaagacttgacacccttgtctaaaataaattggtagtatatttgttggcttacatataggaagctagccttagtttttaattttttttctgatttaaattctaaaaaaaatgaaaaccagggatagaacctataatgggtaagatggcacttatcttgttgtattttagagttttctggtggtgtcattttcagaatacattttgtgttcctcagaataaaggaaatgaagcttatttcttttattctcaagccaaatcactctctgaggattgaggaagtaatccagggtttgatatggggctcatggcataaggttaggtagcctgttatctttaactttctagattacttcataaaaataacttgcgtatatgtaatgatatctttctatgttttagatgttgttcaaagcactgaattgtaaacatattctcaatatttccctcgaatcttaagtatttaccttttattttttttaatttaaaataaaaaattaacagagtaaaatagatgttttttggtgtatggttctatgaattttaccatgagtatagattttgtatatccactacaacattcaggacatagagttgtcccattacttccagaagttcccttgtgctttctatccctttgtagttatatcttccttctatccctaatccctggtaactactagtctcttttccttcactgtagttttatcttcttgatgtcataagtgaaatcacacagcatgtaaccttttgagactggctacttttatttagcataatgcctttgagattcatccgagttgttgcatgaaccagtttatattttattgttaagtagtagtccattgattggatgtacctgtttatccattcattcatcctttttatttggggggacagagttttggtctgttgcccaggcttgagtgagtgcggtgacacgatctcggctcactgcaacctccgcctcccaggttcaagtgattctcatgccacagcctccggagtagctgggattacaggcatgcaccaccacgcctggctgatttttgtatttttagtagagatggggctttgccatgttggctaggctggttttgaactggcctcaagttattcacttgtcttagcctcccggactgctgggattataggcatgagccactgcacctggcctatccattcattctttgaagaatatttaggttttttttttctagttgtgttgattaggaatagaactgctgtaaacattcacgtacaagtttttgtgtgaacattagtttttattcctctagtgtaatacctgagagtgggattgctgggtcatttgttaagtgtatgtttaactttataagaaattgccactgttttccagagtgtttatgccattttgcagttttactggcagtgtatgaaaattctagtagttccacatcctgaccagcacttggtattgttagtatttttaatttttgtcattctaggtgtgtagtggtattgcatcatgatttaaatttgcatttcgttaatgggtaatgattttgagcatctgttttttatgggtttatttacattatatatcatctttggttaagtggatataagtcttttgttggatttgtgatttgcaaatattttcttccagtttgtagcttgtttcttcattctatgaacaatgtctttcagagaaccgaagattttaattgtaatgaagttcagtttttcaattttttgttttataagttcttttgatgtaatatttaagaactttttaaccacaggacatgtatattttttcttatgttttcttataaatcttataaaaatttagtagctttatgttttaccttaagacctgtgatgcattttgagttgatttttgtataaagtgttaagtttaggtttattttctcctacatacagaatttccaattctaacatcatttgttgtgtactctcctttgtttatcgaatggctttggcacctttgtcaagaattaatttgctatatttatgcagatttatttccgggttattgattctgtcacattgatcaatgtgtcattccctctgccaataccacactgtcttgattactagaaaattgtgtagtgtgaatcttcttatcttttttttttcaatattgtttgacctttgcagaaacattttagaatcagcttgtttatatctatgaaaaatttggctgggatttccattataatcacattaaattagtagaatcaatttgggtagaattgacattttttaggctcttgagcccctatgtgtgggcccactcccactctgtggagtgtactttcattttcaataaatctccacctttgttgcttcattcttttcttgctttgtttgtgcattttgtccaattctttgttcaagacaccaagaacctagacgccctccaccggtaacatattttggcaagccagccaggatgtaaaataagtttgggatttatttttttccttttcctttctgctccacgcagtggaatctcttcttcactcgggacccttggtgggcagcgcctaaacacagaggcaactgcagatttctggctgggatcactctgaaggactctcttctgtcttttctgcttgtggttcctgatccctacatgtggagcagctcagggcgaactcacatgtgtttcaggcaacttaaatcttcttttcttacactaaatttttcccttactctactcgactggctaaggacaaaagaaacccacctagcctccagttcctatcactacagttcacggaatggagcaaagtccactttgctccatcactctagtggaacaggaagcatgctgttccactagagtgggaccaaatgctcctcctttgctccatcactgtagtggaccaggaagcatgggaaaagatggccttatcaaattttaaggattctgaaagtcagggattatacctaggaaccaaagggaagctcatagtagtaggccattgcctctggagggaaaacatgcaaagcggcactggtgcccacgtaacgtcagagacgtctgatactcttaagactggaccccaaagagggatgccccaggggatcctttggacctcaacctctctgaagggaacacccttggcagaggtcctaaggcctagtactaagccctccttagaattttatctcacagttgcaatactgtttggccccagtattgtttggaatcaagtgtgttgttgaatgggaaagtgagatggagttgcatgtatccaggctttgatgctgctgttccaagcagggtcaggcctggttatatgtgatgttctcctttggtgctgtttggccccagtgttctttggagtctggggaggtttgacctttacaaattaaactgccatggaaactgctttacctgaaattttggttcactgccttcattggattaactactggggcaaacaaaagtagaaccggcaagtttgtattgctgtctcatggctagagttccaaggtaaaagctattgaatcttcatttgtatgtgtatatacatgtctagatgtgtttatttgtatgtacacttattgttatacattctgtctacaaaactgacatacacgtaaaagagtactcataaataagtctaagtacttttcaagttcatgtgacttaagtataactttactaaacaagctggttttaaaatgattggtaaaataaaaatagaaatgacttcaaaaaaaaaaaaggaatggacattttttactgttgagtcttccaatccatggacatgatatatctctttatttacttaggtcttctttgattttattcatcagtgtttcgtaatttttagcatataaaccctgttgactttttgtttgatttacatgtaagtacagatcctcctcaacttatgatgatggggttatgtatccagataaacccatcgtaagttgaaaatattgtaagccaaaaacatatttttggcttacagtattctcaccagtcaaaaccagactttcaatttatggtattttcaccagtgaaaagcacacttttgacttaatattttcaaaccagtgaaaagcacatttttgacttaatatttttatcagttgaaagcacactttcaaattgtgatattttcaacttatagtgcatttatctagacataacctcattgtaagtcgaggagcatactgaatgtatattgcttttgtaccactgtgatacggtttggctgtgttcccacccaaatctcatcttgaatggtggctcccacaattcccatgtgtcattacttccagtgggaagtaattgaattgtgggggagggtctttcctgtgctgttctcgtgatagtgaataagtctcatgagatctgatggttttgtaagggagagtttccctgtacaaattctctcttgccatgagtgtgaggacttccctgccatgtggaactgtgagtcaattaaacctctttcctttataaattacccagtctcaggtatgtctttattagcagcgtgagaacagactaatatacattgtaaagctgaaaaattgtaagttgtaccatcataggttgaggactgtctgtatttatttcttagagctgttgtaaatggtatttaacaagaattggtttccagttgctctttgctagtatatagaaatacaattgagttttgtgtgttggctttgtattctgtgatgttgctgaattcacttattagttctagaagcatttttcatagagttcttgagatttttctatgtacagttgacccttgaataatgcagcaaggtggaagttaggggtgctgacccctgaagcagttgaaaatctacaaataacttttgactcccccaaacctaactactgatagcctgctgttgactggaagccttaccatcaacataaacagtcaattagcacatatttttatgttatatatgttatatactatattcttacaataaagtaagctagagaaaagaaaatgttattaagagaatcacaaggaagagaaaatatgtttactgtttaattcatggaagtggattatcataaaggtcttcatcctcactgtcttcacattgagtaggttggggaggcggaggaagaggaacagttagtctgtctcaggggtggcagaggcagaggaaaatccacatataagtggacctgtgcagttcaaacctgtgttcaagggtcgactgtaaatgataacgttgtctgtcaataggacagtttgatttctttctttctaatctgtatactttttatttgttattttcctgctttattgtactggctaggacttccagtaccatgatgaataagagagatgtgatattatattttttccttggttccaatctaggaaaccattaaatatgatgttggctgtagttttgtttaaatgccctttattatgttggggaggttcctttcagttcttagtttgctgagagtttttatcatgaatgaatgttgaatgctgtcaaatgcctttttttgcatcaatatgatcatgtgggtttgtttttaaactgttaatatgatggattatattggtcaatttaaaaaatattgaacagctttgcattcctagtataaatcccacttgattgtgatatattcttatacattgctggatttgatttgttgatattttattaaggatttttgttgttgctatgttcatgagggacataggcctgtagttttttgttgttttttttttaataccttttttggtattggggtaatggtgactctcaaaacgaattgggaagttttccctcctctattttcagaaatgagtgtatagacctggttttatttcttcttttttaaatatttttcttttattgatacatagtattgattttttttttttttgagacggagtttggctcttgttgtccaggctggagtgcaatggcatgatctcagctcaccacaacctccgcctcccaggttcaagtgattctcctgcctcagcctcccaagtagctgggattacaggcatgcgccacaacgcctggctaatttttttctgtttttagtagagacagggtttctccatgttgatcaggctggtcttgaactcctgacctcaggtgatccgcctgccttggcctcccagagtgctgggattacaggcgtgagccaccgtgcctggcctgatttttttcttttaatgttgggttgaatttgctagtgaaaccatctgggtctcaattttttttttctttttgtttttttggaaagctttaaactatgtgttgaacttatttaatagttatagaattactcagaatatctatctcatcattggtgagctttggtagtttgaatttttcaagtaatcgattcatttcatctaagttactgaatttatgtgtaaagtgttatttgtagtgttattttattatccttttaatatctatggagtctataatgatattcctcttttattcttgttattggtaatttatgtctatctttttttctttatcagttttgtttgaggtttataaatttttaaatcttttcaaagaacaagatttggtttcattaattttctctattatttttctgttatcactcttattgatggggagctgatcattatttcttttttttctgcttgctttaggtttattttgttcttcttttcctaatttgttaagataaaagcttagatgattgattttagagttttattcttttctaatataagcattagcttctttgagtttccctctaagcactatgctagctgtgtgccataaattttgatacattgcattttagtttttatttggttcagactatcttctaatttctcattaaacttcctctttgaatgctggcttatttagaagttatttaatttctagtgtttggagtatttctgccatctttttgttacctatttctggttcaatttcattatgatcagagaacatactttgtatgatttcaattctctgcatatatttgatgtctagatatgagattttatctgtggtacttatcctggatagatttactaggttgtagattatgtcagtcttcagttttgctagaaaatgccaaattgtttttcaaagtttgaaagtatcaggggaacccaccccccgtatttcaacgtaggttctttatattttctgtaagtgtcggccagttgagaaataaagagaaagtacaaagagaggaattttacagctgggcctctggggatgacatcacgtatcggtaggaccatgatgcctacctgagccttaaagccagcaggttgtattaagatttcaaaaggagagggggtacaagaacagggagtaggtcacaagatcacatgcttcaaagggcaaaaaggagaacaaagatcacatgcttctgaggaaacagtacaagggcaaattcagaactactgattagggtctttgttcagctgtgcacgtattatcttgataaacatcttaaacaacagaaaacagggttgaagagcagagaactggtctgacctcaaattcaccagggtggggtttttccccaccctagtaagcctgagggtactgtagggaaccagggcatatttcagtccttatctcaaccgcataagacacttgcagagcagcgtttatagacctccccccagggatgcattcctttcccagagtcttcattattaatattccttgctaggaaaataatttagtgatatcttccctacttgcacatctgtttataggctctctgcaggaagaaaaatatggctctattctgcctgaacttgcaggcagtcagaccttatggttgtcttcccatgttccctaaaattgctgttactctgtttttttttcaaggtgcactgatttcatactgttcaaacacacatgttttataatcaatttgtacagttaacacaatagtggtcctgaggtgacgtacatcctcagcttacgaagatgacaggattaagagattaaagtaagacaggcataagaaattataaaagtattaattttgggaactgataaatgtccatattaaaatgaaatcttcacaatttatgttcagagattgcagtaaagacaggcgtaagaaattataaaagtattaattttgggaactgatatatgtccatattaaaatgaaatcttcacaatttatgttcctctgccgcagctccagccggtccctccgttcagtgtccctgacttcccgcaacatgaaagtagttgtacgaatctattgcaccactccccctgccccagaatgggatatgaatgttctatatcctccctaaacctactatgtatttgatttattcattattctagtcttggaagacaattaatcactaagggaacatttttctcatctttttttttttttttttttttttttttaagacagagtcttgctctgttacctgggctggagtgcagtggcacaatctcggctccctgaaacctccatctcctgggttcaagtgctttttctccctcagcttcccaagtagctgggattacagacgtgcaccaccatgcctggctaatttttgtatttttagtagagacagggtttcaccatgttggctaggctggtcttgaactcctgacctcaggtgatccacgcgccttgacctcccaaagtgctaggattacaggcatgagccactgcacctggcctcatctttcgtgagttaagttttatatcatccttgataatttagggtatcacagtaagcatactgaagttgaaaactcaagtaggttttggttatcattccaaacgacttgaagtttctcattggtcatggagttttggctgtgaaacaggacctggggctgcctctagccagagtgattctacctatgccacaggtggacaggtaagcccttttatggttgctgaaataagtccatatcctagagatgagattagattttcaccaatatctacttccagtcttcatgctttaaatgttgaagttcttcagttttgtacaggtaaaagaaattcttcacctaattctaagtttttacctaacttcttcaaccagtcttttcattgcctgatggaattctgcctgggttttaaattcttttaaatttaaaaatttttttacgttcttcctatctgacaaagacacaagtcttccattcgaattctacaaatctcttatacctttatctgagtctatattttcaacccttatgtgctaatgacaaatatttaattccatccttaaaggatagttgattgtgggcatctactgtatttcataacctttgtaatacaagttatataatttttagtgcttaaactatactttaaagaaaataataacagtgattagtagaacttagccttgaattaatttgagactgttgaaatagtggtgaacttttaagacgcagaggaaagtttttcctttggggataagttattttaacctgagacattttaaatgacaggaaaacatctagctttctttttttatgagtgattaaaatttaaagaggaaagtaaagactgaattggctttatacttactttaaattttaaattaccttaccatctatttaacttaaaaataagccacttttattattcagttaacaaactgaatatcattctttgtttttatttttattttttttaaagacagagtctcgctgtgtcgcccaagctggagtgcagtggcatgatcttagctcactgcaagctctgcctcctgggttcatgccattctcctgtctcagcatccctagtagctgggactacaggcgcccgccaccatggctggctaattttttgtatttttattagagacggtgtttcaccgtgttagccaggatggtctggatctcctgaccttgtgatccacctgcctcggccttccaaagtgctgggattacaggcgtgagccaccacgcctggccattcttttattaaaatattttttatagtaaaaatgcaggtgtattatgttatatttattcgttttggtaatatggttttattaaacttgacgaaaatgccttccaactatccatgtgttactcagaggtatgagaatgaattagccgaacaatttgaacaaaagttaagataatagacatttagaatgcttcttgctagaatgaagttctgatttgtgaagaatattactttatcaggtagggaagatatataaaggcagaaaaattattaaattgtgacttcctaaatgtctacttaaaaacatttatggtaaatttataatgttatattgaattgatttgaattatttgaatcttaaaatatagtgtgggagcttttttctaaagtatatattattaaaagctgagaaatatttaagtggttgaaagccagtgggaaatatgaagcaaactgctaatgcaactggggagacaatagaactatgtttatttaatattaagcattaaacttatgaagattttactggaaatttgattggtttttctgtcacccaagggtattttaagcctgttttatgcattatacctgggctgtaccaagagcagatggcaagttcccaggggaactttccaactgacccataatttgagataagatgatagtttacagagctacaaaaatagtcttggggtttgccactgtttttgttttagttgcctatcagatcttttgtcaccttttctctcacagatcatatggatgacatacagttctgtttatttgtcaatatctaattgattagcataaagttataagattataattcaagaggtgaaatggatgctaattggaactcctattaggaatttgctcatcaacatacaatttctttttttgaataatcaaaatatatacttttcattatatagattcagaaaggttctgaaaacataggagatattttcttttaaagctgcactcagaattttatttctgtgatactcaggtgaaagtatgtagtttcccttttcatttaattttattaaaattgaattaaaattttctttctttttctttctttctttctctctctctctctttctctctctctctctctctctctctctctccctccctccctccatccctctctctctctctccctctccccctctccctcttctctctctcggagagaacatgagtattttcaggaaattagagatttgaatttgaaatattttttgtatatcaagaaatccatcaatctttgtttaactatggaatcttcagaacatcagagttgcatgtttttaagcttagagaaaaatggacacactgaatcttagcaactgaaagcaaatagacatacgtcagtatctgtgtatagtgctgacacttatgtcagcactttatcctatttgcttgggaactcttgtttagtagtgtgtttacaatgaggcctttcagtggagagggctacatgactgaatgtgtgtgtactctgtattgtctgagtacattctatgtgtaaactttaagatatgtttatagacatatttgttattgacatttagtcttgtatttattttatttctcagaagtattttatttgttcatttttgataactagcactcagccattcactttttatttctaattttggtgtctttgtgtaggtcactgagtgtgattccagataagttattacagctagatctatgtggctcatcagccacatatttggtttttttgttgttgttgttgtttgtttgttttgagacagtcttctctgtcacctaggctgcagtgcagtggcatgatcttggctcactgcaacctctgcctcctgggttcacgcgattcttctgccttagcctccccagtagctgagattataggtgcccaccaccatgcctggctaatttttgtatttttagtagaggtgaagtttcgccatgctggccaggctggtctcgaactcctgacctcaggtgatccaccatcctcggcctcccaaagtgctgggattacaggcctgagccactgtatgcgtcccacatatttgttttagagagggaagttcgtgcaattaaaggtggaataatctggatttgtcataagtcctatgatttcattgtgctttagttttctgaacagatacgatgaaaattatctactaagagtttaaaatatatcgctgagggttaaaataaagttcaaagtactcccaagtattatgggaatttgtctgtttcttgggaagcagggtagacgttatctaggtggaaaagacgagtgggcaatttgaaatgttagactaggagcttggaaagagagaataaggctagagttatactctagaagttactcagtatattttattgaaggcctaatatatgtcctttaagattgaagccctggaattcatgcagaccacaagactagcatctcctttgcttgtggaattgatagtctagttactagattctagagggaggattatttgctttgaaggtcataggtgaagcttgggaatggatgagactgaaaaaaaagagtgtagatatgattaaaacaattaaggacacagtgactttgggaaatacattatgtaggtttttaggagaaagacaaggactgtgggggaagtacctatgtttggtgattggcatgatgaagagtcagtgaagaaaagaggttcagagtgtcagggatttgggggatttatcattaagctaattaaatttaagctccaggtttgtcacttacataaaatcctttcaagtctgtaggaggaaggttttcacatgggcatatgtttctgtaggatttccaaaagtaaggcatttcaatattgccatttctttcattctgacttaccctcatgtcatatggcattagagtggctgcaggcatttttgggatccagctaaggggaagttgaataggatttacatttagtttgggaggcatgtatttatgtggtcatgtcacttctgaatatagactagctgttctggtataggaaggatatcaaggaatactggtgttactcactgtgttaacacttagtgttatgacacaaagatggaaggctagagatcacctggtgatatggacgtgtcctataatgcatcacattagaagtacgtggtaggataagagaaacaaaatttgaaatacacggggccagaagctagtctgggaaaaattcttccaaatcgaatggtttataaatgaaagaaaatatatgagtttctctaaatttgacaatactaaaagtttatgacattaccagtagtagtttgtgaacagtttgtgaagactattttgtaaaatataaataacaatttagtcttttgaaaattaaaaagatatttatagaaaaccttacatataattgccatatgaagaggtgataacaaaagttatgcaaaaaatatgtagaagtatactagaagtgtgtcagggagtttattgataacattattgttattttttctggattcttgtgatgtttatgatgctgtgacttttttttctcattctcagtaagtattcacctttgtatctaattttgtatttgtaattttgcttccttttttttttttttttaaagaaggccccctaaattctagaaggttcaggcccaacaatacctgggaggcacagaatcatggaagttaagaggagacaaatcacggatggagaatatgtactcttttaaatgatgcattggggtagctaaggaaggcagttgcatttggcaattcagggattattgataatcttcactaatgagtatgaatttgggagtgggaagtggaggttgtgtactttttaaagaaagtggcagtagagtccaagaacagtagcttttgaggaaagcaaggtccagggaagtttttttgtatgtgtgcatgcttcaaaggtaggtggacatctaaatacgttaaaggaagggaaaacatgcaaatagcacagaaggaaaaattaaaggcaatagcaagagaggttaaagcagtgtagaaatagtgacgagagcagggaggaaaaaggaaatgaggtcaagacataggagtgttctaaatagtagaattcagtaaaggtgatttaattgttactgtattagcactgtgctagtgctgagtgcaataattgattttcataatgctgtaatttttctgcaaatcaacattttatgcttagttcattaagatttattatacaatttataaagacttacaatcacataatttataaagattttcatttggatgtttaaaatgaaatgtttcatgacatagttggaagataattatcttaattatctaattagttgaatatgttaaaattaatcttccagaattttttgacttattaagtgattgccccaaatcagcttagagatattatcaagtattttgctagtaagttatgtaaactaattaatagaaaatacatgaaataatcttattttctcttagttttatagatggtatggaaaaaggtacagaattgtcaggtaggatatttattattattttttccatttaactcatcaaaatgtattgaatgtttattatatgccaggagcaggtctaggtgctggagatagagcagtgaacaacacaaaatttctgccttcatggaatttacattttagtggaagagacagaatataagcaaataagcatgtacgtatatattgtcagatagtaatgtgtgttacaaagaaaaataagggagagtaaggcgacagagagttgtataggatgatatttcagatagtgtggtaaggaaagccaggtaggacacttatatgttgctttttgtcagtgtatttagaaaactattttatgcaagtcaaattgtgtttactaagatcaaatcatttacaatttaataggagcaacatctgcttacctgagttttcccttctgaaattattgatttataatagtaccaggctaggtgtggtggctcatgcctgtaatcccagtactttgggaggctgaggtgggagaattgcttgggtgcaggagtttgagaccagcctgggcaagatgctgagacccccatctctacaaaaataaataattaaaaatcagccaggcatggtggcatgtatctgtagtcccaactacttgagaggctgaggcaggaggatcctttgagcccaggaatttgaggctgcagtaagctatgaccatgccattgcactccagcctgggtgacaaagcaagaccctatctctaaaaatgatatatataataataatagtatctacaccataggtttgttgcatggtttaaataagattttgtatgactgttttggtgcagtgctcttactcttcactttatatgaagtatgcctgtaaaagggaataaaacttagtatgtttcgcagatactgtgtttttcacaaattggaggtttgtggcagcgctgtgttgagcaagtctgttggcaccatttttcttacagcatatgctcactttgtatcttcgtatcacattttggtaattcttgcgaaaaatttttaattttttattagtatatctattatgactatttgtgatcagcgatctttgatgttactactgtaattgttttggggcaacacgaatcactgcacccagagaagagagctaacttaattgataaatgtgtgggttctgactgctctaccagctggctcttcccctatctttctcccctgtccttggacctccctattccctgagacactgcaataatgaaaatgggccgattaataatcctacagtggcctctcagtgctcaagagaaagcaatagttgcacatttcttaccttaaatagaaagccagaatgattggaccttagtgaggaaggcatgtggaaagctgacatacaccaaaatgctaggcttcttgagccaaacagttagtcaagctgtgaatgcaaaggaaaagttcttgaaggaaattaaaagcgcttctccagtgaacacaaaaatggaagtgaccagctttactgctgatacggagaagttcgagtggtctggatagaaaatcaaaccagtcagaacatttccttaaaccaaagcctatcccagatccaggccctaactctcttcaattctgtgaaggctgagagaagtaaggaagctgcaggagaaaagtttgaagctagcggaggttagttcatgaggttttagcaactatctccataacataaaagtgcaaggtgaagcagcaagtgctgatggagaagctgcagcaagttatctagaacatctagctaaggtaagtggaaggtggctgcactaaacaacagattttcaacgtaggtaaatcagccttctattggaagaagatgctaggactttctagctagagagaagaggtcaatgcctggtttcaaagctttgaagcctaggctgactgtcttgttagagactaatgcagctgataactttaagttgatgccagtgctcatttcccattctgaaaatcctagggcccttaagaattatggtaaatctactctacttgagccctgtaagcagaacaacaaagcctagatgacagcacatctgttggtagcatagtttactgaatattttaagtccactgttgagatctactgctcaaaaaaatatattcctttcaaaatattactgctcattgacagtgcagctagtcgtcgtccaagagctctgatggagatgtacaaggagataaatgttgttttcatgcctgcaaacataacatccattctgcagcccatggatcaaggagtaattttgactttcaaatcttattatttcagaattacatcttataaggctatagctgccatagattgatggatgtgtgcaaagtaattgaaaaacctggaaaggattgaccattctagatgcccttaagaacatttgtgattcatgggaggagatcagaatattgacattaacaggaatttggaagaagttgattccagccctcatgagtgactttgaggggttcaagatgttagtggaggaagtaactgcagatgtgatggaaatagcaagggaataaatagagcctgaagatgtgactgaattacttcagtgtcatgaaaaaacttgaacatatgagtagttactttttatggatgagcaaagaaagtggattcttgagatggaatctacttctgataaagatgctgtgaacattgttgaaatgacaacaatgggtttacataaacttagtggataaagcagtggcagcatttgagaaaattgactccaattttaaaagaagttctagtatggataaaatgaagcattggatgctccagagaagttcttcccgaaaggaagagtcaattgatgtggcacacttcactgttgtcttgttttaagaaattgccacaggccaccctgccttcagcaaccaccaccctgataagtcagcagccatcagtattgaggcaagacctcccaccagcaaaagaactacagtttgctgaaggcttagatgatcattaacattttttagcaatagagtatttttagattaaggtatgtacattgttctttaagacataatgctacttagcactttactacagtatagtgtaaatatacttacagtatagtgtaaatatactttttatgcactgggaaaccaaaaaattcatgtgacatgctttattctgatactcactttatttcagtggtccagaaccacatttacagtatctccaaggtatgcttgcatttcttgtctgcttttatgtgaaccaaataagttataatcctctattaaatacctttcttttctgtagatacctccaaattacagaatgaagcttctgtgttttttcaacttggagattaaataatggttttaaattgaggcacatgcatatactgtaaggtatattagtctcagatatactactcagtgaatattttcttagatacatacctatatagtcgccacacagatccaagtatgccgtattcccagcacaccagaagaaatctttgttcaccctttgagtcattactaccttctgtaggtatccactgttctgacttccatttccatcaatttgttttctcgtttttcaatttcatatttctgacttctatttccatttctattttatgaaaattcaaaaaaggcaaaacaattttatttatttatggtttgttatcttttttatctggcttcatttgctgaaaacaactcctacaaaattcatccacattgttacgttatcaccagtttgttgggtttcagttctgtgtagtgttccatagtttgaatggaccacaatttatttattcattttctagtttatggacgtttggattatttttattttgagggagtagttatggataaagcttgtgtgagcatttttatacatcattttggtagacatatgtactaattttgttggctatatacaaggagtgggtttactgagtcatagggtaggtatatgtatttttaaaataattattttattttttttaagttctggggtacatgttcaggatgtgcaggttacatagataaacatgtgccatggtagtttactggacctgttaacccatcacctaggtattaagcccagcatgttttagctcttttccctaatgctctgcttccccaccctcccccaacaggccccagcaagtattgttcccctccctgtgtccatgtgttctcactgtttggctcccacttataagtaagaacatgcagtgtttggttttctcttcctgcgttagtttgctagaataatggcttccagcttcatccatgtccctacaaaggacatgatctcattccttttaatggctgcatactattccatcatgtgtatgcaccattttctttatccagtctatcattgatgggcatttgggttgattccatgtctttgctattgtgaatcgtgctgcagtgaacatatgtgtgcatgtataatatactgatttatattcctttgagtatatactaagtaatgggattgctgggtcaaatggtatttccggttctaaatcttggcggaattgccacgctgtcttccacaatggttgaactaatttacattctcatcaaccatgtaaaagtgttcctgtttctccacaaccttgccagcatttgttgtttcttgactttttaaataaccaccattctgtctggcgtgagatggtatctcattgtggttttgatttgcatttctctaatgatcagtgatgttgagctgtttttcgtatgtctgttggctacatgtatgtctttttttgagaagtgtctgttcatatcctttgtagggtaggtatacgtttaacttcagtagaaactccaagcagtttcccaagttgtaccagtgtattcacccaaaagcattaggtgagagtttcatttgcttcacattctcaagaacacttccagtgagtgaagtctttcgccattctgggaggtgtatatttgtgtatcattgtcattttaatttgcatttctatggtgctgatgatgcgcgagtgcttctatatatgttgactggccatttggatattgatattctcttttgtgaaatttctctttagatctttacccctttaaaaaattggattgtttgccttatttattattgatttatagtaattctttatattatgtattttatatacaaaacttttgtgggatatatgtattgggaatatcttctcctggtctgtggcttatctcttactgttttaatcttaatggtgtcttttagagaacaaaagttcctagttttcatgaagtccaacttatttttttctttagtagtttagtgcttttgaatattaatttacaaaatctttgcctacaggaagatcacaaagatattgtcctacattttgttctagaagttttatagatttatctttcactttttttttaggcagggtcttgctctgtcactcaggttggagtgcagtggtgcaaatatagctcagtgcaaccttgacctcctgggctcaagtgagcctcctgcctccgcctcccttgtaattgggaccactgtgcatgccaccatgtccagcaattttttgatttatttttatagaggtagggtcttaccatgttgcccagcctggcctcacactcctgggctcaaaggatcctcccgccttgaccttccaaggtgcagagtctatagctgtgagccaccacacctggctacctttcacttttagatatgtgatctagaattaatttttgttcatggtgtgcaattgggattaaggtttttgtttgtttgtttgttttactggtttacagtgctctagcaccattaattgaaaagattgtcttttcccttcagactttcagtggtctttttcataaactaagtgactgtttatatgtggatctgtttttggactctgttccattggtctatttatgcattctttggttgttgtcagactctccaatataataaattttgaagtctggtagtgtcagttctcaactttgttcttaaagattgccttggctagtctaggacctttgcatttgtatgtaatttttaggatccttaggtcaatttccacaaaaaaacttaatggaattttgatttggtttgcattgtatctatagattaatttggggaggattggcatcatagcaatattgagtcttttgaaccatgagcatgatatatttctccatttatttacatcttaaaatttttttctcaatttttagttttcagttgtagatgtctttattcattggtattttattttcttatgttattgtataagtggtgtttcataaatttcatgtttgattgttgttgttagaaatagaaatagaaaaatcttgagcttgtattaaacaaccttactaaatttgcttattcgttgtagttggtatataatcatgttacctgttttctttttgatctttatactttcccacccttttattgcctgttttcctgactataacctttagtataatgttgaatagaagtgatgatagtggacaatcttcttttctctttaacctttggggaagtattgaacattttaccaatctaataaatagattggtattagtggtaggtttgtgtgtatgtgtgtgtatattattattactattatttttggtaatagctaccttttatcagattaaggaagttcccttccattcctaggttaccaagagctttttttaaaaaaacgataaatgaatgttaaattctatcaaatactttttctgcatctattgagatgatcctagaatttctctgcttaattttgttaatgtagtgaattactttttaaaaaaattttaatttctttttaaagatgggtctcacttcactgtgcctggatattacttaggtttatttttgaatgttgaaccaacactgtattcttggaataaaccccacttgattatgtatattatgtatattatccttatatattgctgggttttctttgctaaattatcatttttatttttaaaagttttcatctgtgttcatgagagatgttagcctataattttcttttcttgtgtccatatcatgtatgcatattattaggcttatgctggcctcacacagtgcttaggaagtgttttcttctctttctattggctagaaaaatagtacaagattgatttctgttatttttaatctgtatgataatctctttttctctttttaaaatttgtgaaatagtcatcaaaatagagtatggttgtcttcttttgcagctgaagaaactgaagcttatagaatttaagtactattagatagctggtggttactgctctgtattgaaaaccagttctgttttacttcaaagcctttgctatacagtatacatggaggaaaatgagtgaccaggtgatcatatggggatcttaagaaataccagaagttgttcttttggaaacttgtaagcttcttttaaaatcttacttcctgtcggtctaagaagggcactcttgatgaatgcttcttagttgtttgtgagggttgtggcttaaagtagctaagctttataattctgttggctctgtcaaatgaaaagtctatccattccaaaactgaacaaataagttttatttctgtgtgagaacaaatggttacttggaatttactgggatttttctttttccaaatccacatagtactggcaacatcttttttttctttgatgttaagatatttccaacattgattctttacagtatatgataggtcaagggattccattcatcatatactgataggtccaaggatgagggaaaaacttcatacaagggaaatataaggtgagttttaagatgaatctagtaccttattttcccacaagtccaaacattattacttttttatataagaaaaatgtttagctgttgtttcatgtggaaacatcttttcttcctttaagtgatatagaatacttgaaaaactattccttgttttcgttaccaaagaatttaggttttctaacaattgtttcctaatgacttctcattctgtagctatttacatttttttcttgaagattttattggaaatgtttggcgtctttatgagttttcagcaagttttgatgtcgtttaatcactaaagtttatactatgccagtgatgttattttatttgcttaatatgaaaaacctcaataagtttgtctcatttccagttaacttaattagaacatttggctccctctgaaactgcttctcatttttaaagcagaaggtgttatttagtgaaacctacaaaagaataatgttagagaaaattgtactttttagctgaaaaatgttctgtgttaataaattttagagctagaaactttttcgagagctcagttaatccttctgggacttttgaaattgctatctcagtggcagtatttcttgacaaatacagtattgagtgcttttaatgatcttttgttaattatatatggctccgacagtagagatttgagtttggcttaaatgaataaatactatttttacccatggtcaccttaaaaattggagttaaagtgttggcctgctggtctttttccttctctttagttttgctagtaatagtaagttttatttgccattgtataggcttaattggttaacatgtggctgctaatatttagtaaggttaatttttagtatgaaaattaagagtttcattttggtttttatataaagtgaagctatgtattaatagatttggtagttaattatgctgaataacaaaagtctaatatttggatgatcagtatattagtagaattagaaatacttgctcttgaagttgtttaaaaattgagatagaaaaagaggaagttgattttattaatgctgtaaaactgtcaaaaataagtatttagaaaggcatatttgagtgctaaattacttatgaactgacaactgttaattctttgcttaaaattaaaatcaaagtataatgccattaaaacaagtatagaaaaggcatgccagtttcccccatatttagggtattatttttcaaaacatttgctgaattaaaaaaaggttacttaaatttcaaatgtgtgttttcctctaaatgaaaattttccctttttcctcagtgtttttctgatgttcaagtggcagtaggtgtgggaagccgttgcaagcagtatctcccaagagtgagcttattctcctattgtagatatcaggatatcattgctttccttttctgcactgtatcatgttttagttattttatggaaatctatcagagtggaagagcaaaaggtcagttggaagagaaaaaagatgaaactgaaactaaaagtggttaaatatacttacattaggtatcaattactacttgtatattatccatgttacattttaaatttgcattggcttttttgttgttctttaggtaccttgctaggattattgattttgttcattatgagcagatctgagtgcctatcatgtacataatatttctgtgaccagttcattcattgtgctcaagtgataataaccaattttaatattaattctgtaaaacatatagcgcttaatattcctcacatatggagcttaatcttcccccacaaattttattttgtatattttaattgcaaaaataaaggatttattcatattgtagctagtttgcatcagcatgaattaataagtttcactatttttcttgttagcatttttaagttttattgaattagatgggtaaatgaatagtaattatattatctgcagtgtaattatctttgatttcagttattcacaccatctctttacaagtgataatcaaaaattatttcaaagtttgaaaatttttaacataaaatttctgctcaatttttatactttttaaatttccttcaagtaatatatgcacatagttaacaataagatagtaccaaaagacttaaggtgaaaaatagcagtcttctttctatttctgttccactctacagtcctgcactccaaaagcaattactcctaattttttccccatttcttaaggtatttacctacataatttaaaataatatggctcttctactaattttttggcttaagcagttttcttatgataattgaagagttagctcttttattatgcctctctccattctttctccattctcttgctatagttatgtcatgaatttaaaatctatttttggtatttatattacttgattatggaaatactgtttatttgtgaactaagtagttcactttttttttttaaagcatccagtgttactattaataagtagaaagccattctgatttctctctggaagcgttcaagatttcctttacccctggtgctcacaagttttgtgatgctgtgctttgataagtgtctttttttcaacctttgtgctgatatttgatgggtctttttactttttaatttttggggaaaaattcatgtgtgtgtttttttttctcttccctttttttgattctttctgggcttcctgttagttgaaaattctgttccctaggttaatttgcctaatttttaaagtgtttttctcctatagtttatctcttaggctttttgtcttatttttctagttgtccttcacttcatctttctgtccgtctactgaattataaaaattgtattatcatagttttaatttcttagaggggttccttattctctgttcccattttaatattatgtctttgattcatgggtacaacatctattcttatttttctgagattattaataagagtttattgatgtcattcctcctacttcctaatttcttttggcacattttggtctttgcttttctgttgcaagcttttgtcagattcttcaagtcttagttcttgcaaaagcagaatctaaaataccctatctttggtttatttggaaggtgattccaggaattataatgagagaataaggaggtgagacagggaagagaagaagtccagtaaaaggtgtattgattttgtgggttatcgtttggagcagctggagctcaatactgctggagactttcagagagactgtgtagaactgcactgtctaatactaatcactagctacatatggctattaaaattaaaattaaaatgaatgaaattaagtaaaattagagattcagtttgcattcacaccagccacactttaagtgcagatgtagaacattagacagtgcagatatagaacactccaattcagtccagtccagtgcagatataggacatttccatcatggtttataacataccttagaattgtaccatggaggttcaggaaaactgacctatttatctaccatcatctgtcccttattgattaagagttgctcctagagttactgactccctgtcacttatggcctgcgccacacaggggctgtgtcatttctgctaccttactcatttccactgggtacctagtaacaccaaatgcagagtttctctagttcatttttttctagagatccaaatcctggtcttctgtcagtctgaggcaagtagtcacttgactgaatgtggtggagggaagatagtcttttataagtatgcagatttttaaccaaattgctcatatttttttggggaaatcttaccccagtatcccatggcaactgttacattcgagttccaagcctttggaggattccatggagtaaattgacttcttattcttgtcctttaccacaggcattctgattgcagttttccctgatctgcaaattactaccactctgtagcttaagaaaaattatgatatatagtatttcaaacatgtggagaagtataaagaaaaaatatgcttgcaattcatatagtgctgggataaattcaactaagccctgtagggttgtctttttttttttaataccaggaatcttttgtttaaattttaggagacttgtcaccactcagtgatatcaaggctgctggggttattatgtcctttttcttctcctttgctgtgtttaggtggctactagtttattgagaaatttttggtctatttgcataagagatcttagcatattataatgttctttctatgtaacatttgtctgcatttggttttgatgtccaggtaacactagatttatgaaaaaagtttgtgttacctctttttccgttatgtggaacagtttgtacaaaattaatattagttgttccttaaatgcttggttgaactacccagtttaggcccggttgtttgtgtgtgtgtgtgtgtgtgagacattccttcttactagtttaatatttttctttttaaaacaccttaaatgtagttttttcagttagagtctgttagtggtaagttctttttgtgtttctggaagtttctttgtttaactctcactcttggatgatagtttagctgggtatagaattctgacaagtctgttttgagttttttcttccttaaatcttttgaaaattttctaagttttttcttattttcagtttggcttgatgaccatgtggcttgatatgtggcctgaatcttacttaaatattaggtctatagatttaacaagtgaaaactaatttttataattcatttcctagtttttatttagataccagcaatattcatgataaaaagtaccatatagtctcagatatctttaattttaatggttagaattatgttaaaatattaaaccagcatgtctgaatcatgactacataataaagcctattgatttaattggtttgaggtgggagtccaagcctgtattttctttcagtgtgctcaaataattctaatgtgcagccagaggttaaagaacatgaagttacaaattgagctgtaaattcagagatattctaatacaaatctcaactgtctttttctttttgttttgtttttatttaaaaagttggcagcctaaattcaaaatgtatgtggaaagacagatcaatagtcaaagcaataaaaaagaagtacatcattggatttatagttcctgattttgagatttacttaaagacaatgtggtattagtgatagaatggatattatggacaatagacccacacatacatattcagttggtttttggcaaaggtggtagggcatttcaaaggaggaagtaataatatttacaacaaatgtgctggaaaaactgtataatacgtatgtaataaaatgtatactgactcttacctcacatcatgcaggaaaggtgaacttaaaatgtgtcatagacctaaatttaaaactaaaaaaagctgtaagacatctagaagaaaacatagaacacagaaaacacaaaccataaaagaaaaaaattcataaactggaccttgtcaaaattaaaaccttttgttctttaaaagttatcaataagaaaattaaaagataagggttaacataggaaaaatatttataatacatatatttgagaaacgacttatatattggatatataaagaactcttacaactcaatgaaaagaaaataattgactcaatttaaaataggcagaatatttcagcactgctactacattctagaagatttgaacatgtaccattttcattccttggaaaatagtttggcagtttagcatatgatactggaattctctcctaggtatttatccaagagaaatgaaaacagatatccacacaaaaatttcgtcatgcatgtttatagcagttaattcataatagctgtaaactgggaacacccaaatattcattgcagatgaatggttaaacaaattgtgctctatccctaccagtagaagggaatgaactatgaacacacacatggataagtcttaaaacattaacaaaaacatgacgctaaatggaggaagccacatacaatatattctgtataatatcatttatatgagattttagaaatcaaaaactaatttatggtgtcagaaagcagatcagtgacttggggtagtggtaggagagtttgactgcagaggcacatgaggtatcttttgttggtgatggaaatgttttgtattttaattttgttggttgtcacacagttgtacaacatttgttaaaaataatcaaactgcacattttaaatgggtgtatgcatattttattcaacaagtttgacgaaggaacttaggaacactaagttggacaatctcatgagctttttttgtgatttcaaatccatgttagtggttaagctacaatgtttattgttgaatgtgggtatttactatggaggaagtgtgtgtatggtcttagctcatttacaaataaaatattttaacctttaattgaatattgatatagcatgatgttaactttatgttacagttactttctgctgtgtattactgggaatgtctttcggtacttatatagaaataaggtaaaaaagctatacaattaaaaatgtggcaatagtcacttcaaatcttttatgtgtgcctactaaagcaaacaaaatactaaacttgttttatatgtgttcaataaactgctgaacaagaaaaggatgcaatggccatgttgttagactgttggagtaagtgtaatagcaataacctaccttcctttttaccttcctttctccccctctccttccctttgtttctccctccctccttcactcccttctctccctcttctacctatccttatttccctttgctggtgacagtgcaagttgaatttgtacactgatctagattcagattagtataataaatttttaaaaatatcaagttgaatgaagaaggaaaattaaaattatacagtacctgaaactaaaaggctaaataaatggattcatcttttaaaaaaagttacattttctgagcatctataattcagttaagaaggtgactgaaaattgcagtttactggatgatcttgggaaaattactcactgtgtttctcagttttctcatttgtaagacaacaataatatgttgaaaggattaaatgaggtaatgtatttaaagtgcgggcacatagtaactactcaataattatttgcctgtcatcatcatggtcatattcaaagtgaaatttcttccacatctgaccttggctattttaatatatgtgttactaagcaatataatgtattttaaagaaaaatacggtgatatgccactttcaaagaaacaaaaaagatgtgcattataaattttagatcataggtgaaattgtacttattatcaattcattaggtgcatacaatacacatttagataggagcattgttaattcatttttagagtttttgaccactttcatacatttcaaaatggctttgaagacataactgcagttttcatatttttcatactttagcattttggtacatgccatattagaatgtatcttagacatctgataagtgtcaagatttcccccttactctgttatctagcaaatattgagtacctggtatgtaccaggtgctggggatataacagtgaagacaatctagatgcctctgtcatggaacttagatttcattgtttggggagatactggggaggaaagattggacaagacaacacataaaataacaagataacttcagatagtaataagtgatgagaagaagaaaatgggatgatggggtagaacatgcctggaaggactaatttgggttgtgtggttatagaaagcctttgtgagatgacatttgagcgaagacctgagatgaagagtcctgaaaatctggggatggattttctagtcagtggggacaggagttcaactgcatcttagacctgatgaacttggtatatttgaattcttacaaaagatgaatattgctaaaggatggtaattaggtagaagactaataaagtagaggagggtggaaagatagccaggacctatctttcacagatagccttgggcatcatttcttactgagtctgtgaagcttgatgccgtaagcaaagagaaatatggaaaataagtggttggtattaacggtgtggcttttaggaaacaggcaaaatatcctggaagatttttattggggatttggaagtataataaaataaataatcattaactttgtatgccgtggggagaaaccaggtctgattattgacttctctttagggaaacatcagtttgtaaaatgtgttttgaaagcagcagaggaggtaatatgggcatactactctttccctcccattaattctttagacttcttctttgatattttactgagagtgtggggttttccccctgtatatatgatatttgtgatgaagaaaggcaaataatttagctagagttcaacactttgtttcctactctttggtcaaaacataaatagtatttggataccttatagtaacatacaaggagaagtgactagagagagcttgtttggttaagatcactcatttaagtagattagaaaagtatacctatggagaagcatcccttggaaggtaagactaggttattttatttagccttcttcttggttgcaatggtttggatgcttgtcctcttcaaacctcatgttgaaatttgatcttcagtgttagaggaagggcctaaagggagatatttgggtcatagggatgagtccctcacaaatagattaatgacttccattgggggtgagtgagttctccattaattcctggaggagcttgttgttaaaaagagcctggtacttccttccatctctctcttgcttctttttttgtcatgtggtctatgcacactggcttcccttcaccttaccccatgagaggaaacaacctgaggccctccctagatgcagatgtccattcttgaactttccagtcatcagaatcatgagccaaataaatcctttttctttataaactacccagcctcaggtattcctttatagcaacaaaaaatggaataagacattggctaagtcctattataaatatatataagtatttaaatgtgttttttacatatggggacagcttagagtctcaaatattagacgtacctaaatgtaatacatggcttctagactggattctataagcagtactataaagaatgttattggatcagctgacaaaattgtactagtacagtaaatctgatgcaggtatttagtgatgttgatttttctggagtcgataactatagtgtggttatgtaagagaatattcctcatcttaggaaatttacattgaagaatttaggactaaaaagcatgatgtaagcaacttactctaaaaaagttcaggggtgaattatatatatatatagagagagagaatgtaggtgtatgttaataataaaacaaataggacaaaattttaacaatagatggatctggataaaggacatataggagttctatgcactaatcttatttttgcacctcttctgtaagtttaaaattatgtctaaataaaatactaaaaatgggttaaagttattttttgtttaaaaataatttcaaaatgtagctatatctcattgtcagaaatactatcaattctatgttgagtttatcaagcaaaattccaatgttagtacaatgatcaagtgttaaatattgggttacaaactaatattttttgaatctagaggtagaaaagattagtgtggattggatgttagaactgtgaaaaaaaagtgcagagtggtgaggtagttaagagaaactggaaagaatgagctggttgagaattcagaattggagaaggtaaatttagtagttacccatgtaaatgctaccattgtagagcaatgttttgtagtcttttgcagtcttcctgaggatacttaccatgttttattgaattttaacgtgcacattttttttcacattaaaaaaatctctgaaatcagggtgtaccttataatcagtggcatctgataatcacatcggtgtggattaaagtcagtttttccatataagatttgtggttttgcctgtaacctgggggcactaccagtaacctggaggcactaccacttttcttctgccagtaacctggggacagtaccaacctgaaactattttaaattatcttttgtgtttgagtacttggaccaccctagtgtgaattcggattacagatttgtgtgtgttctggctggtggttcaaatttggagaggagatagcacctctctcccccgcaccactagtgccaagattgagaagacaaattcctgtgctgttgctttccttgtaataggtttatttcccctttactcttatacgttttttgtcacagtcttcttatgagggttcctgttagactattggatattttttgttgttttcagttatatatgaaaataatggtgataaaaatactttttttcctgcttaactttggtgtccttgctttttggatatatgttcttaattgtattattcctattcatggtttcacagatatctttaatctcaccctatccaaaggaattctaaaggtaaaataacaccctacattgatagcttggtccattaagtcatttgtcttggggaaaagttgtagcataaagtcatagtcagtttttggttaggaggaccttatagaagagatgaatgagcatacatacaccctggagttagtccaagttttggattctctgaagcttacctctgtaacttaatctttctgaactttagtttcctcatctagagaatggtttgtgatattactgctctgttaatgttattgtgctccttcaatgagatagtgtatataaaggtctagtgtgggctctggcagagatgtggtgctgaatagatgatttatttttttgattgattgtgattgccattatttttggtttcctaggacatcctcttccacccagtccctcttcttatggaaatatatcttgtccaaccatcccctcccaccaaccacgagagaggtgggcacattattcatcctggccaatttagattaatcctctaaatataatggtaggttcacgtctgagtgggcatgtgaccaaagtccatcagagtcttttcccatcaggattgatatacagggaatgggggaagaaaacctctctaccggaattacaaaggttggatttagatccaaagccactggcaactaccatctaattccatatggagaagtctgcttaaataatgaagctaaggagaagctatcaaggataagagatggaggttgagggttggggagggcgaaaaagagagggaggagagagacagagactgagggagatccagttccatttttttaggctatccttcctatagctcttctttcagagatatgccagtctcctttccagctttgtgaactagtaaatgctttttttaaaaaaatgtggtttaagttggatttctgtcacttgcagtgaagagttctgatgaatatgataatggtgttatttgcccaaagaacttttcttgctcaaagaactgcctatattgctttcttgctaacttgttaaagactagtatataataggctattacatagaggatgaatgcctggaaaaagaaataaaaattatgatttttttaaggaagatctctgagtttaagattttttccatgtcacattattatttctagtgatgctatagggataccgtattgcaagtaaacatctatagatgtacaaagaaaatttgcagtcttaattttaattagaaaccatttaccacatttagaagctctgattaaagatataatggataaaagggataaaattacatttgcagttatttgtttttaatctttaatgtcccttcttatatgactctcagatagagtgagcagggcccaacttgtctgaagcttaagaggtgacccagaatataattgagaggactagaaaggtatattagactattcttgcattgctataaagaaatatctgagatggagtaatttataagaaaagaagtttaattggcttacagttctgcaggctgtacaggaagcatagtgctggcatctgcttctggggaggcctcaggaagttttactcatggcggaaggtgaagtgggagcaggcacatcatatggccagagcaggagcaagagagtctggtgcgggaggtgccggactttgcaacaatcatatctcaagagaactcactcattattgcaaggatagcaccaagccatgaggaacccgcccccatgacctaaacccctcccaccaggtcccacctccaacattggggattacaattcaacatgagatttgtaggggacatccaaactatatcaaagggcaatggatcagtgtcagcattcactgctggtaaaaacagtatttgtattcttaatttggttagtctggataggagccaaagattcacagcatggccgtattcacttggaagtttgcaatttgattaaggtttgagaacatgtcagggaaggaaagaatttcctttaaaatcatcctgcacactgaatacctaaagtagtacaaataatttgttatggcctgagaagctaagaaaaaatttagtcattcttctaagtccaagaatggctgtaggggatagtacatgagtgactatcctgtctacttctgttttctgttttattttgtatattttttagaaacaggatctttctctgtcccccacactggagtgcggtaatgcgatcatagctcactgtaacctccaactcctgggctcaagctgtcctcctgcctcagcctcccaagtagctaggactacagacgtgtgccaccacacctagctaattttttattttttgtagagacagggtcttactatattggctaggctgctcttgaactcctggcctcaagcaattctcttgtcttgggctcccaaagcactgagattataggagtgagccaccacgcccaatcctgttttcttttttgaggtgcgttaaatatttacattttacctggagtttggaaaagtagtttatttggacgtacaagcttgttttttttttttttttttttttttttgagatggagtcttgtcctgttgcctgtgctggagtgcagtggcatgatcttggctcactacagtctccgcctcgcaggttcaagtgattctcctgcctcagcctcccgagtagctcggcttacaggtgcacagcaccacacccagctaatttttgtatttttaatagtgacagggtttaactatgttgggcaggctggtcttggactcctgacctcaagtgatcctcctgccttggcctcccaaagtgttgggattacaggcatgagccactgcgcctggccaaggtgtgtttttaaagtagaagttaattctgtggattgatttaaccaattttctttgcaagcaattgtataggagaattaaatacaaatcctcctactgatgtcagatttagataatgccttaatatgatgtaatatcttaaatagtgaactgtttggttataccttgtgccatgatttccttaatatatctcataaagttgtacaaagaataagattgagatgctttactgttaggcacatagacatttatgtaacattcattttaaaaaatttgaataccaattatgtgtaaggtactaggataaacacaaaggatacaagaagtctttgccttaggccaatacattctgatagagtgttaaaatagttacacaagtatctgttactcaaagcattaattacataggtgttatatatattaagtatataaacattatgtatattaagtgccttgtgctgagtatcaactaagtgttttaagatcagagtccatttggggtttgtgatggttaattttatgtgtgaacctcactggatcacgggatgaccagatatttggtcaaatattattctgagtttctatgagagtgtttttggatgagatagatggattatgagtagagcaaaaaggcagactctcccacatataagagagaattctttcctacctgactgccttcaaactgggacattggctttttacctgcctttgaacttgaactgaaacattggcccttcctgggtcccaagcttgctggccttcagatggaaactatactgccagctttcttggttcttaatgcttcagacttggactgaaactaaaccattggttctccaacttgctcccacaactctgcacatgttaggtcagcctccacaatcatgtgaactacttccttataataaaaaatctttacacacacacacacacacacacacacacacactcacacacatactattgtttctgtttccctggagaactgtaattaataaagggtgacttggaaaggcatcacagaggaggtggaatttaagccagaggctaaactatcgtataagcaggatttcagtagataaagatggtgaagaaaaacactacaggcagaggaaatagggtatgtgatggaagcagtctcaagtagtataatttggctagagttcaagatgtttctactgtttttttgcatttcagaagagttgtgggagaacaccagttttaccacaacctggctagtacttggtggtagtgtggtagtggcagtggcagtgcgcgtgtgactttttttttaaaaaatgactgtagcaggttgattgatgattggttaaagaggaagtctgctttctcagcattctggttaatctaacctgagatcatttttcattactctatcatgctccagtccaggggaggggagggttatagtcagaaaaaaagaccgtataaatgtgtatatatatgtgtgtgtcttgctatttgtattggttctcatagtttgcaaagtgaatatgatgacattcttcccttggccctatttttagcttgcttttctcttagtggacctaagttatgaaatagcaaaggtttatatagctttgaaattcatgtttttagctgggcgtggtggcagtgcctgtcgtcccagctactcagggtattgaggcaggaggatcatttgagcctgggagctccaggctgcagtgagccatgcctacacctctgcattccagcctgggtgacccagctaaaccctgtctcaaaaaaaaaaaaaaaaaaaagaaatacatgttttataccctcagatttaattgcttattttacatatttgaccatccatttcctgggatgactgatgccccaagatggtgccaatgtggaatggcagtactgtttagtaggactttctccagtgtccagtgtggtatccaccagccacacatagctattgagtccttgacatatggctagtgtggctgaaaaatggaattttaagttttatttaattttaattgatttaaatttaaattgtaacatatagctagtggttactgtatgagacattgcagttctggagcttaagaagttttggcttgtttctagctctctggtgttgagaagggctgaccaagcagtattttcactcatatttaaaatataatatcttaaatattcttaaatattctattggtgattacacagcaaatgaattttgatattgccaattcttcagtaaaattaggtatttattaattaattgtttatgttctgcctcattccaaataaagattgtatgtgaatgataggaaatgatctattaaaggtacaattattaaaataatgataaaagaaaaagagccatgtaacaaatgaagtgagaagagaagcaagaaaaggggaaaaatcaggtagcgtgatgcctccagcttttttcttttggcttaggattgacttggcgatgcgggctcctttttggttccatatgaactttaaagtagttttttccaattctgtgaagaaagtcattggtagcttgatggggatggcattggatctataaattaccttgggcagtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattgtctttgaagcaattgtgaatggcagttcactcatgatttggctctctgtttgtgtgttattggtgtataagaatgcttgtgtcttttgcacattgattttgtatcctgagactttgctgaagttgcctatcagcttaagattttgggctgagacgatggggttttctaaatatacaatcatgttatctgcaaacagagactatttgacttcctcttttcctaattgaacaccctttatttccttctcctgcctgattgccctggccagaacttccaacgctatgttgaataggagtggtgagagagggcattgcgacactattaacagtagcaaagacttggaaccaagccaaatgtccaacaatgatagactggattaagaaaatgtggcacatagtgggaggagccaagatggccgaataggaacagctccggtctacagctcccagcgtgagcgacgcagaagacaggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatactgcgcttttcagaccagcttaaaaaacggcgcaccacgagactatatcccacacctggcttggagggtgctacgcccacggaatctcgctgattgctagcacagcagtctgagatcaaactgcaaggcggcagcgaggctgggggaggggagcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcaggaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgagggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggtagaaaccctacaagccagaagagagtgggggccaatattcaacattcttaaagaaaagaattttcaacccagaatttcatatccagccaaagtaagcttcataagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccatctcatgtgcagagacacacataggctgaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcatctctgcaccaagtggacctaatagacatctacagaactctccaccccaaatcaacagaatatacgtttttttcagcaccacaccacacctattccaaaattgaccacatagttggaagtaaagctctcctcagcaaatgtaaaagaacagaaattatagcaaactatctctcagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaacgagaacaaacacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagactgctagcaagactaataaagaaaaaaagagaggagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacactctcccaagactaaaccaggaagaagttgaatctctgaatagaccaataacaggagctgaaattgtggcaataatctatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgagaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaagcctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagagactaccatcagagtgaacaggcaacctacaacctgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaatacatgaaaaaatgctcatcatcactggccatcagagaaatgcaaatcaaaacactatgagataccatctcacaccagttagaatggcaatcattaaaaagtcaggaaacagcaggtgctggagaggatgtggagaaataggaacacttttacactgttggtgggactgtaaactagtacaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccgacccaaatgtccaacaatgatagactggatgaagaaaatgtggcacatatacaccatggaatactatgcagccataaaaaaggatgagttcatgtcctttctagggacatggatgaaattggaaaccatcattctcagtaaactatcgcaagaacaaaaaaccaaacaccgcatattctcactcataggtgggaattgaacaatgagatcacatggtcacaggaaggggaatatcacactctgtggactgtggtgcgggtgggggcaggggggaggggtagcattgggagatatacctaatgctagatgacgagttagtgggtgcagcacaccagcatggcacatgtatacatatgtaactaacctgcgcaatgtgcacatgtaccctaaaacttaaagtataattaaaaaaaaaaaaaaagaaaatgtggcacatatacaccatggaatactgtgcagccgtaaaaaatgatgagttcatgtcctttgtagggacatggatgaagctggaaaccagtctcagcaaactatcgccaggacaaaaaacaaaacaccgcatgttctcactcataggtgggaattaaacaatgagaacacatggacacaggaaggggaacatcacacaccagggcctgttgtggaatagggggacgggggagggaatagcattaggagatatgcctaatgttaaatgacgagttaatgggtgcagcacaccaacatggcacatgtatacatatgtaacaaacctgcacgttgtgcacatgtaccttaaaacttaaagtataattaaaaaaaaaagaaaaggggaaaaatctaggaaagtctagtcgagggtagcaaaaaatccatctgtgtcaactggcagatagagtaaaaaaaataaatccaataaaaaaataacatttttatgtaatgagacatgccattgagtcaagagagaaactttttccaaagacgaaacaaggagaaatttattccgttttgtaagatttgttgagtagtatagtggacggcatcgtttaatagcaattttacaaataatagagacatttttatcatatatttacatcaaatcttggtaaaaagttttttgaagagctaaagcctgccaataaccatgtgagcgagctgagaagcagattctgcagagctagtttagtcttgagatgactgcagtcctggctgacagtttgattataacctcatgagagaacttgaaccagaggcactcagctaagccactttcagattcttgacccacagaaactgagataaaaaatgtttgttgttttaagctgcttagttttggggtaatttttttatgtagaagaagctaactatgttatgatattttttttagaatggaggtgcttggtgttaaatgataaatagatacagctttctaaaccttcaaatcttatttatgaaagtacatttatagccttatatgtttgagggtgtaaatatagttaggaaaaatgttgaaattaagtattttcactagccatcctaaatggcatctggccatttgaatgaatgaaaaatagctaataacaatagataacatgtattgaactctttctctgtttcagaaactatcctaagcatgttatggacattgtatcatttagtccttacagaattgtattgagtacttcagactttaaaaccaaatcactttgactccaatttagccattgtactaaccatactgtgatcaggtaacttctgaggtatagaaattcatgtgttaaacatctgagggattcttaaattttgatggatgctggagatatagtggtgagcaaagggagacagaacctcagatctcatgccacttacaacattttgaagtacatagacattaatacaataaatacatatttacagactgaggtcagtactatgaagatgagttctgagatcctttaataaaagcaagtttctggtccaggcacagtggctcatgcctgtaattctagcaattttggaggctaaggtgggaggatcgcctgaggccaggagtttgagaccagcctgggcaatatagtgagaccctgctgctacacaaatttaaaaaaaaacccattagctgggaatgatgatgcacacctctagtcctagctactcaggaggctgaggcaggaggatcgtttgggcccaggagtttaaggctacaagtgagctatgattgggccactgtactccagcctgggcaatagagtgagactccatctcaaaaaaaaaaacaaaaaccagtaaaagcaagtttttattgttgaagagcaatggtatgcttacaaactgaaagaagggcaacaaggttatagcacagaaaacaaaaagaagagtggtgtgagattaggctggaaagatatgcatgggccagactagcaaggccttggaaggtgatgttttattctacttcctaagggaagctatcgaaaagtttttaacagatattatgttaaggttttctttttggaaatatcattgtagttaaaatatggacattgtagacatgccatagtggctatggggagactcttaggaagctgttgaaataaccaaacaaaaaagatggactaaggtattggcaaaagttttttcagaaatggagagaaatagacttgaaagatggttacaggataaaatcaacaggacttggtgagaaaattgattaccagggggttggggagaaggcattgttaagaatggtgaaaagatttcctacttgcctatctgtgtgtatgatgatgctatttattaagggtacagaacattaataggaagggggacacatttggtggtaaaactcattagttagcttttgccgaatttgagatatgtttgagacatccaagtttggaatgttgagaaagatgtacaggttgaacatccctaatctgaaaatccaaaatcagaaatgctccaaaatctgaagctttttgaatgcctataagatgcttgaaggtcatgctcaaaggaaatgctcatttggagcatttcagattttggatatttggattagcgttgctcagccagtgtaatggaattatgttattctaaattctgaaatatgaaacacttctgatctcaagcatttcagatcaggatactcaacctgtattagattggatcacacagaactccaggccagagataagaatgttcaaggaatgggcaaatatatggtaattgatgtaatggttaagaatgccttgtgagagggagtgagaagagaagaaggcctagaagttgaggaactccaatattaactggccaaactgaagaggataacctacaaaggatatagtagaaggattctttcactcatttatttatttattcaacagatatttatcaagtgcctattatataccaggcacaaatatggaatccagggatatagcagggataagatagtcaagatctttgctgtcatggaacctaaactgtagtagaaagtacgtaaataaacataaatactttagataggtacaggtactaaaaggaaatagaaaaggattatgtgactgaggaagggaagactagaagaggaacaaggcttttgaggaaaatcaagaacttccttctttttagccatgctacttttgaggtatctatatccaaatccaagtgattaataggggctgctgcatgctagtaaatagcaccaccattcacccaaattggcaggctcaaacttccagcagcttttttctttctttcgttctttctttctctttctttttctttctttctttttctttctttctttctttctctttctttctttctttctttttctttctttctttctttcttctttctcctctctctttctcctttcttccttccttccttccttgcttccttctttctctttttcttttcccttccttccttccttccctccctccacccctccctcctttcctccctctgtccccctttccctttccctccccctcccccttcccttccccctccttctccccttcccttcccctcccctcccctctccctcctcctgcctattctctcccctctccctccctcccccttccctcccctcccctctcctgttctctcctctcctttcctttcctttttctctctctctttcttatactccatattcagtccattagcagctcctgactactccatctttaacatttgtgctcaatatgattacttcaattatatgcactatttctttactctaagccaccattttctcttgcctagactattggagtaacctctgttctgatctcccagcttccaatcttgtccccatataatctggtattcacattgcagcccgaatgatcttttaaaaaccaaaattctttgatcatatgctccagttgtttcctataatatcgacacagtttaccatggcaataatgctctatatgatctagtcacttttttgactgcattttggaatgctctttccctctacttcagcttcactggccaagactccgctattccttgaagatatcagtattattccagacttcagggcatttgcatttgctgttttttcacttggaatgctcttcccccatattttcacttagcttgctccctcacttcataccagtctctgttcagctgtgatcttatgaaagaggttttccctgaccaccctatataaataagccttctttgacacctgcctatcattctgtattcccttagcccatttttatttttcttcatttcacttatcatctaatatgttcttgtttattattttttctttccctctagaatgcaaagaccttgtctgtcttattaatgtctgcatcccaacagccaagaataatgcctggtatataatatgtgggttccataaacatttttttttagtgaatgaatgaatgaatatataagtctggagctcagaggagatttcagtgctgaaatgtaaatttagtagtcaatagcatataaatggtcatttacactgtaggactggatgaaattatcaagagatagtatggagccaaaccagaaaagggacccagattcaagcctttcgctgatttttcatttataaatcagattagaaggacccaacaagttaggaggaaaaccaggagagacatatcattgaaactaagagaggaaatgttctaaggacacagctttgttggataatgcttacaggctggattaagatgtgtttgtaaattaaccattggatttgcaaagatgaagattgttttgtggcttttaagagttatttcagtggagtggttggggtagaaatcagactggagtatgacaggtgaggtagggagagtgaagtagactcctttgagaagtcttgctgtgaagaacagagaattgaatgatcattgaacggaggaaatgtaatcaaggaaggacttaagtattcccccagagttttctgaatttgcaattcattcatcttgattatctccccttgaggtctagctgtcatcagttaactggaggattgattcataatccctttttgcaaggtggcaaagcttacctttctcctcaaacctatctaccaaagttctctttcttctttaatttcattagagtccttggtaaatgattcacatttctttttgttataactcttcagtaaattaagcctttgcctttcttgctgattttaccgtattatataactatcatagatgatttcaaatgttaatagtgatagaaactgtaataatataatactaacatgtattgatatttactatgtggggtcttttgaagaaatttacatttttttaacttaatattcaaaacaaccatgggaggcaggtgctattattatcctcagtagaggatctaaggatctgaggttcagagggcttaggtaatttcctcaagatcatatagttcataagtggctacaggtatgattgtagagcttttgctgttagccaccatgctattctgtctttaagttaacaaagtaaatgtttcatcttctaattatgttaaactaatatgcctttggtgaattgttttggtaaagttaatacttctttttctccacttttatatctgttatgtgaatttatgtcttagactggattattggtaactctattatttttacaataatcaaatgttagggctagatgggacatttaattacataatgaatggaataaaaatctgctaatcagatagatctgttttctaaactgcattttttctcctttgtcttttttggcctaccctgttggctgtgaactttattttaaaattcatttgtgcttataacaataataagcactatttattccttgagtggttttacaaaccttacaaggcttaccatttccagagtgtcagagtagctatagcaggtttacacttaaatatactcttggttttatgacattccattttgacagtgatgaagagcatgcttataggcatcgttgaaaaggaatgttagaactgtttatgtgatagttctacaagtttcttacatttatctattatagaaagatctatcatacatgcttacttttcacagagtttataatatatgcatatgttttaatggtttgttataaataatatgattagctggcaaaagcttttagcaatttaaattttggggttattttaaattatgaatttaaacaagctctttcatttcaggtggttggctaaacccactgtggctgatagtgttatataaagttgttttctagttttgaaaagctaaaagtttatgtttttatgctttctgtgaaagtcactaatacttgtaacctaatgaaaatgtttctactgctacaattgtggagaaattttgaaaacctagatttagtcagtatttttcatgctaacattgtaaagaatgtcagaggccatggagaggatctaagggaatcagagaaaaggaagaggaagtaacatttttagagtacattttatgttctaggcaactcagtaatagggcagtatatcatttcattctcacagaagtctttcgaggtattataatttcccttttacagatgaggaaactgaggttgcagaggttaattatgttgataaagatcatatagataagtagaactaggattgaaatctagatctacttgatacttaagcttcctcttacacttgttttatggagttgttcttgggccttcttaaacaggtaattattctatgtcatagcagaattcttgatagaattatgatatttaaatttttatttactcagctatcataaacataaaaatactatactactatataagcttgcaggtcttttgaatataaaaactaaactgcatgttgactcatttatcagagttctgtagaataattaaaagtaattataggaggtcttttttaagtgtatgtagtcatttgtattatttgaaagcttagacagcttttatagcagtttgcttccagaccatgctcattgatgcattgaagagatacccgtgaaccaccttgtctactcccatacagctgatttatctttgtagcagtccctgagttagagaatcttccctactacctctgctatagttttcagtaaattgggcaagatcaaatgtttcctggagataatttccttagctcttgtattagatcccaacagtaaatacattattgactgatgtgaacacagaaagcatctcaaactttttgttgatcagagcatagctcagttgttttaggaattccagataaaatgacagtaatgtattgtgattatttccttcttttgaaatgaacttgaatatacttttatgtttatttgtaaaataacatttcaaagatcacattgtgcttatttttacagtggcctctggctgaaagcaataaagttctgtcctgggtggaactaggctagttgcagtttctcaaatttcttcaatgagatgctttgcttttgtgaaaataagtcatattgtccactgccacctttgtttacttctccattttatcccctcttggttacagaaattagctactacaaataaaatgccaagattttataattttctatgtttaaatttgcaagtaaaaagttctgttgaaacatttgtaagatcaaactaatgtgagataaatatgactgatattcagaagttgattaatctaactttcagtactgtacctattacataaagtatgattaatctctatgtgcaagtatataaacaaattttgagtataaaatcataatctaaaattttgttttatatttaatggagtgttcaaatactttgtaataaaaacaatggatgactaaaatgattgaataagttatcaaatagagctttgtaaactagggttcatagttgcaaataatagaaatcaactctggatattttaagaactaaaaaaaaaattgaaacgttactgagaagcttacagaatcactgagagggttgtagaactaggctcaataaaaggatcagaataggagaggttaggcagcaaataggaccacaaccaaaatcacagcacatcagtctggtgaatacatgcatggctaccaccaaaaatgaacactcacttgcccctcacgttagccaatgaatgctgtctcttccactgctatctaagaacctcgatgttgctaccatcagtttccagaatggattctctgatactcccctctgcatcattatctcccagtttaaagatgggtgtttctgagtagctgacctaaggtcacatactaatactgtaactacaagaatagttgggaaagtgaggattggatattttcagattgtgtggagaactaagctctgtggtctatcaacactcctcaggtaggtaatttctaagtgtaggaaagttcagatgttgggtggccaaaaatgtacagatatccactacatttccttgtgatagcatctaagttctttccatttcattcttttataaattcttttaacattattgttgcataagagaaaaaggcataaattattttaaaattttagattcagagacttggttggacacatgatattactctggatgttcttagacgtttcaggccatttcaaccttattttagttattactttaacaagtttctgcaaagttgtggttgtattaatagcaaacatactaatagtgctatttgagcattatcagatatcataaacatagtattctatcccttcttctgaaagatatatcaacatttccctagatatatccttatctttgtactcactttggagaatgagctctaaaagtataatggaaggaacaaaaactttagagccagatttgggatcagatgtgacctctgtcactctgtcatcatcatttggtatctaacattagcagttattctcattttagatatgataaaactgaatcatagagaggttaagtagctcaagacttttaaattaaacatgaacgattaaacattaaaaagtatccagaaaaattaacttactttttttctaaatgtagtataaatatttttagtgcatctcaagtatgcagtgacttagatacccatattccaattacagatgtctaattttttaacttacatacaggaacaggtaatcatgttagatcagtttgtctcagttccttgtgttttatgtttagaatgttggggatattttgttcatattctaaataactatttgttatacccttccaccatcatttaatatgttaaagttttaaagcattttactttgatttttttttttttttttttttgagacagagtcttgctctgttgcccaggctggagtgcagtggcactatctcggctcactgcaagttccgcgtcccgagttcacgccattctcctgcctcagcctcccgagtagctgggactgcaggtgcccgccaccacacccggctacttttttgtatttttagtagagacggggtttcatcgtgttagccaggatggtctcgatctcctgacctcgtgatctgcccacttcagcctcccaaagtgctgagattacaggtgtgagccaccacgcctggcctttactttgattttttaaccttacaacaccccttgtacttgtataatgtcatttttacagatgtgggaaattaggaatatagattaaaaatgacatagttataaggctatagtttagttctcacagagaaactcagtcatataagttaagcgtttttgttcccaaatgatagtcatagtagtaaaagaaatttttaaatttcacttatttattcagaaagtgcttactgagcgcctagtgtgttctgtgcactgacttaagtgctggagatacctaagtaaatcagacgatttctgctgtcatggagcttatacacttatagagggaagtagaaaataaatgtaaaaaatattttcaccttttgataagtaagtgctgtggaggaaaattaagcaaggaagggtaaaggggaattctaggggttaggaaaggggagttataattttaaacagaattattgaggaagacatcactaggaaggtgacatctgagcaacaaaagacctaaaggaggtatgggaaggagacatgcggatgtcttggagaagaacattataggtagagagaagagcgaaagtccaaggccctgagaatgcagcatgtctgacacgttcaaggtgaggcaaggtgcaggtggggggcagtatgttgaaagcaaggtaagcaaagggaagagtaaaaggaaatgagatgaaaataatgaaaaagcatacgaaagcaagtgattttttcttgggtctagatttcatactggtacctaactttgcttaatttttctgttgttaataggagctgttaatgcccagtcaatatatcagagaatggagtttgagcaactatagtttaatgaggcaattaaattgagaaccgtggctttagactagttcaatatgaagaacagattaaatgtactctgaggaactgccttttaattatagatttttgagattcattttagtgtcatttttttcatggttaaacaacatggagaggaaagtaatgatcttataaaatagaagtgttcaagataacttactaggatggatcatctgtgtttgccaaatcaaacagggcaatttaaaatacagttgttccttggtatacatgggagattggttccaggactcttgagtatatccaaatctgcacatactcaggtcctacattagaccctgcagaacccacgtatacaagtttcacatcctgaacttactgtattttcagcccgtgtttggttgaagaaaagccatgtatataagtggacttctacagttcaaacctgtgttgttcaagagtcaactgtgtatcaggttagcatataaacctgttttgttttgcctaccataaaacactgatctttagattgatacaattgctgttttattcattggttcatatacacctaatgagattgctattttaattttcattgttaagacacacttaaattcctaatacttaaaaacgtatatgaaaaatttattttcacaaatcgatatacctattttttgaacagtagtatgcatattgctttacaaaatgacagtgtaaaaatggcattcagattcccgtttctaagatgcttgaacattttgatttttactcattagaagtttaattgttattagtcaacaaggagaaacaatgaggaacttacagaggagtgtcagttgtattgaaagattaggagtgaatgttttatcttgtaaaaagatatctcagcccctaggatggtctacagaaatgacaataagctccgattcttattttaattttttattttttctgtttctctgtctcctgtcttttcctgcgcattctctcttttactcccaacctctcttgtttatttctttggatccgtcaaagttggaaattgaacagtatttctgatatattatgtagtatgagttctgaaatcttggtgaattaaattcatgaatgctaccatagtgattttattaaggtgtggcttttgattacatgttcttcaagctagggttatgggagtcagctagtaggtaggcttagtttgattgtcctactttaacatttgtttttccttcttgaaataactttcatgaagttagatacaggcttttgtacaggatcattttgtgggaaatggtgggtctgaaaagtaagccattggtattgataaaagcagagagaaaatgaaaaagaaaaaaggtaggaaagatgtgccttttagccaataaatagaagtttaaaagacatgaaagaatgagatgtaatttttttaggagctctaatttagccatgaacacagccaccattactctgcagaaagggaaaaaaaggggattctgtttcagaatttgctgtattaaaaactatttgagaaagagaacactttattgaaaattgaaaattattggctaacattcagtgtgagggtatgtcgaagtaccatccgactaaaaacaaattaagtgtagtcgtgagtcaaacatattgtttcttccaaaatttaaattaaattagtttcatatgagtgttttctttttttcttgagacagggtcttgatctgctgcccaggctggagtgcagtggcatgatcacagctcactgtagctttggcctcccaggctcaagtgatcctcccacttcagcctcctgagtagctgttactacaggcatatgccactacacttggctaatttttaatttttttgtacaattgggggtcccactgtgtttcccaggctggtctggaactcctgggctcaagcgcctccagcctccagctcccaaagtgctgggtttacaggcatgagccactgcacccagccaattttatgtgttgataacaatcttgctgaacttactgtttcttataacttataggttgttcttcttgggattaccaagtaaatgtcctttgcagtagtgacactttttctttcttttcaatctaagattttgcttttttctctgattgtgtaaagttagcacttctaaaacaatactctcagcatgtattgcatgattacatactttttcttcttatattaataatatgaagtatattaattgaatgctcaatattgaattaatcttgaacttctggaatatgtcatataattctattcttttaaatgagttattatgaaaaattttaaccatacagaaaagttgaaatttattcggtggaaatctgtatatcctctgtcttaatttaacaattaacattttgctatatctcctctttttttttgttagaccacttgaagctgtttttgagaatacagattccaatacaaccacaaaaaccttaccacatctaagaaaattaatactgattctatcttatgtaatatctgttctttatttaagtttcccgaaatatccccaaaatatcttttatagctttcatttttttccaaaccaggcaaggtttatacattcattgcatgcggttatgtctctttcatctctttcaatctagaatagcccaccccatcatcttttcttctgttggacagttatactaatatgcagagatgatgtcatatttttcactacagaaaaagcactcataaatatgtataaatgtatatcgatcataatgcttgagaaggaatgggcattggacccatacctctgcactctggcttgaaggaagatgaaaagtttctagatacaacagaggaaatgataatatagagaagtccaggaggtacaaagtctgtgtgacaaagatagaaagtagaggaatgtgatacaaagggagaaataaaacctttgaatcttggagctatataataaatgttaagattcttcatactgaggttgtgaagcaggacaatagtgaagaggaatactgaagaaattataggagttttaaaaatgattacaagatatatcctatatagagagaatattacaatttctggtgaaaactatcaaatataaggggatattctccagaacgaaaaggtgaaagaaaacacctcattggcactatgtagaagaaatgggttgtaattatccaccactgcacctgccagccacgaatggctgtttaaacttcagttaaactagttaaaattacataaaataaaaaatctagtccctcagtcacactgaccacatttcaagtgctcaatagctatacatagctagtggctccatattagagtgttttcatcatcgaaaaaagtttaactggccatcactgcaatagattcaatataaaggtatgctggcttttagggtacacattcaaggtttggtagggagcctattaaaactgatcaaaatccttgattgttatttagtctggatgaatcacataggggataatgacagtgaggaagagaacacggaagcatatttagagtcctcacaaaaaatctggatgtgctgggaataataggttgtgtgtgtgtgtgtgtgtgtgtgtgtgtgtgtgtgtgactccttattgttgattgacacagtggaacaatgaaggaagatagtagaagacaagtaatctagttttacctgtgctcttctctcttgcaaggtagaaggctaagcctttgatccaggctggaggccctgaaactgggattgataggatgggcttattactgtggccctgaactgaagcccagttgagggcggcctgggaagcaaggcatgaacacagccttgataaacaaaatgagtaaaggatgcacagttaagagccaaaaagagaatagcctgaacgtgtagaaggaaactaaagctacaagggagttaaaagctggttgaagtgagtgttttgggggttttctgtgaattaataattttgaagaggaaacagccctggtgcgtggggcacattttcgtagagaacacaaagaaaagaaaacctctttggtacatattttctttcagtatttttgggcaaggagaatgatgtactttttactgacaagagtataactaaagttgccattaacagaaataaagcccagttatcataaaggaactgaagtccaagattaaagaagattatagaaaagtacttgattgattgttcataaacatattcaaatatcccaatacagatgaattttgtcctagggtattgagataacttacaaaggagattagcaaacagactatatatttttttaagacactatagagaaggagagaggttctggaatactggagatagatacatgccattctgattttcagaagggagaaatgaaggttccacaaacaataaatcaattggtttgacattgaccttagaaaagattaaaggggtgggttttgatcatctgagagagatagtagtggtcactaagaaaagattaaagaagtgggttctgaacacccaagagaggtagtagtggtcattaggagttagtatgggctcatggtgcataattgtgacagattgacttttcaagtccaccatgtactagctgtgcaacattgagtaatttgcttcatctatctgggtctcagctttcttatctttaaaatgaaaataaaaataatatctattacataggctcgtaataaagaataaatgaatttacatttgtaaaacatttagaacgaaatgtgatacataaaaagcacaatgtcagtgatagataaatagctagagagagaccaacaggctgccttctttttttttttttgagatggaatctcgctctttcacccaggctggactgcagtggtgcaatcttggctcactgcaatctcggcctcccgggttcacgctgttctcctgcctcagcctcctgagtagctgggactacaggcaggcgccctgccactatgcccagctaattttttgtgtttttagtagagacagggtttcactgtgttagccaggatggtctcgatcttctgacctcgtgatccgccagccttggcctcccaaagtgctgggattacaggcgtgagccactgcatccggccacaggctgccttctttaatcaaacttgtagctccgtgaaatgaaacagctaatgtgcaaagattgtagcagctcttctttaaaaaaattgaggtgaaatttgcatagcctaaaattaaccattttttttattattatactttaagttttagggtacacatgcacaatgtgcaggttagttacatatgtatacatgtgccatgctggtgtgctgcacccattaactcctcatttagcattagttatatctcctaatgctatcccttcccccctccccccaccccacaacagtccccagagtgtgatgttccccttcctgtgtccatgtgttctcattgttcaattcccatctatgagtgagaacatgcggtgtttggttttttgtccttggggtagtttactgagaatgatgatttccaatttcatccatgtgcctgcaaaggacatgaactcatcattttttaaggctgcatagtattccatggtgtatatgtgccacattttcttaatccagtctatcattgttgaacatttgggttggttccaagtctttgctattgtgaatagggccacaataaacatacgtgtgcatgtgtctttatagcagcatgatttatagtcctttgggtatatacccagtagtgggatggctgggtcaaatggtatttctagttctagatccctgaggaatcgccacactgacttccacaatggttgaactaatttatactcccaccaacagtgtaaaagtgttcctatttctacacatcctctgcagcatctgttgtttcctgactttttagtgatcgccattctaactggcgtgagatggtatctcattgtggttttgatttgcatttctctaatgaccagtgatgatgagctttctgtcatatgtctgttggctgcataaatgtcttcttttgagaagtgtctgttcatatcctttgcccactttttgatgggttgttttttcttgtaaatttgtttaagttctttgtagattctgaatattagccctttgttagatggatagattgcaaaaattttctcccattctctaggttgacttttcacttcttttgctgtgcagaagctcttgagtttaattagatcccatttgtcaattttggcttttgttgccattgctttttgtattttagtcatgaagtctttgcccatgcctatgtcctgaatggtattgcctaggttttcttctagggtttttatggttttaggtcttacgcttaagtctttaatccatcttgagttaatttttgtataaggtgtaagaaaggggtccagtttcagttttctccatatggctagccagttttcccaacaccatttattaaacaggatatcctttccccattgcttgtttttgccaggtttgtcaaagaccagatggttgcagatatatggtattatttctgaggctcctgctctgttccattggtcgatatctctgttttggtactagtaccatgctgttttggttactgtagccttgtaatatagtttgaagtcaggtagtgtgatgcctccagctttgttctttttgcttaggattgacttggctatgcaggcccttttttgggtttcatgtgaaatttaaagtagttttctctaattctgtgaagaaagtcaatggtagcttgatggggatagcactgaatctataaattaccttggacagtatggcccttttcacaatattgattcttcctaaccatgagcgtggaatgtgtttccatttgtttgtgtcctctcttatttccttgagcagtggtttgtagttttccttgaagaggtccttcacatcccttgtaagttggattcctaggtattttattctctttgtaacaattgtgaatggcagttcactcatgatttggctctctgtttgcctcttattggtatataggaatccttgtgatttttgcacactgactttgtatcctgagacttgcagaagttgcttatcagcttaaggagattttgggctgagatgatgggtttttctagatatggaatcatgtcatctacaaacagagacaatttgacttcctttcttcctatttgaataccctctatttctttctcttgcgtgattgccctggccagaacttccaatactttgttgactaggagtgctgagagagggcatccttgtcttgtgctggttttcaaatggaatgcttccagtttttgcccattcagtatgatattggctctgggtttgtcataaatagctcttattattttgagatacgttccatcgacacctagctcattgagagtttttagcatgaaggggtgttgaattttgtcgaaggccttttgtgcatctgttgagataatcatgtggtttttgtcattggttctgcttatgtgatggattacatttattgatttgtgtatgttgaactagccttgcatcccagggttgaagctggcttgattgtggtggataagctttttgatgtcctgctggattcggtttgccagtattttattgagaatttttgcatcgatgttcattaggtatattggccaaattttcttgttttgttgtgtctctgccaggttttggtatctggatgatgctaaactcataaaatgagttagggaggatttcctttttttctattgattggaatagtttcagaaggaatggcaccaactcatctttgtatctctggtagaattgggctgtgaatctgtctggtcctggactttttttggttggtaggctattaattactgcttcaatttcagaacttgttattggtctattcaaggatttgacttcttcctggtttagacttgggagggtgtatgtgtccgggaatttatccatttcttctagattttctagtttatttgcatagagatgtttatagtactctctgatggtagtttgtatttccatgggatcaggggtgatatcccctgtatcattttttattgagtctatttgattcttctctcttttcatctttattagtctggctagcggtctgtctattttggtaatgttttcaaaaaaccagctcctggattcactgattttttgaaagattttttgtgtctctatctccttcagttctgctctgatcttagttatttctggtcttctgctagcatttgaatttgtttgctcttgcttctctagtacttttaattgtgatgttagtgcatcgattgtagatcttttctgctttctcttgtaggcatttagtctgtaaattcctctctaaacactgctttggttctgtgccagagattctgatatgtagtgtctttgttctcattggtttcaaagaatttattcatttctgccttaatttccttatttacacagtagtcattcaggagcaggttgttcagtttccatgtagttgtgcggttttgagtgagtttcttaatcctaagttctaatttgattgcactgtggcctgagaaactgtttgttatgatttccattcttattcattttctgcagagtgttttacttccaattatatggtcaattttagaataaatgcgatgtggtgctgagaagaatgtatattccgttgatttggggtggggagttctgtagatgtgtattaggtctgcttggtccagagctgagttcaagtcttgaatttccttgttgattttctatcgtattgatctgtctaatattgtcagtggggtgttacagtctcccactattactgtgtcggagtctaagtctctttgtaggcctctaagacttggtattatgaatctgggtgctcgtgtattggctgcatatatatttaggatagttagctctttttgttgcattgatctgtttaccattatgtaatgcccttctttgtgtcttttgagctttgttggtttaaagtccgttttatcagagactaggattgcattttttttgctttccatttgcttggtaaatattctgctatctttttttgagcctatgtgtttttgcatatgagatgggtctcctgaatacagcacatcaatgggtcttgactctttattcaatttgccagtccatgtcttttacttggggcatttagcccatttacatttaaggttaatattgttaagtgtgaatttgatcctgtcattatgatgctagctggttgttttgcctgttagttgatgcagtttcttcatagtgtcgatggtctttacaatttggtatgtttttgcagtggctggtactggttgttcctttccatgtttagtgcttcctttaggagctcttgtaaggcaggcctggtgatgacaaaatctctcagcatttgcttgtctgtaaaggattttatttttcctttgtttatcaagctttagtttgactggatatgaaattctgagttgaaaattcttttctttaagaatgttgaatattggcccctactttcttctggcttgtagagtttctgccgagagatccgctgttagtctgatgggcttccctttgtgagtaacccaacctttctctctggctgccttatcattttttccttcatttcagccttggtgaatctgacaattatgtgtcttggggttgtgcttcttgaggagtatctttgtggtgttctctgtatttcctgaatttgaatgttggcctgccttattaggttcaggaagttctcctggataatatcctgaagagtgttttccaacttggttccattctccctgtcactttcaggtgcacaaatcaaacgcaatttggtcttttcacatagtcccatatttcttggaggctttgttcgttccttttcattctgttttctctaatcttcttgctttatttcatcaagttgatcttcaatctctgatatcctttcttccacttgatgagttcagctatcgatacttgtgtatgcttcatgaagttcttgtgctgtgtttttcagctccaccagatcatttatgttcttctctaaactggttattctagttagcaattcatctaaccttttttctaggttcttagcttccttgctttgggttaggacatgctcctttagctcagaatcgtttgttattacccaccttctgaagcctacttctgtctgtcaaactcattctccgtccaattttgttcccttgctggtgaggagttgtgatcctttagaggagaagaggcgttgtgttttttggaattttcagcctttttgtgctggtttctccccatctttgtggatttatctacctttggtctttaatgttggtgacctctggatggggtctttgagtggacatgcgatttctttctgcttgttagttttccttctgacagtcaggcccctatgctgcaggtctgctggagtttgctggaggtccactccagaccctgtttgcctgaatgtcaccaggagaggctgcagaacagtaaagattgctgactgttccttcctctggaagctttgtcccagaggggctctcactagatgccagccagagctctcctgtatgaggtgtctgtcaactcctgctgagagatttctccgagtcaggaggcacgggggtcagggacccacttgaggaggcagtctgtcccttagcagagcttgagcgctgtgttgggagatctgctgttctcttcagacctggcagacaggaacgtttgtttgctgaagttgcacccacagctgccccttcccccaggtggtcccagggagatgggagttgtatctctaagcccctgactggggctgctgcctttatttcagagataccctgcccagagaggtggaatctagagaggaagtctggctatagtggctttgccaagatgaagtgggctccacccagtttgaacttcccagcagctttatttatgctgtgaggggaaaaccgcctactcaagtctcagtaatggcagacaccccttcccccaccaagttggagcatcacaggttgacttcagactgctgtgctggcagcaagaatttcaagccaatggatcccagcttgttgggctccatcagggtgggatccactgagctagaccactgggctccctggcttcaactccctttccagggtagtgaacagttttgtcttgctggtgttccatgtgccactggggtatgaaaagaaactcctgcagctagctcggtgtctgcccaaatggctgcccagttttgtgcttgaaacccaggaccctggtggcgtaggtaccagagggattttcctggtctgcaggttgcaaagactgtgggaaatgcgtactatctgggccgcaatgcaccattcctcacggcacagtccctcatggcttcccttggctaggggagggagttcctcaaccccttgcacttcctgggtgaggagatgccccaccctgcatctgctcgccctctgtgggctggacccactgtctaaccagtcccattgagatgagctgggtacctcagttggaaatacagaaatcactcaccttctgcattgatctctctgggagctgcagaccagagctgttgctattcgaccatcttgccagccactatcaaagagattagttttatattgttgagtgttcttagcacctttgttgaaaatcagttgaccacagatatataggtttatttctcaattctcagttttattccattgatctacatgtctgtctttatgccattaccatgatgttttgattactgtagcttttataatcagttatgcaaccagctatgtgagtcttatactgtttcttttttcctttctattcttttttctttgatttggttattcaatgttcttaaaattctgtatgaattgtaggatcagttttttcatttctgcaaaaaaagtcattgggattttgataggaattgcattgcatttttagtttgctttgggtgatattgccattttcacaatattgtcttccaagtccatgaatgtgaatgtttttccatttagttaggtcttctttactttctttcagcaatgttttgtagttttcattgtcaaagttttgtactgccttgattaagtttattaccaagtattttattatttttgatgccattgtaaattctgttgtaaagatggattatttcatctatatctcccatctcagttctttctcttaagatcccaatgtgcatacacagagaataaaataaattgagtagtagatttagttctaagcatcctgaaaggctggcaaaaaggaaatgagatagggaagcagggtcagtgtatgtgactttctaataaaagagaagaacttttttctggaactcaactctaggagaaaattattatgagaacttttgcattagggacatgaaataacattataaggataattttaatgttttataggaaacatatttttaatattgacaatgaataaaagcccaggggatagggttataatttagctcagtcatatagtataattgttctttaagtgtttatcctttttgttaatttataagctctgtgaaaatagcttttttgtttttttgtttttattttatagagacagggtctctctatgttgcccaggctggtcttgaactcctgagatcaagcgatcctcccacctcggcctcccaaagcactgggattataggcgtgagccactgcaccagccgaaggtagcttttttggagggagactgtgttttgttcttttcacattccctagagcaagtgcctcacaagctgtttacaaaaataatttttttctgaattctgtaattaaatatctgtgaaatttataaactgactttgaaattttagtggttctttaaaatgttatttcttgattcagagaaagaatactgtatctggataatcacttatttttaaggttttggttttttgcttgagtcttgtttgtgatctaactatattgattaagttattatacatacacacacacagcagatctaatatggcatttttttttaaccacgtacttttcttgttcctgttgtggatcaaccattatttctttgtatttagctacataaaaaaaactatcaagaaatatataaaaatgtacttttagaagtattgatttctgctcaccatcatttgtcaactttgatgttagacagctactagttagctggaattcagtgccaaatgaagtcagaggtggataggaatcttttattatgtatattttttttattttccttctccttttatttttcctcctttcctcgctatactttttcccttcaccattttttttccaccctccctgcctgtgcccatctaaagtacatacaaggattgtttagcctgtttgacaggaaaaggaaaagaattaatgtatattggctggattctcttggaattttgtgagatcagggacctgaatctgaatcaggtaacatccatgatagttattccacatccccatttgctatctgattcagattcaggtccctaataacatagcatccatgatagttattccatatccccatgttctatgttatgttgtccagctcttcccttcaggactgaaagatttatttccccagctgctaggaagattgtccactgacaggtctcatcaggaagccctctcataaaattgttgaaatgtctaacgagagcctgtcttggccaggtgccaccgcactcatgcctgtaatcccctcactttgggaggccaaggcggatggatcacttaaggtcaggagttcgtgaccagcctggccaacatggtgaaaccctgtctctactaaaaatacaaaaattagctgggcgtggtggcattcacctgcaattccagctactcgggaggctgaggcacaagaacccaggaggcggaggttgcagtgagccgagatcgcaccagtgcactccagcctgggtgatggagtgacactctatctcaaaataaaataaaataaaaaataataaaataaagctgtctttaaaaagctaatgccctttttctagggcagctcacattaaatgagttgttgatttgatgctgtaaaggcttcaccctctctcaacccaatttaggacaactctgaagggatgtcttagttgcccttttctagttactagactaggatgttttaaaagctgaggatataaacttacctaaatgtttttgtattcttttgctaatgagaaataatctttcactggtgtcatgttttgagatatttgaaagctatccttaggctcatttagctgtcacttaaaatattaagcattacataaggttaaaaaaatggaatagtggcaagagtatgacccagaaagcatgagtgaggctgaaaagaatacgaggatcctttcgatggtaattttggaagatcctatttgaaatagtgatcttaattatgtagaatttcatttccatctctatggctttagtcactgttacaggacatttttgcatcactataaaggaatacctgagactggtaatttataaagaaaagaggtttagttggctcatagttcttcaggctgtacaggaagtgtggtgccagcatctgctcctggcgagtgcctcagtaagcttacaaccatggtggaaggcaaaggcggaggaggtgtgtcatgtggcgagagccagagcaagggttgggggaggtgccatgctcttttaaacaacacaatctttaaaacaacataatcttttaaacaacacagtcatcaccaaggggatgatgctaacccattcatgaaggatccagccccatgatctagtcacctcccagcaggccccaccttcaactttgggaatcacatttcagcatgagatttggagggataaacatccaaaccatatcagtcactctgttttgtttcagagtgaatgatacttacagaatcatagtattgtaaagccctttgatttgccacttttgactagacttacacaacataacacaaatatcaaagcctcaacattgtaaaaaataatataacatgaaagtgagtgagtactaggaagagtaagtgctgtcatgtctttctcccatagagaagacagtcagaagatagcctaaacagaatctgttattcattgtggttgactccaggggatagggacaaagggaagtgtatagttttcattttaagcctttatgtgctgtataaagtttttaaagaagcatatcgtgtgcataatccctaaaaaatcaagcaaccaaaatgtagtggtgatggtgggatgtgtgtgtattgggggagggaaggaggggagaatggcttaaaaattaattcatttaaaatatttcttattttttaacttccatattttgaatcaaatgatttgcaaaaataatggattgttttataaacgcatgtaatatacatatttaagtagcaggtgtttcataaataccttgttatagaagtgcacacatttctgtgtttcagaattcaaaagcccctttgaagaaatagtcactatttgacttaccacatacgtaatgacaagaaatttacaagtataattagatttttagtgattaaattgtgcatataataattttaccaacatagtatagcatttcctttagcatttattatattgtaaatgagtgttataagcgagttataacctaaattctttaatgtaacctagttctttaacataatctaaatggtttaacataggcataggcctataatattagtaagaatagatcatatggtttagaattattttaaaatgttgaggattacttcagatcttattactgtaattccctatttgtgatgggtagccgttctgtgacctattaattgttctcttggatatgtagctgtttatgtttcagattggctgcagctgttttgatttgaggcagatggcctgaagaagcagcattcataaattaaatcacaattttttttctatgtatttttaaatcattctcagaaacctgaagtcttttcagtacagagttaatttcaaattcataatattctttgaattttcacataatatattaacttgatttttgtataacaatattcttttcatttttgtgaaatacataattgctaacttattttaacatagacatgagctaaagagaccctaattatatttttacacaaaccttatacaattatttaaattctgacccaaatagcagaatggttattacactgattctttaatcatttcaaaataggaacaattatttccaatggaattctcactttctaacttatttagttctctttttcattcattatggttttggaaagtatctgagacagctacatttattaactacactatagttaaggtaaaaagataatggtctttctcgtcattgttgaaatacccatactaaaatgatactattaaaaaaagagctaacttccttttaaggagtggtctatagcctttctcttttctttcttttttttttttttttgagacagagtttcgctcttttgcccaggctggagtgcagtggcgcagtcttggctcactgcagcttccgccgcctgggttcatgtgattctcatgcttcagcctcccaagtagctgggattacaggtatgtaccaccatgcctgtctaatttttgtctttttagtagattcggggttttgccatgttgctcaggctggtgtcaaactcttggcctcaagtgatgcacctgcctcggcttcccaaagtgctgggattacaagcgtgagccatccacgcctggccaagaactttctatttttgtataaaactttttttttaaacatagattggtacatatgtaaatgaaaagtaatattcatgtagaaagagaagtgaagatcatctagtctggcctttcagtgcttgaatttccttaaacacattaactaaatagtaagctagcttatgcaggtactgatccaatgatgagtaactctatacctctgaagataatacattccatctttggatagcattgactagtgaaaagcaaatagttatactgaatcaaagtcagcttccttgtctttctttttgtttttaacctgttggccctagattctttggggctacacagaacggtttaagcagtcttccttatgacaatcataaaatatttgaggacagcttttatgactccacaatctctcttaccattcctgaagtttcttctctaaataaatacttttggttccttcagccattcttcatatgtcacaaaggccttctctgttattcagaatatactgcagatggtctctactaggagcagaatccatgaataggattcaggaaacccatggattttgatattagtcagggttgtccagaaaaatagaaccaataggaggatatttacacatgcacatcctcctatatcccataaatatatatatatttatttatatatatttaaaatttatatatttatagatttaaaataaatatatcccatatatatatatatgtatctttgtggaagctgagaagtcccaagatctgcatttagcaagctggagaccttggagagccagtagtgtaagttccaatctgaaagctggtcagcttgagacccaagaagagaggatgtttcagtccagttctaaagctggaaaacaccagtgttgtagctcaagctgtcaggcaggaagaattcctcctattcagccttttggttctatttaattgattgaatgaggtccaccagcagtagggaaagcaatctgctttactcagtgtactgcttcaaatgttaatctcatccagaaataccctcctagatacatacagaatagaataatgtttggccaaatgtatgggcaccttgaaactcagtcaagttaacacataaaattaactatcacaaatatgaaaaatttgtatccttatatttactaacttctgaatgagagtttatgattatttcaaatcataaatttgaaaatttatgattgtaagcaacagaccactatagcaaaactgtggcttcacaacagtagaaatcacagataactttatatccactatagttgttgcagatatttggaaatattgacattcattggttcttaatgtgaatattatatataatttcctaattataagaacatatattattgaatcatgtttattttaataatatttataatgtagatatgatataaattttattgactgattggttttctctgttttcttatgcattaaattttatgcttttaagaatattattttgaaaaggatccataggctttactagactgcaaaaggggtccattgttcaagaagtggttaagaacctttggtctatactttttctaaaagtgtaattttagaaaggaatacattttatgggtgtggcccattaacactgacataggagtagagattattatctccctgcatctacataaaataaaccaagatctcattcattttttttaggcagccagactgatcacactagttggaattagtccatcttttgattctagcctggtcttttcagaatcactctgttagtgtgttccctgttctacgtttctgtcatttacaaatacaataggcatgttgtctatatcacagattaccaaacctggctgctcatcagaatcatctgaggagttttaaaaaatagatttttagttcctccctcacatttagtcagaaacattgtgcacctggtgattatgcaagctgcctggcactgttctgtgaattcatatttggaaatcccattttttatataatttatgtcatttatagtaatatttttaaaaatgttatagaagttagaattttgtagtgttgcacttgctaagtctttccaggttgacctgcagcaccctggaggttccaatgattattactttatatcattactgtaattcattcttttctgttttgaatcagtttgtttcaagaaattgagtgcatctacctaatttctctgatacgccatctaataataaatcttggcaaaaaaggaaattgtcactcatttttctagtgagttgatataaacttatactaatcactacctcttcacctgatttgtcataaattattccttaaaacttgtttgtaatcagttgatatcagccgtattgttttggtttaagtttccctaaaagtcaagcatgaaacaaggacagtagtttatttgggaagtgatcccacaaagtgggaataaggaagtggtcaagagtgagacagggaagaaggaaatgccaatataagactatagtattgtagtggtagttttgacagcagaaactagattctgctgtgacatcctgaaaagtgttcagaaagcttcctagactttctatctgaaagataggcaacgagatttatctatcagctcttgttctttattggtcaaagattccctccatcccttaacctgggaaagttaactcacccatatttccaggctgcccttgctaacaggctgagtgggacattgtagtgccagtgaaaatcctgggacagaaagtggaaagatggtgaatgcatctttgaagtggcagtctgttaatgtgaggtaaatcttttcaggaaggttcaccacaagtatgacaaaaagtggactgagggactgtgacatgggttatcagtggtacttgctacactcatcttctgtattctaagaaatctacttttttatttttataaatcaattacatttgtttgtttctaagagtctttaaaggttaccaataacctcatgtgctagttctctcagtatcctgtgactataattcattctgactaagaacttggagtgacttacctgtcttgggctttagttctggcattacaatgtttgttcagaccttttcagtttctgacagagaaaactgggacaatctaggagttaaagagttttactttctctttagtggtattatactatcttctgaaataaggctttgttgttgttgttgttctatcttggtttaatctatcaaagaaaagaaaaagaaagaaaattccttttgttgtctcttgaactttgcaagccataggtaattttgaggtttgggttttttgagttcactggttaaattctttaatttcttttcccagctctcttctaaagttcctccctccttcaagttttatgctatggagtcatggctgtcttttctgtgagaacgttgaaatgttttattaaattttaaggagatccattgaatatatctagactttttctttatttgtggccatcacaaactctgagctgacatggtcactccttgcattttctccttgattctgataagccctggaatccttcatttaggtattacttgtctttgtacaagtcaaaggctactgttattcagtcacttttgtcctcctgccccattcttaatcttttttcttttgccttacccctcttttccacttcttctaaaagttatctagtattctagtataatctgttgacttttgctttctaaactatctactgtttgctctcatttattccattgctttgggatgcttattcagtgaccatagctaaactgataaactacttagtcttcaggtattaaggaatgatagtgtgtggaagtggtaagataacatatttgtgttttgtcaggagtctaggatccctgtttttcccctttgtttccctattcaccatccattggatcataggaaaaattaactgttaatgtaagtgaaaagtaacttagttctttggagggagagatataaaagttttgactcaggtgattttacaattacaagcatattttcagtatagatctttttgagtgccttccatgaaccacatactttattagtcaccgaggataaagaaggccaggaatattgttatcaaagaatctaataaaagagatggagatgtaaacaaatacttgaattttaatgtcgaagttaaattgaatgccctaaatgatggatatatttttttatgaaatatcttctgtaataacatgatgttctgataattcttgggtttataaattgaatcatttggtgtgtgaagttgacatattattctcagatgccaattctgatttctccatgctgaaaattacgatggtaagaatccaatagctttgatttccttaggtaaatattaggctaaacatccagtgctgtatcttcagtattttctaccaggcagaagaattgttatttttatgcctctgtgtttaaatgatagaagtaagatactttaattgaaaagagaataaaaaacaaagtatcccttttagaggatgaaaggggagcaggaactccccaggtttttaaatattttagtacataaaatatacacaacaacttaaaattgttacttttctgggaaaactgaagcacatgcaggagattttaaaaactccacttgatgttagatgattaaatagtgttttgctttggaaattgaaaagcaagacttgttataaaaatagttcattccataccaataaaatcttattggcttgtttatttttattttgtaataagatagagtgaatgtggaagcttgtgttttaagaacttcttgtcctgtttagattatgttaaataacatacaacattttttaaaacagcttttataaacaactaagactttagacaaaggaatatgagtatgtgatgaggcttgacccaattaggtaggcaaaaactttaaaaaatatttcatggcatagagggagaattagttcactttttattaattacttgttcttttctgagttacatgtatatttatgggaattaaatatttaaataattgggtaatttaatgtgataatctaattttaccagccagtttctttagcattttaattttcactgttccttaactctatataaataaacaaatcaagagaactcattattattaatatcaataatactaacaaatcatgctaacatttcttgagatcaatctctagagtaatatgtaagctctcatgtgtattatctcacttgatgtctcaataacctgagtgtgtagatattattattgctatgttataaacgacattacttaaaagaactctgtagtaaatcctttggaaaaataaatagtgttttggaatgtgagcatgcattcctcaatttatctattttatacatatatacttttgtatatgacaacgttttgttaaatatgctatttctagccaggtgcagtggtgggtgcctttagtcccagctactcaggaggctgaggtgggtggatcgcttgagcccaggagttcaagtccagcctgggcaacattgcaaggctccatctcttttaaaacaaacaaacaaacaaaaacagctatttttaggtctcttcatcctttattatttttatgaatgtcgccattatcttttgtgtctgctcagatttgaactctataggctcttttggctttgctccccttcttctctttcatgccctcttcaaaccaggaagttgcacagtcttggaaggacaatctctgtaatatttctcccattatctgttgtactttttgagctcaggactgagattgaaatttttctgaatgagaagaaccaccctcaaccacgattactgaacactgagtgactttggaagttaacttttgctgcagacttgataaatccatcctaaagttacaaggaataacagtttaaatgcaaaaatcatgttatagtaaaagtcattttgatgacaatgaatgttgtttgagtcacaagtaatgtcaagccactgtatatgtcacatcttgtcaaaagttaaaacaagaagttagatgtccattcccacacaaatttatggcagatacattttctagataaaattatagttctagcagcagttttcaaactaaaatacaagttagggattttccgtatttcaaaatctgtttaactgtgcaatcaaggaacttccaggtaactgtcaactggaaatgattatttacagtgtaatgacctgctaaaagtcaggagaagaatctaatagaattttataaataccttgtaagtgaggaatatacttaaataaaataacgtgcctgtggactggtatcaatatttggcagtgcttgtctgcgtgaaaagacattttcaaaaatgaaatatgtaaaatctcattacagatgaacattaacagataaacgttgattttgatgatagagaacaccagctttgagtcccaattaaaatgaaatactctttccccaaaagaattccattcttctcattggaagacccacattacaaaacattatattcacattattatattttgaattttgtcgataaaaactttatggaaatatatttgtattgtactaggtacctacataataaccttgattttgtctcttgggcattaaagtctaaaatatttactatctgacccttatatacaaagtttgctaactgtgagctaaacaattattcattcttttaagtgagctcatacctatcaaacacagagaaataagtctctactggtagagtttcaactattagtgttgaaaaaataattctacatcattcccagaacagactttagatgattatttactccaacttaacccattttacaattattttacaattaagaatccttattttacaattaagaatccaaggtttaatggaagctaaacattggtataactgaaaatggaactgagatattctcattttccatctagtgttctttctagtgaactttatttatatgcaagtgtttctgctggatactaagaatgataaaaaagaaatatgagaaatggtgtctatatcaagatatattataatctagttggggagtgtatcagtcagggtcccagcaagaataatacactccaatggactagttgagggtcatttaatgacagactatttataaaagggtggagagagttttgggaaataggcttttgccatcgaagcctaaagagacaaggggtggctataggagaggcccctcaagaggagctgtggcttttggtggaggaatccaactactgtcaacccacgctgtccagaaaggaggtgataccccacctacaaataccttgacctcattctcctcctgccctttcatctcctgctggtgcctcccgtagtcctaatcctgccaaaagccacatggcaaataacctttggatggagtccaaaaaggttagtctcctaaggaaaactgcgagttagagagtggatctgaagggacaaatggagaatatccacctcagagagcaggattacttgtatggtaatagcacatggtaacatattctaagtgcatgagcaatctggactacatatacttaatagcatactgacacacaagatatcattttaagtgcttattttttttttttattatactttaagttttagggtgcatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgctcttgcaatagtttactgagaatgatgatttccagtatcatccatgtccctacaaaggacacgaactcatcattttttatggctgcatagtactccatggtgtatatgtgccacattttcttaatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgctgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccacttgttgatggggttgtgtgtttttttcttgtaaatttgtttgagttcattgtagattctggatattagccctttttcagatgagtaggttgcgaaaattttctcccattttgtagggtgcctgttcactctgatggtagtttcttttgctgtgcagaagctcttgagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccggtttcagctttctacatatggctagccaattttcccagcaccatttattaaatagggaatcctttccccattgcttgtttttgtcaggtttgtcaaagatcagatagttgtagatatgtggcgttatttctgaggactctgttcttttccattgatctatatctctgatttggtaccagtaccatgctgttttggttagtgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttcttcttgaagaggtccttcacatcccttgtaagttggattcctaggtattttattgtctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatccttctcctgcctaattgtcctggccagaacttccaacactatgttgaataggagtggtgagagagggcatccctgtcttgtgccagttttcaaagggaatgcttccagtttttgcccattcagtatgatattggctgtgggtttctcatagatagctcttattattttgagatacgtcccatcaatacctaatttattgagagtttttagcatgaagggttgttgaattttgtcaaaggctttttctgcatctattgagatagtcatgtggtttttgtctttggctctgtttatatgctggattacatttattgatttgcgtatattgaaccagccttgcatcccagggatgaagcccacttgatcatggtggataagctttttgatgtgctgctggattcgttttttccagtattttattgaggatttttgcatcaatgttcgtcaaggatattggtctaaaattctcttttttggttgtgtctctgcccggctttggtatcagaatgatgctggcctcataaaatgagttagggaggattccctctttttctattgactggaatagtttcagaaggaatggtaccagttcctccttgtacctctggtacattttttaaagtacattctttatctgcacaacaagtttaaatctgcaccacattcctttttacactgacatctggaacaaagttcagtctaattgtagttcagtagtagttcagttctaaattggtaggccacttctgctgctgcataaagttgttccactgtctatcagaagtagtttttttttttttttttttgagacagagtcttgctttgtcgcctggttggagtgcagtggcgtggtctcggctcactgaaacctccgcctcctgggttcaagtgattcttctgcctcagcttctagagtagctgggactacaggtgtgtgccaccacgcccagctaatttttgtatttttagtagatacagggtttcaccatgttggcccagatggtctctatcttgtgaccttgtgatctgcccgccttggcctcccaaagtgctgggattacagatgtgagccaccgtgcccggctacagatattgttttaagtggtttagagctcagcttcaggaggaggctaagtagtaagaagcccagaagttaaataatgcattgctattgtttatcagttgaaaattcattattttgagatttttataaactggtcgtttttataggatgaaagagacttacataatagagattctcaacctaaaaataaattgtgagtattgcaatataatattgttgttaaagttatagattttgtagttagagaaaccacagtatgattctggctctgctactgccttgccctgtaagtctgggcaagttgcttagacttgctcagccacagtttatttaaaagtgaggacagccacaaggttgtttcaagttttaagtgagataatggcatatagtaagcccttaatagatgttagctattattagtagtgttcatagattctataaccaaaatttcaaatttataatggaacaagtgatatttataggttaaatcattctacagatatttattaaacaatgattatgtgctgcgtactcactgtgctagatgctataatcaaagtaggaacaaatcagacctcgacctcctggagactgaaggtgcataatttgcatctgatttatattaataattgatgaattagtaaacagttcctgtactgacatatgtgctgccagcctaatgggttacttagttatcctcattgaccatcagcataccaaaaagactaggatagtttaaaattgtttttcttcaaaatcaagtttaatggggttcttatttaatatttcaaagtacataatatattcacatggttcaaaatgcaaaaagtggaaacagtcataagttgacaattctctttcgcattgcttagttctcaacttaccccacaaaagtaaccactgttctcagtgtgtatacatattcttttggaacattaaaaaaattgacatcacagttgtacatatttctgtggtacatgtgatattttaatacttgtatacattgtgtaacaatcaaatcagggtaattgggatatccatcacctccaacatttatcttttctttgtgttgggaacattacagttcttctctctagctattttgaaatatacaataaattgttcttaactgtaattttcctgttatcctatactagaacttattccttctaggatttttttttagttgtcttgtgttcaagaattagcacaatttatcattgtgctagactctttaatcacagtaaaacactagacttgtgtatttgcttcctaataaacgagcagcgctattaatatagaaaaaagaccgttgaattaaaaatagaagtctttaaaaattctagtagtacattcatcattgaaagactttaattatcatctgattttcctttctatgccatttggaattataaatggtaattttttctttgtgtggcactaccaaaaagtgcaatgtttgggaaaataagttatttcacattgaacagtagttagacattgtgctcagtttagataggattacttgaagcttggttttgatttgtcagtttctttagcttatacctgccattttgtagtaacagtcaattcagtattatattattctcagattttattattttatgctattttttacatgaacaattagtatttaatggtcctttgtaaagttttttctcaaaatgtagtgttaatttgtctgcatgtttaaagtttattggaaaagttattttgcctattcagagcgtaaaacttttagtacattttgttttataagtataggataccatgatgatccctggggaatctgattttttttaacagacaagaggttcccagttttcatttttaaatcaagttgctatggggctagcatctttgtttgcttaattttaatcacaattaccatgacaaaacttatttatttagctaatgcctaacagtgtcaaatgtatactgctggaaactggactaatttctatctgactaataaaaatcccaaataaaaatggtacatttttattttaaatggaaaaagattagtttctgaatataaattgagtttttaagtttttctttttggttaattaaagtctactctgatgcttttttgttaattttctttaatatccatatctcctaaatttaatatgcagttctaaaataaagacaagtcagctgggtgtggtggttcatgcctgtaatcccagcactttgggaaactgagcctggcagatcgcttgagcccaggagtttaagaccagtttgggcaacatggtgagaccctgtctctacggattttatactttttttttttttgaaatgggatctcactgtattgcccaggctggttttgaactcctgggctcaaatactcctcctgcctggtactacaggcattcaccaccccacccagctgattttgtacttcttgacaggaaaagaaaaatgaacaagaaattccttaatgcatattttaagtgctgctttaaaattttatcagtacagctttagaacatcacgctagataatagtgttgtactgttatttcctttttaatttattaagaaaaaggaagatgcaggggaatgaatctttattgaactttcctggcctgttcaaggaatagtaaataaaccaacttagctggaggggagtggagagggccttgtaggccattgttaaaaccttaggcttttactcaggttgagatgagaagtcactggagagtgttgaacaaagaagtgacattatgtgacttaagctttaagagggttgctttgctctgttgagaatagattctacctgggcaagaaaggaagcaaagaatatttaggaggctttggtaatgatttgggcaagagagcatgatggcttaggctagagtgggagcaatgaagatatgataaatgtttatattctgtacatattatgaaagtagagataacaggattttccagtgtgatgtgtgagaaagaggggagttatatttttggcctaagccaaggtaatgatgggattcccactaactgagatgagggaagactatggggaggaaggtcagttcagttttggacatgttaagttcaaggtatctattagacagccaactggagatgttgagtaggctattggatatataattcttcagctcagagaagaagatacatatacatttgtgagtcattagcttattgaaggtatttacacccacaaagctaagtgaaatagaaaagagaagaggtccaagggcagtgggggtcacagcaatgttaaaacatcaaaatggtaagtaagactcagagaggagactgagaaatagtgtccagtgaattagaaagaaatctggagaatgtaatactccagaagccaagtgagaaaaataatttcagggaggaaagagtgttagattgtgtcaaatgatgatggatcagaagtatgaagagtgagacttgaccattggttttaacaacattagagacctcatcaagaacagatttaatgaaaaagtgccaaaacctgattagagtcaacttaccagagaatgaaaggagaagaactagaaacaaccaataaagacaactcttttgaagaattttacagagaaatgagatagtggccgggtgaaagtatgatcatgataaaggggtgtgtgtgtgtaatgaatgtgagatgtgagaaactgcagcatgtttataatctaattggaatgatttagtagagaaaaaatgatgatgagagagagaattgctgctgaaatatcttcaggtagggaagagggaatcgaatctactacatttatggaaaagtagctgtaggctggagcacagacagttcatctgttgtgacagaatgaaatgccaggtatatggatacagatattagaaggtaatatgatgatttgataaataaaaacaaggtctaggtagatactttccatttttgaaagaaatgtgttataaaaattattaccattttagcatagtggaaaggaatgaaattggagggagataaacctgggtttagattttagctctgccaattactagctgacatgtggcagaacttagttacaatgcccctgtattatttagggacccagcaagaaataaaattcactaaaaagtggttcaaataaaaacactttaatgaagagtctactttgagagaatgaacagagttaaggaatgggcaagatatggtaaggcaactagaaactagcaattatggaaagctgttacctcacctggggctgaagaggcaagagtggacatggtgtttttagtttagtgattgccaaaggtatgaaggaaggaccagctagtaagagctatagttgtggaggaacacagctgttgccagagacaatggtacataggtaaggaagcagcagagaagaaataaccttgatctctctctactcctcaactctatttttctgctattgacctccattggctaaatgtaagcagaaaccagctgcaaggcttcttaggtgttgcagaatatagggttcactctccctagggtccagagaagggcaaaagatggatgtggagacaaatgctgagtaatcagtagaatcactaagcctcaacttctccatatataaaatgaggctaccgcaaagttgctgtgatgttacatgtactgccaagcactgctacattgctagcatatagtactgtttattaaatgacaaatataagatgctacagcataatggttggtccttaaagctttggaattaggcagatctagatttaagttctgtccgtcacttactaatcatgagattttgggaagtctttgttttgtcatctgtaaaatggggaaataaggcttaccacagagaattctaataaagatgaaaagggacagtgtatattaagtgcctaatatagtgctggtacacagcatgcagtttaagttaccatgaccatcataatattatatgactagaaagaatagtaaatgacatcagtttccaagtaatactagtctcctacccctccccctccccccacactttttttttctgcttctcagtttttctgaatagggttatttctttgttacatagggttcaaggttaatatctttgcactttaaacaattaggaaatatagctttagttagtttaactttttggctattcatttattttgtttttgatttatgttcgctaaacacacacaaagagttaagtggatttttttattaggcctaagttggaaggcatagaaaaagttggaaacactgaattcagtcagtttcattagcatagatttatatatgaagctcaagtaaaatgtcatcaagaaatgggagaatataggatgctgtaacagttaattcagagccgtactataataagtattctttttaaatttcacataaatataacagttctgtaagcttgatttgagggcacatacatgtttttctttttggctacatagagaacaatgaaataaagcctcattgacgtaattgaacctgataacatctcctggttgtactgctgatgtttcactgtggttttggtggttttgtagagctccgtagagcgtgttagacttaaaaacatattcaaacagaaacttttatcaggattcaactttttaaccataaagaaaaaatgaatgtaaataaaggtgcagtcttgggtacacctagatcaacttaaaaatgtttaatagtatatattacttagagaaattactgttccttaattagttttgaacaaataaccacagtatgaaaagaaataataatttctggtattgtattatatattagcacagaaggaaagaggtaaatataataatggaagctcctaaaaacagcaagttaaaattttatgctttcattaaatgatgtcttatagtttgatagaactacatgtttaaaacataccatagcactataactttttgttttaaactgggattaaaaatttaattttatttattttatatatatatttataaaattcttatatttaagttatttacaagatctactttggtattgggtttagatgcctaaaactttgctgacttggaaacaatgtgtatcagagcatttactgtctacttggaagtaaaattttaaaagagctacattttattatataggaggaatgagtgcttgaaccagtatttcttaaaagttttaatatacatgtaccgccaactatgcattccgtatgcgtggtagctacccaccaacttaaggtaaatgtataaaaaagaattaatcacaatttttgaaaactaaaaaattaaaatattttatatcagtgtatatttacaatattaaaggtatctctgtttagctcaatgttgagtaaataggctgcttgttgtaggttcattgtatatcgtcatattcttttctcatctctatttctcttaacttggaaaaatccaaccaaaattataatttatgaggacagtcagcaggggttttttggctgttggttctgaatactcaggttaaacatggactccagaattaagagattgctcactgaagactctttcaaggctgagtcacttgctaagttgatggacattatcatacttgaaagtttaagaaatagaggcttttgcattttattgaaaaaagctctttttgctctttatattttatatttacttttaaatattttatttgctcagtttttccaaagcacactgaaaagatgtatactctgtatccaaaaattgagtgcatttacatttatgctatttctttaacattgaactcagcataatgtattttaaccaccagcctctttctgtgaaaacaaacaaacaaacaaaaaaaaaacagggtatatagatttgcagttagtgtagtactcattgcttagcaaggctttttcttgatgtgcagacaactgattttttctctcaggactgatttcatcacatatttcccagtctatatcatagtttacaaaacaaatattaagtaggaaaaaaaatcatgttttgtagtatgaatttttcagaggtaaacacaaaaacttgtctgctattcttcctcaagtgtattacacatataccaagagctgatttggctttgcacttcagtgcatttatcaagcagtaaagtaaaatatctggtttttctttcagcataatatttatcgtttgtgtggctgagagttttataaatctctcagcaatagtctatcttttttatatgcttttgctaggaggagcacagaatctgaatggtgcctgtgtagtttttgtctcttttaggaacaaaaatcttcagtttcatatatgaaagcattttgtgcttgttctagaaagattctgttcatttaccaaagaggtttttatgttttgtttgaaaactttccatagcttcatgtcattatttgataaagtttcaaagtagacaacatccagaagaatatagggtaaatgaattaccagtcagaaagaaatccagcttttagatagttgctattgtatgtgctagtaaaatttttgtttttatctctttgtgtggtattatcacatgcacagatttatattgtttgcattagagtcctattcttgatttaggttcaacatttattccgagctatttatgttaccctatttttatcaatatcttaggctttaaaaaccaattttgagccatttatttattgattggggagtataatgcaacacaatgaaaataatgcaaatttaaaagatataaataatattcaaatgatgtgaaaatacttcaggtaagatgatttgttctcttttagaataatgcaggtcttagagaaccttttcagcttttaagaatataagtttttaagataataatgagatttctgcggaaatcaaaattaaccttatagttcacaattatgaaatatatgcaaactaagttgtttcctttttccctctaaatattctgggacaatgaggaacaactagtgattgacagatcataatttgataaataatggctaatattctattacaatttcctagtttaaaattttatgtttttaaaaatatcatatatatatttttttcgtgtatacatatatgtaatctaatactacggagacacttagcagtattttcattaagtatttgctctttgcatatttctcactttattctgtcattagttctcccactgttcaggatcattcctatcaagtacaagcatgctttagaacctaccatgttaaaaaaaaaagtattattcccacatttttttctgatgattgcttcatttcattcttgcctttacagcacagtttttcaaaagagttttctctagtcactttgtctacttccttaccttcctaaattcatcttaacttttactaaagctgaacaaatatttatgaaatatgtgtaaagtacagagactaaagaaacagacaccatcaacccaccattactggtgtttttgaacattaccattaacattgaagttccctgtatgtcactcctggatctggttcacttctttttcttttagagataatcaccatcctgaatttctttacagtttaccataagtatttctaataagcatatcgcaatgtgtatttcatgttaaatgagtgaaggtatactgtatgtatctgtctgtgacttgtttttcttgttcaacattatgtttctgagatccatccatatacgatgtagctgtatgtacttcattcattttcactcctatactccattgtatgaatacatcaaaatttttctattttattgttgatgaacatttgggttgtatctagttttttgctaccctaagctgcacagctatgtgcattcttcctgtctccttctgtcaaactgtagcaaaggaccaagcttttgggtttttccctgatctgttgtggattgatgcttttgtaaaatacactaaaaatgtctcaccattgtcaaattgctataaaaatatataaacctttactctgaatttctgtatttatcttattatggaccacactttgaatactgctctaagatgtgtacctagctgtggaattcctgggtcattcatcttctattacttatggagaaaattgttttctcaaaatcactaatgtgctacttgctcaaattacgcagaaggcagtctgctagctctttgtggctttctgtgtatctgctttcaattcctaatatgaaggggatttcacagtaagacctgctgctttagggtaacatagttttcatcctagagaaagtgactgcaaataagattgggctttgcttaagaattgattcaaagccaatctagcaagcacaagtgagagaaaactatgataatgggataaagggccaggaagagtgaatttattgagggagatggtctgtaatattgtaatactacaatattgtaatgtacaatattgagggagatggtctgcaatattgtaaaaatataatattgaaatattgtaatacaaaatgctacagtagagagatctaaagagagcaagcagagaaaaaagaagcattgtacatagtaagatttttagagacctttaagagtccagttaaaatagggcatacattccttctcatattagcagccttccttctgcataggcagcctttaattgtctaaatgcattagagaactttcacaaaatataagctaagatgagattgctcttataagcaagcagcaggactactttttatcagtgtttctccaccgtattttgattacaactccgaatccagggatatatatatatatatatttatattgtatatacatatgtaaaatatatgtacatatattaaatattatatatacatatattatatatatgtttccataatcatctcccccttcatgtaattttcataccaaagatgtacagtatatctgtttgtatactgtagcctttggagggctacgaaccattttaattttcaagattttttttttttttttgccccaagaaccagctaccacttgcttggaagtgatagcaccactgttgagagtatatcacatgaatacaaacatggctcttggcattagagtacaaatatttaaaaaggtaatgtttatttaatcatgtaggtcaatgaagtggggaaggcagactactcaatgttaagaaaccatcctaatgaaaagtatacttgagttagccagaaatcaacttctacttagagttgtgagtcagggaaataaggtatacaagtatttgtctctgtttgatggtattattgtgggaaaagtgtagaaatgtggatcagatgatagtacagttaaaaaagttagcagaccaagaatgccaattagttcattgatgcctatctcataggtgatttttagtgatatatcgtatggctctgttttcactcctgtctattctagacatctattcgtgaacttaagaaaacatcagatttatagatgttatgataatgggaggaatggagaatagggtagttgacattctcaatctccaaagaagctgacaggctaaaataagggcagaagtaaagtattgcagttgggtctaaaaagccatatttataagaatagcatggaggaaaatggatcataacaatatcatgtataaaagaaacttagggattttaggttatgttaatcttaaggagcattttaggaagctattaacatcttaatttgcaataattagtgtctcttgaatctagattatatgctgattaaatcacaacctgaaataattatatcaggaccacatttaggaccatataaaatactgcttaaatttaatgagtctgttatatatatggtatactttgcatgcagttatatcagagccattttgtgggcactggttcacaagtcttctgagtgattgtactgtgtctgaattttctttgggaagaaatagatttttcctcagtggtaagaaagaaattacgttctgcaaggatattgatgaggagatggtgataatgataattgacagttttttgagtgattaaacatgggtgtattatgtaaaatatgagtcagcaaactgtagtccactgaccaaatgctgccagcagactgtttttgtatcacctttgagctaataattttttttgcattttaaagggttataaaacaaaaacaaaaagcaaagaatatgccatagagaccttatgtagccagcaaagcaccaaataagatcttttgcaaccagaaaacttaagcctgaaggacaaaaaacaacacaaatagttcaatatatagaaattatgagattatattacagattaactgggctcatattcaatacaggttcaaagctatgtacaaaatggctattagaatgaattatttaagcaaaagaagacctatttaactcagtaaatgtcaaagaaatttaggattgatgataggtagcagttatagcttcctaaattaaagttaattttatctccttgggcatagtgactactatattgggttgggaagcagccaaaaagcttgttaggaagaagggcaggaaaaaaactagtctgggactaaagttaccattgataagctaggctatcaaggagacagacaggaaaacaatcactaattatgtgcatatcaaaaggggtatgtgctgcttttgataagtctattcttttatacttaatctaaccccaaggacaacaagcttttcaaaatgtttttgacagaagtaccttattggtaggaaaatagcatcacccatcacccatgatgagcctttggagatggtgggtaggcagagaatatctgatgatatgtaatttttcttttattttttgtgacttaatgtgattatggatttatattttcctttttgtggtagtatttgaaggttaatatggcttgttttagttactttattgtgataattctttattcttttgatttctcaattatagattatattaatgaaatattctgtcgagataatttttattttcaccattccaatatctcttccagattttgagctatattagataattataattgaaaatgctgaattttgtctttacatatacttttttgtttatttttggtttgtaaccaagtgaatttttttttctagatgattctttgggattgggacttaaaacaatggtataagcctcattatcaagtaagtataattaatatctgtgatgaatatctaaataatatctgtgatcactaaataatatctgtgatgcaacttttgacacttaaagttacactcacaatatttctgtgccataagattttctttaactaaactaataagttaactagaaccttcattgaggtagattttttaaaaatatattttaattataagggaaaaagaaaatgataaaaacaaaatttatataaattgttatgaaaaatattgctaatataatctgggctcagaatcaactaatatttctatattaaggataagatttttttcttttctgatgtggaccactgttctataaaggggaaaaaatagatggaaggccatatctgagacaaagcaaagcagttggcaacatattttattagggaagtaaagatatccaactttcattttttggtaaactttttatcaaattataacatacatgcaggaaagtgtacagctcaattttcagaagttaaacatcccatgtaactggtactgatatgaagaaatagaatgtttccagtatctcagaagcctcacatatgcccaattccagtcattacctatatccccaaagataaatcctatccgacttctaataactagttttgctaatttttgaactttatatatacacaaatggaataatatgtgtacttttttaggattaattttttgaacacctaagtaatatatgtttatatcagataaaatgaaaatagaagtatttaatataaggagaaaaaaggaaaatcactcataaaacatcaagcaataactgtgttaacttttgatgtctatctttattgatctttcccattatgctaaatttacttaataattctaatagcttatttgaagattctttgagtcttgacgtacacaaaaatgttatctatgaataaagacagatttatttatttatttcaaaacctatgccttttatttctttttctcatgttattgtactttctaggaccttcaacgcagtgttgaatggaagtggtatgagtaggcagccttgtttttcttcatgaactcagggaaaaaatgttcaacatatcaccactaatgttttttgtagataccctttagcagattaaggaagttttattctaattctagtttactaaggactttttttctcttaagttatgagtgggtatataattttatcagatgctttttctgcatctattcaaatgattcgagatttttttctaattattctactaatgtggtgaattacattgtttatgtttgttaaaccatccctgtattcccagaataaagtaaatttgatcaagatgtattttgtttaaatatttatcactagattctatttgttaatgttttgtttagaaattttgaatttgtgtttatgagagagtgttggcctataaattcttacttttcataatgttcttggcattatattggtatcacggttaccaagaaccttgatatcaagataaaataaggtgagatatttaccctttctattacctcgaaaagtttgggtaagattaaaaattggtattatttcctcctttaatgtttggaagaatgctctggtgaagctatctcaccttgaagaattattttgtggtcaaattttaagttatggattcaatttctttaatagttttagtatcatttagattttccatcttttcttctaacaattgagttacttgtgtttttctaggaattcctttttttgttgttgttccttctggcatttgtgagactgctgaaagccctattttaatttcaaaatagaaatctttttgaggatttctacttggtttatctctctcttagccactgtttataaattggcaaatacctttagaggaaaagcaggtctgaatttaagctcactactttgtttttctcatcactttgggatcttgtttggcaccccctgtcttcatagctctgaactccaatttcggtctcccagccccttgggactatagatctctactctgttttctggcctcttttgtgcttctcatcctctctgctctgtgccagttatgaatcagcagaaaattcctagagggaaaagagtagcacagaatgttggatttcttttaatcttttctcttaattctgggttcttggccttttatgccctggctgtttggttgtgttttgatgccttgaaatgtatgctatttatattttatttcagcttttctagttgttctagacagaagagttggtctgatacaaaccagtccctcttagctggaaaattaggcaagcctcttaagacactctgaacctattccctcacctacaaattgagaataataccagttccctcaaagggctaattaatatgtgcctggtacttaatacaaatgtgggccaatattatataaatttcaatagtaataaatactaatctgaacttgaagtataagacaggaatgagcatttttttctttaaaaggccagagagtaagtattttagcatttgctggaaacatatgaccattgctaccttttgccgtccccagtgcttctcattgcctcctttgtcctcttctccctcccactcctcttctttttcaataaccatttaaaacataaaaactattcttaactttctgttcaacaatcaagattttgctaaatataagtgaatggaaaataggaatttaagttcagcttttaaaattgtggcaaataatttgaatattcaatttgatctgccataagttatcatgtcactctcttgctcatttctctcgtttcacccagtgtaaaagtctttgtcatgtacgtaaaagaacttacacaacatggttccctcccttactctcttgtacttctctgtctttgtcttctactactttctccttcatttactctgttccagctgcactggcctccttgttattccccaaacaagtcagacaggcttctgactcaggtctttgcacttgctagtctctctgcctgggatgcttatttcccacactttgtcatgtctttacataagcatttccttcttagtgaggcataccccaactatcctctctaaaattgcattgcgttctatcacatctttttcccttaacttactttattttctctttttagcagcttgttcaaaatctattatatacgaccctttattactcatattacttagcttggaatccagtgttctcaaaaatttggtcccaacatgtctttccaacctgtttttcattgctttcttatataatctgtacttcaacaatttcatattccctgtatagcattattttaccacttaaaaattgtattttaccacttttatacttttatttatgctgtgtccattttgtgcagtacacttccccaatacatttttgttttgttttattgtaaacaaatataaatataatcctaccaaatttttagggcccagctcaaatgctaccccttccataaaatttctgttaccatccaaatggaaggtttctatatctcttttgaacgctaatgccattttgtctgtatatataatttttttctttttttgagacgaagtttctctcttgttgcccaggctggagtgcagtggcatgatctcggctcaccgcaacctccagctccctggttcaagcgattctcctgcctcagcctccggagtagctgggattacaggcatgtgccaccacacctggctaattttgtatttttagtagagatgggatttctccatgttggtcaggctggtcttgaactcccgacctcaggtgatctgcccacctcggcctcccaaagtgctgggattacaggggtaagagaccacacttggccattttgtctgtatttttatctcttcactttctgttaataataacagtactatctttgcctttagttatatatactatactttatatgctctgcatgtgttaccatatgtaactctctcttttcctccttgctaagtacagttattaagtctggaaataatgtaagaggcaatcaagtgagaactacaaaaaatagaaagaggaaggcagactggctagggaccctagtacaggaaaaacaacacagtgacagagtctcttatgacccacacccaacagcaaacctggtctaggcccccactctcaacctagcaacataaggtgacacaggtaggcttattctttccccagattaaacaagagccctgccaacactaggcaagtctggtggctctagcaagggggaattgatttggaaccactggcaatcagtgaccagggagaagcattctccttccctcctgggcatgagactccccttccccactgacagacactgggtggccagtgtgcctggcaagggggatgtcctcacaaatgcctagcccagaaagtgatctttgttcctgtcacctggagactcctttctctcccctaaaggtaccagatgacccaacctgaggaagctctctttccccctactgtaaggcaccagtgtggactgtggactagtgggaacccaacgggcaccaaatgctagatgacgagttagtgggtgcagcgcaccagcatggcacatgtatacatatgtaactaacctgcacaatgtgcacatgtaccctaaaacttaaagtataattaaaaaataataataataatagtaataataaaaaaaaaagaaaaaaaaattcagacacacctaaatgattgtgaatgctttgaaaattgtcatccaaaccacagcccacaaaagtaggccaggacctgtgtgataaacctaaatggggatatgccttctaatggcaaagatttctgtaggacccagagtcttgtaagttatagtgaaaatattgaggataaaataaaaaatcacccatcataccaaaaccaagaaaatcacaacttgaataagaaaaaggaatgacaacactaagatgaatcagatttggaattatctggcaaggatttttaaagcaaacatcataaaaatgctctaacaaataattacaaagtatcttgaaacaaatggaaaaagaaagaaaatattagcaaaagaaatataaattataaagaagaaacaaatggaaagtatagagctgaaaaatacaataatagaaatttaaaattactggatgggatgaataacagtggagatgacagtaggatagaatctgtgagcttaagcatagatcaatagaatttagccaattttacaacatagaggaaacagaaacaaaatcagcaagccttagggacctattgggaagtaacaaagaaccaacatttgtattgctcgtgtttgagaaggagaaagggggtggcattgaaagagtatctgaagaagtaatggctgaaaacttcccagatttagccaaaaacttaatcctacagattcaagaagctttctgaaccccaaatagtatcaaccccctcaaaatctactctcagacatgtcataattaaacttatgaaagctaaagacaaagaaaatatcttaaaaagcatccagagagaaacaacacataacctataggggaacaccaattcaagtaatagcagatttctcatttaaaaccatgaagcccagaaggaagtggcagaacacttttgaagaggtggaagaaaatggctgtaaagtctatatccagcaaaagtattctttaagaatgaaggggaggaggttccaagatggctgaataggaacagctccagtctacagctcccagcatgagtgatgcagaagatgggtgatttctgcatttccaaatgaggtactgggttcatctctctggggcttgtcagacatggatgcaggacagtaggtgcaacccatggactgtgagccaaagcagggtgaggcatcacctcacctgggaagcgcaaggggtcggggaattctttttcctagccaagggaagccatgacagacggcacctggaaaatcgggcaactcccactgcgcttttccacctaatactgcgcttttccaacggtcttagcaaacggcacaccaggagattatgtcctgtgcctggctcggggggttccacacccacggaacctcgctcattgctagcacagcagtctaagatggaactgcaaagcagcagcgaggctgggggaggggtgcccaccattgctgaggcttgagtaggtaaacaaagcagccctgaagctcaaaatgggtggagcccaccacagctcaaggagtcctgccggcctctgtagactccacctctgggggcagggcatagctgaacgaaaggcagcaaaaacttctgcagacttaaatgtccctgtctgacagcgttgaagagaggagtggttctcccagcacggagtttgagatctaagaatggacagactgcctcctcaagagggtccctgacccccgagtagcctaactgggaggcatctcccagtaggggctgactgacgcctcatacggccgggcgcccctctgagacgaagcttccagaggaacgatcaggcagcaacatttgcctttctgcaatatttgcagttctgcagtctgcactggtgatatccaggcaaagagtgtctggagtggacctccagcaaactccaacagacctgcagctgaggttcctgactgttagaaggaaaactaacaaacagaaagaacattcacaccagaaccccgtctgacgtcaccatcatcaaagaccaaaggtagataaaaccacaaagatggggagaaaccagagcagaaaagctgaaaattctaaaaatcagagtgccccttctcctccaaaggaacgcagctcctcgccagcaatggaacaaagctggacggagaatgactttgacgagttgagagaagaaggcttcagatgattggtaataacaaacttctgtgagctgaaggagaatgttcgaacccatcgcaaagaagccaaaaaccttgaaaaaagattagacgaatggctaactaaaataaacagtgtatagaagactttaaatgacctgttggagctgaacaccatggcatgagaactgcgtgacacatgcacaagcttcagtagccgattcgatcaagtagaagaaagggtgtcagtgattgaagatcagatgaatgaaatgaagcgagaagagaaatttagagaaaaaagaaagaaatgagcaaagcctccaagaaatatgggactatatgaaaagaccaaatctacgtctgatgggtgtacctgaaagtgacggggagaatggaaccaagttggaaaacactcttcaggatattatccaggagaacttccccaacctagcaaggaaggccaacattcaaattcaggaaatacagagaacaccacaaagatactcctcgagaagagcaactccaaaacacataattgtcagattcaccaaagttgaaataaaggaaaaaatgttaagggcagccagagagaaaggtcgggttacccacaaagggaagcccatcagactaacagcggatctctcggcagaaactctacaagccaggagagagtggggtccaatattcagtactcttcaacaaaagaattttcaacccagaatttcatatccatcccaactaagcttcataagtgaaggagaaataaaatcctttacagacaagcaaatgctgagagattttgtcaccaccaggcctgccttacaagagctcctgaaggaagcactaaacatggaaaggaacaactgctaccagccactgcaaaaacatgccaaattgtaaagaccatcgatgctaggaagaaactgcaccaagtaacaagcaaaataaccagctaacatcataatgacaggatcaaattcacacataacaatattaaccttaaatgtaaatggattaaatgctccaattaaaagacacagactggcaaattggatagagtaaagacccatcagtgtgctgtattcaggagacccatctcacgtgcagagacacgcataggctcaaaataaagggatggaggaagatctaccaagcaaatggaaaaaaaaaaaaaaagcaggggttgcaatcctagtctctgataaaacagactttaaaccaacaaagatcagaagagacaaggccattatataatggtaaagggatcaattcaacaagaagagctaactatcctaaatatatatgcacccaatataggagcacccagattcataaagcaagtccttagagacctacaaagagacttagactcccacacaataataatgggagactttaacaccccactgtcaacattagacagatcagtgagacagaaagttcacaaggatatccaagaagttaactcagctctgcaccaagcgaacctaatagacatctacagaacactccaccccaaatcaacagaatatacattcttctcagcaccacattgcacttattccaaaattgaccacatagttggaagtaaagcactcctcagcaaatgtaaaagaacagaaattataacaaactgtctctcagaccacagtgcagtcaaactggaactcaggattaagaaactcactaaaaaccactcaagtacatggaaactgaacaacctgctcctgagtgactaatgggtaaataacaaaatgaaggcagaaataaagatggtctgtgaaaccaacgagaacaaagacacaacataccagaatctctgggacacatttaaagtagtgtgtagagggaaatttatagcactaaatgcccacaagagaaagcaggaaagatctaaaattgacaccctaatatcacaattaaaagaacaagagaagcaagagcaaacacattcaaaagctagcagaaggcaagaaataactaagatcagagcagaactgaaggagatagagacacaaaaaacccttcaaaaaatcaatgaatccaggagctggttttctgagaagatcaacaaaattgatagactgctagcaagactaataaagaagaaaagagaagaatcaaatagacgtaatgaaaaatgataaaggggatatcaccaccaatcctacagagatacaaactaccatctgagaatactgtaaacacccctaagcaaataaactagaaaatctagaagaaatggataaattcctcgacacatacaccctcccaagactaaacaggaagaagttgaatttctgaatagactaataacaggctgtgaaattgaggcaataattaagagcctaccaaccaaaaaaagtccaggaccagacggagtcacagctgaattctaccagaggtacaaagaggagctggtactgttccttctgaaactattccaatcaatagaaaaagagggaatcctccctaactgattttatgaggccagcagcatcctgataccaaagcctgccagagacacaacaaaaaataattttagaccagtatccctgatgaacatcgatgcaaaaatcctgaataaaatactggcaaaccgaatccagcagcacatcaaaaagcttatccaccatgatcaagtgcgcttcatccctgggatgcaaggctggttcaacatacacaaatcaataaatgtaatccatgatataaagagaaccaaagacaaaaaccacatgattatctcaatagatgcagaaaaggcctttgacaaaattcagcagcccttcatgctaaaaactctcaataaattaggtattgatgggatgtatctcaaaataataagagctatgtatgacaaacccacagccaatatcatactgaatgggcaaaaactggaagcattccctttgaaaaacagcacaagacaggggtgcctctctctcaccactcctgttcaacatagtgttggaagttctggtcagggcagtcaggcaggagaaagaaataaaaggtattcagttaggaaaagaggaagtcaaattgtccctgtttgcagatgacatgattgtatatctagaaaaccccatcatgtcagccccaaatctccttaagctgataagcaacttcagcaaagtctcaggatacaaaagcaatgtgcagaaatcacaagcattcttatacaccattaacagacaaacagccaaatcatgagtgaactcccattcatgatggcttcaaagagaataaaatacctaggaatccaacttgtgagggatgtgaaggacctcttcaaggagaactacaaaccactgctcaacgaagtaaaagaggacacaaacaagtgacaatactgcccaaagtcatttatagattcaatgccatccccaacaagctagcattgactttcttcacagaattggaaaaaactacttgaaagttcatgtggaaccaaaaaagagcccacattgccaagacaatcctaagccaaaagaacaaagctggaggcatcatgctatctgacttcaaactatactgcaagcctacagtaaccaaaacagcatggtactggtaccaaaacagagatatagaccaatggaacagaacagagtcctcagaaatagtaccacacatccacaaccatccagtctttgacaaacctgataaaaacaagaaatagggaaaggattgcctatttaataaatggtattgagaaaactggctagccatatgtagaaagctttaactggatcccttacttacaccttatacaaaaattaattcaagatggattaaagacttaaacgttagacctaaaaccgtaaaaaccctagaagaaaacctaggcaataccattcaagacataggcatgggcaaggacttcatggctaaaacaccaaaagcaatggcaacaaaagccaaagttgacaaatgggatctaattaaactaaagagcttctgcacagcaaaagaaactaccatcagaatgaacaggcaacctacagaatgggagaaaattttcgcactctatccatctgacaaaagggctaatatccagaatctacaaggaacttaaacaaatttacaagaaaaaaatcaaacaaccccatcaaaaagtgagcaaaggatatgaacagacacttctcgaaagaagacatttatgcagccaacagacacttgaatgctcatcatcactggccatcagagaaatgcaaatcaaaaccacaatgagataccatctcacaccagttagaatggtgatcattaaaaagtcagggaacaacaggtgctggagaggatgtagagaaataggaacacttttacactgttggtgggactgtaaactagttcaaccattgtggaagacagtatggtgattgctgaaggatctggaactagaaataccatttgacccagccatcccattactgggtatatacccaaaggatgataaatcatgctgctataaagacacatgcacatgtatgtttattgcggcactattcacaatagcaaagacttggaaccaacccagatgtccatcagtgatagactggattaagaaaaagtggtacatatacaccatggaatactatgcagccataaaaatggatgagttcatgtcctttgtagggacatggatgaagctggaaaccatcattctgagcaagctatcgcaaggacagaaaaccaaacaccgcatgttcttactcataggtgggaattggatagtgagaacacttggacacaggaaggggaacatcacacaccggggcttgtagtggggtgggggagtggggagggatagctagcattgggagatatacctgatgtaaatgaggagttgatgggtgcagcacaccagcatggcacatgtatacatatgtaacaaacctgcacattgtgcacatgtaccctagaacacaaaatataataataaaaaaaaagaatgaaggggaaaacattgtgaaatgaaggaaaacaaaagaatctgtcagtaagagatttaccttgcaagaaagacaaaaggaagttctttaaaccaggcgtcaccaaccagtaccggtctgtggcctgttaggaactgggccacatagccggagatgagcagtgggcagatgagcattaccacctgagctctgcctcttgtcagatcagccaccacattagattctcataggagcacaaatcctatggtgaactgcacatgcaagggatttggggttgtacgctccttatgagaatctaaggcctgatgatctgtggtgaacagtttcattctgaaaccatctcctcgcacccctacccagtctgtggaaaaattgtgttccacgaaacctgtccctgatgccaaaaaggttagggaacccctgctttaaacagaaaggaaattataaaagaaggactcttgaagtaacaggaaggaagaaagaacaatgaaacaggaagaaatagtgggagaatgcaatagactatccttcttgtgagtttcatgaatcatatttgatgattgcaacaaaaattataacatcatctgatactcaagacaagacaattatacttaaaagtaagcaaggtagagacctaactagtagtaaggttttcacacttcactcaaagtggtaaaatgttgataccagtagacggtgataagtcacatatgtacattgtattgccaagggcaaccgctaagaaaactttatatagtaatacactcagaaactctataaattaatcaagatggaatcataaaaatattctaataaccccagaaaagcaagaaaaaacagaggaacaaggaacagaagaaacaaacacaaaacaaataataaaacagcaaacttatggcctgacagaagtatttaccttaaaaggatacaatatgaagaaaagtaaaaattgaccatgaaaaaaagatttgtctatgaaaatgatttttttttacatgaggtattcctgttgtcattggagatatttatgagtagattctaattaccttgtattgttaaagtgaaagtcacactgtactctcagtaaatttgtgatttgttctttcctaatttcaacagtttttaaacagtattgaggaaaggttacttgcaaacaaaaattgtttttgtgtgtgttccatttgaatatgtaaatattataaggaacatttagaatcacaataatcagagaattcagattaaaacagcaattagaggtttttttgcctatcagatagggattaattaaattcatagttgctaattgtaatgggatatggaaaaataggtgctgttatatacaattagaagtgtagatttgatcaacatattctaaggcagttttagaggaatgaccttattttaacatgttaatttgcattcagcaattcagattatgggaagctgtgtataggaaatatgcttaattgttcacagtaacatatatagacaggtgtttattttagtggtatttgcaggggagaaaggctagaaatagttgggctatgccctggtatcaggaaatgttttaaagtgaaaactaatacatattaacacttcataagaaaaaaaattccgcaaagagcagacattatttagctagcttggtgtaatgttcataatatttctcagttccaaaatgtattggggatactttaataaacagttttgttgtgaactcattaatttgaataattattaattgcaaacatacccaaatgtaagttcaaggtacaacaacaacaacaaaaaacaaaagtaacatttaatttactgttctgattactagtccatttatttctatgggtaatcgagttgaacatcatatgtatgttttttcagagagtaaaaatcatctcatgtttacatcggtgacatatttcttctaaattaaaaaatttttttctaccaattttttaaggccttgcctgatgctaccctgtctgtgaggtttttgttaattattcatctttaagttatcgctatctcttttgaactataacatatttttctttatttttatctcatcattttccataatattaatagtaataatactttttgtgctttaaatcatacattatacactgctttatttgctttacatatattatcagatttctcatattagcccataataaggtagacattactatcctgattttacattgaagaaactaaaatattcagaggttaagtaaattactcaaggtcacacaggtaagattaaagtttaggtttcaaattcaggtatgtttgctacaaaaccttgtcactgtgttagactgcctctaaagtgagtaaggtaaatgaaataaatgctttgtatgtttaaaattttgttataaaggaaaggaaataatgaattaatgaaatgttcaaattacagactttaaagtaaatacagatttcgttttatactagtcataaggtaattcagtgttagtagttaataccattaaatataatgtgataatcagctagcgaaaaagaaaaaaattaaagttcacggttatttgctacatatatatatatataaattttaagttagaattataccatttgttatatcatttatgccatgtacaaatgaatgaaaatttcactttttttctttctagaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaaggtcgaaatacagtaatcatctaaccctatttatcaaatttaatgatattttcaaattaactgctcctttaaattctatatagaatacaattttcgtttcaaggatcagacataatattgagctgcttgggatgttagaggcaattataagctcaaataattatagttgagtattcagtttttattttaaatacattgctgtgattagcacttataacaactatgtattattattcttgttaagaagtagagaacagcaagcaaattttgttccaggcttgtacaacaaactagtagtcagatcacgttattgctctattttattctttagaatctaggaattgttcttgttgagccaagaagaaatggtcattatcatattcattttatgaattacatagaattattttaaaatgatttttaagttttttgaaccctgttttcccccttttacacctactgaagattactgtagcccagtaggcattgatttttatatcattagaatagaggattaatttctctttaaaatataaatatttcaaaataggattttctttagaaaataataaatactgttctaaatgggtatgcattatccttgttcagagtgcttttacttgttttatttgactattatcagtatctttgccaatagctaaaatcataaaactttaaaactagaaacattgtagaaattattttactcaaccactttattccagataaggaaactaaccaagagaagacaaaatttatttcagttaattttgtcaattgtaataatgcttatagaacttagaaataggtaaatatagtttttgtagggattttgatcatcagttaattttatcagttgtcagcattagggtttagaaatgttgaaaagttaagcaaacccagttagaggaaaaggatttcagaagtattgatcacaatctggatcattgttatgtgatacttttatttttttaaagtttatgcagtagcacctacattagtcaaaacccaattaattagtacttagttacatgacttcctttttagcactctatcttataagaaagaggttaatcacaagcattcagagggcatagcaataaaccataaataaaataactctaatgtattcttgagttagttttcactctatatgttactctttctttgcattttctgttgatatttgatactcaggatagtaatttttaaaaatagtaattcttaaaatttttaatcagaaatcatattgatatcagtatttagtgtgtagaaaagtgtactggtacattttaggaatattttaaacataatattaattaaacaggatgcctaaatgcctcatttcctgagcattgtagttaatcaaggaaggttattttgggttctggaatctactgatagagtaagtcatataagaaccaggaagtaacccttattccttttctttgtgttctttaaactcgttattagaactctatatcgaatttgtctctccttttggaaaagcatataaaaagcctgttgttacttcagaaaagggcaaaggcatttattgaaaaaacaataggcaaaagggaaaaggaacagacaacttgatataactatcttatacacattaagaacaaagaaagatcatatgaacctaaatgacactcaacaaggatattaacataaaggactttttcactgcaggtctaattaactattaacctttacaaaatcagtgtccttgggaaaactgaaatataagacagatacttatctctgagattgctgcagtgtctgctgatagaggaaattcataagaagcagaaactattatgtaaatctcagtaaaacacttatttataatggtcaaaaatggaatattggtaattgaacatttgggttagttgagaatattttttaaaattagggcaaaatattaatgctaaaggtgttctgtatttaactcagtcatttattcaaacccagaatcctgcagtttctcctgattaacagctaagtaaattctatagcactgtactgaaaatataaaaaatttagaatatagggctgatcatccctgatcctaagattgtcctctgaagttgattttcagggtaaatctttcatatccactttttaaattgccgattgtttcttatgaaacaagtagtaaaatgtacaaaagaaaaagaatctagcttaaattatagagttcagacatattttttagtaggaggaagaggaatagaataacaaaatagagtgtgaaatttggagtaaattgacagattttcagaataaaatgtttcttttttctctgtacatgttaaaaatatactttgtattgatactttcatgtgccatcactaatattacatatatagcatattaaagagtgacattttaaaccattgttaaattattcaacagggactaaataggaatagtttgccaactccacagctgaggagaagctcaggaacttcaggattgctacctgttgaacagtcttcaaggtgggatcgtaataatggcaaaagacctcaccaagaatttggcatttcaaggtaaaatctgcagagccttttaagaaacttgaatcaaatgcatctactttgtttctgtcaataatgtttcaaatagttctggaagcagaaaggaatggttgaagtattttaggtataggacaacatgtgtagtaataatatggtaaaatagagaaactgattattaaagagaagctaatgtgtcttgtcctaaaactttgataggctgggtacaaaatgtgctggatccctgagaacatgagatagtttagggaaatcaggatcaactcaggactggatgctggggaagtttttaaatcgatagaagtggccattacagggttagccaccaatccaatgaatagtatccaaaggtaggtctgcagaattactgacttctgaaaagaggagcacgtttccaaggctcatcacaattgttaggtttaaggtaaccagactttcaaatcctgttcctgctggaggttgagacaactaatatattctatattctgttgaggatttacttggaactgaacaatgctaatcttataaatgaaaggcatcagtaactttaagtaaatgaggctgggaaaatgcaggagctgaaatctcccgaatgtaaatatatacatttaccctgataacaaaggatttaataatacagtactttgtcttttgaaagccaggaaggatactgatccttgtgtgagtttgtcataagttttttctttactcagctttctaattatgttaatataatattggaattggcacaaattctgtgttaaccattttctggtattactgagcatgttttatacttttgagctgtatagtttcacatttgaaacagtagatggcaggattggatcatagctatttgttaaagtttatgttaacagataattagatgattataattttctagattcttaggtggtttattaatttgaatcttgtataatatattcaagcaggtgaactccttttttgtaaaagaaaaattgaatgaagtgatgtctaaaacaggaatggattgaagtatgaagagtactgtacaggaaaatgagcattggtccaaaatttgccatggcctgaacatcatagtcttttttttttttttgtaaaggaagcaggatatagggaagtgaatgatgttaggaacagaaaatgtgacagtatttcttaactatgggtagcattatcttgagaatatagttgggttttaaaaggtatgataaaaatgttttatattttaacctttcatactgatgtaacagcaatgcatttgcagttaaagaaacatttgatacattgagttaaggtcatttttatcctgctgcctcagataattgattacaatagaaacatagttcagagaaaactaatctttaactctgaaaagtgtttattatataaagctaaatgtaggtagattctatgtagtgacttaactcattaaaacaaaatttatgcctcataaaatatttagaaatttggagaataaattaattggtggtattatgtacgtctattttaaagagaccaggctagatgtatcttttctagtttgcagaagctggagcctcttggtaataaatgtctatgtgtactttgcacataggtgggttacgatgggaatatatgaaacatttacaaccactattccttttcagattcaaatctctggatcagtgctgtctaatagaaatttttgcaatgatggaaatagtttatatctgcactgtctaatatggtactccctagctacatgtgactgttaatcatttgaaatgtgtctagcatgactaaggaactgacttttaaatgtgatttaattcttattaatttcattcagatataaagagccatatgtgactgttttgtagacatatgtgacatccatattagtgcagctctagatctttaatgcgtagtgatgttttgttcaggaatctttagactttagtagcacaaaactcatagacttatgactctgaaatcatcttgactttatattatagtactccagaatcgagatctcatatccttgattttgagtcttgagctttggattctgatcacagtttgcctgactgatttcagcatgattccggtgttgaacctctcatttcctgagcctatgcctgataccaggtttctcatcattccagctgcttttttgtctgttactattgttctgcccttatttccccgcacaatgctgctatcctctagtggagtggttgcttacaaaattgatttacttagagacttggtgttatctttgcatcctgttaccttattctacagataacagttgtcagatatctgtctgcattatcttttactctctattcttctcctttatcactgtgcctatactattttatgctttcattactacttacttgggctattgaattagcctcttaattccagtttccagtatccttcttgactttattaatcttccaccttacactagaaatcttccttaaataaaactgtgattgcagttgtccctggttatccctgggggattggttccaggcccctccccttcccatgggtacaaaaatccatggatgcttgagtcctttatataaaatggtgtagtatttacatattctctctacacatcctttcatgtactttaaatcacctccagattatttataatacctaaggcaatgtaaatgctatgtaaagagttgttatactctattttttacttgtatttttttattactgtgttttttttccttgaatatttttgatttggggttggttaaatctgtggatgtagaaacctcacatacagagagctgactatgtatagtttgtctagtcattgcatttttggactctttaccagtcctatagaataacgcccaaattcctagtgtagaatgtgaaacccaattattacctcatgacagagctgcagcccttacttggaaaaagtaaatgaactaacacagatgagcagtctttcaaataatgagaatagaaaaatgatatggaaagctttctaggtaaaaacagtaggcatgtaacttgtttaagactcttccttgatgttttctggtaattttgttcttggtttaacaccatttgaaaattaagctaaattatgtttcaaaataattaaaatacaaacaatgaaatatatataaggtatttggataaaaagtaataccctatttgtgtaaagaataatacaggatttaattttgcttttattcatgctttgcctagagaaaaaaattaagtattataaccctgggagctatgataaaaataatcagaagaaagaaaaccacagggaagaagagttagtcccccattgaacagcgaccctgttcttattgttaagagtttattattgttcatctgttagaggacttgagattttactaattaaggaggccattcctttacaacaccaaaatatgtttccaacatcaccttcctctagtcttctgaaattctagtcaagctgaactatttgatcttctctctgtccatctgtgcacccttttaatttaaaaagcaatttaactggaatagatctcaacttcagttctgtatatccttagttgggctcataaatcaccttataaggataacacctggaggtccttctcccttctccaaggagaagtactcttttcttcctctgaatttccataacacattctcttacggcgcttttcacatttgactttatgtcagccattactactcctctaaagcctgtttaagttctgtaaagagttcgagattgcattaaaatgaatctttgaagacaaatggctgcttaacaagtgtcctgcagaggtatggtatccatatgagattatgacccttaatcttgccttctgcttaagtttcagatctgggatgagatttctgtggtcagaaagttccaggaaaggttgttttctggatttgctgatgataaaattacccatctctgagttctagttttagtacaggttgaatatcccttatctgaaagtcttgggaccagaagtgtttcagatttcaggttttggaatatttgcctatgcataatgttgtatcttggggatacaacccaatattcatttatatttcatatacacatagcctgaacgtgattttatataatattttaaataattttatgcgtgaaacaaagttttgactatattttaactgtgacccatctcatgtggtcaagtgtggaattttccatttgcagagtcatgtttatactcaagaaattttgaattttggagcattttggatttgggatgctcaacctatacttagagttaaaagaagactgaactgctatttttgaactgagtgatgggacccagccttctctgaggtcaaacagcatatattcagggctcacaggtcactctttttgaacaggttttccctggggaaaaaaataggcaagttgtgttcaattaccctgtgggctatcaattatagttacctcctacactaaagagacttgcttttaaacccatgagtcaccatttatcttcaccgctactgtgtaatgaaatctaataactcgttgcctggcaatagtatgtatgttaaattctgtgccttataatttatcagagacttacaccaaggttatattagcaaacttgaccctatttgaaccccagcaattcaagagggctaattgtgtcatcctactcagcttcttaagagaataactctgtaaatttagacatctacagttatcaagtttatacaactgcattgaaactgagttggtacagaccttgttaaggtaatttgtattgactgtctagaagtcagctcttaaaatatagcttagctcagggaccataacttttgacgtctcttgttcgtttgcttttgacaactcattcccaagtgagtagaaaaagaaaaacaaactcaatttcttccaccatactctgacagcacatttctgataccagatgtgtggggatttctccccaccagcaagcaagcgagcaagcaagcaggcaagcaagcaattctgtagtagacataagctaggtgtcctataattcaattatttctttttcttttctttttttttttttttgagacagagtctcactctgttgcccaggctggagtgcagtggcacgatctctgcccactgcagtctctgcctcctgggatcaagcaattcttcctcaacctcctgagtagttgggactacaggcacatgccaccatgcccagctaatttttgtatttttagtagagacggggtttcaccatgttggccaggctggtctcgaactcctgacctcaggtgatctgcctgcctcggcctcccaaagtgctgggattacaggcatgagacaccatgcccagcctaattccattatttctgacaccatctacctggagatagcgtcagatcatactggttaaggactcagtccgacaagactgatctccacttctgatgccaatagcaagcctcaggttattttgcctgtgcttctgaccaaccagctgtaaatcagggttcccacagccccctccctgggttcaggtaatttgctagagcagctcacagaactcaaggaagcatgtttactggcttattacaaataatattttaaaggatacaaatcaacagccagatgaggagatacaaaggacaggtctggaaggggcctgagtacaggagcttctgcccctgtggagttggagtataccaccttccttgcttgtggacatgttcttgttcactttcctggaagcccccacgtgtttggctattcacaagctcctcagacccagtcctttctggatttttataggagcttcattttataggcatgattgagtaaatcattggccattggtgagcaatttaagctttagtccctctcctctctctggaggttgggtagtggggctgaaaacccccatcatctaatcctgtcttggtctttcaagtgactagcctctatcctgaagctacctagaagctgccagccatcagtcaactcattagcatacaaaaagacactttggagatcctcaggagtttaggagttgtatgctaggaaacagggactggactaaaaccaaatatgtatttcacaatatcacaccaagtctgactttaatcaccttcctgccaactattagtagtcattggaactactcgtctgcttgtcttctgctttcttcgtattgatttatgtaatttcattgaggtgtgtatttatctggtgctgggccaggacatgatgggaagattcgggaactaatctgagaacctatcatttgacctgtaactcttaattctaaatagctaaatgaatgtatgatatactgaaattattgaaagaccctggatcaaggtagaagacagtggagcagtgctgtggtgccattctgaaaggagaaatctctctttgtcttgactattaatcatagaatcagggagtgggctttggtagaatacacagatttttctctttttttgttttctttcttttttattttaaactagaagcttttagagtgtgtttgtatgctgtgaatgatatggacaagaagaatatgagatttaattttgtttgcatgtctaagtgtttgaaagctcaattcattatcttattattattattatcattatactttcagttctggggtacatgtgcagaatgtgcagttttgttacataggtatacacgtgccatggtggttcactgcacccatcaacccgtcacctacattagatatttctcctaatgctatccctcctctagtcccccaccccccgacaggccctggtgtgtgatgttcccctccctttgtccatgtgttctcattgttcaactcccacttatgagtgagaacatgtggtgtttggttttctgttcttgtgatagtttgctgagaatgatggtttccagcttcatccatgtccctgcaaaggacatgaactcttccttttttatggctgcgtagtattccgtggtgtgtatgtgccacattttctttatccagtctatcattgatggacacttcggttggttccaagtcattgctattgtgaatagcaataaatatacatgtgcatgtgtttttataatagaatgcttcataatcctttgggtgtatacccagtaatgggattgctgagtcaaatggtatttcttgtcctagatccttgaagaatcgccacactgtcttccacaatggttgaactaatttacactcaccaacagtgtaaaagtattcttatttctccacatcctctgcagcatctgttgtttcccgactttttaatgatcgccattctaactggcatgagatggtatctcattgtggttttgatttgcatttctgtaaggaccagtgataatgatcatttttcatatgtttgttggctgcataaatgtcttcttttgagaagtgtctgttcatatcttttgcccactttttgatggggttgtatttttcttgtaaatttgtttaagttctttgtagattctggatattagccctttgtcagatggatagagtgtaaaaattttctcctattctgtaggttgcctgttcactctgatggatggtagtttcttttgctgtgcagaagctctttaattagatcgcattggtcaatgttgccttttgttgccattgcttttggtgttttagacatgaagtctttgcccatgcctgtgtcctgaatggtattgcctaggttttcttgtaagatttttgtggttttaggtcttacgtttaagtctttaatccatcttcagttaatttttgtataaggtgtaagaaaggggtccagtttcagttttctgcatatggctagccagttttcccaacaccatttattaaatagggaatcctttccccattgcttgttgtgtcaggtttgtcaaagatcagatggttgtagatgtgtggtgttatttctgaggcctctgttctatcctattggtctatatatcggtttggtaccagtaccagaggaaagaacaggcagtaatgattgctgttctgcagcctctcctggtgatacccaggcaggcaaacagggtgttttggttactgtagccttgcagtatagtttgaagtcaggtagcgtgatgcctccagctttgttctttttgcttaggattgtcttggctatgagggatcttttttggttccatatgaaatttaaagtagttttttctaattctgtgaagaaagtcaatggtagcttgatggggatagcactgaatctatatattactttgggcagtatggccatttttgtgatattgattcttcctatccattagcatggaatgttttttcatttgtttgtcctctcttatttccttgagcagtagtttgtagttctccttgaagaggtccttcacaacccttgtgagttggattcctaggtattttattctctttataacaagtgtgaatgggagttcactcatgatttggctctcttgtttgtctgtttttgttgtataggaatgcttgtgatttttgcatattgattttttatcctgacacttttctgaagttgcttatcagcttaaggagatttggggctgagacaatggggttttataaataattgaatcatgtcatctgcaaacagagacaatttgacttcctctcctcctaattgaataccgcttatttctttctcttgcccgattgccctgaccagaacttccactaccatgatgaataggagtggtgagggagggcatccttgtcttgtgctaattttcagaaggaatgcttccagtttttgcctattcagtatgatattgcttattggtttgtcataaatagctcttattattttgagatacattccattgatacctagttcattgagagtttttagcatgaaggggtgttgaattttgtcaaaggacttttgtgcatctattgagataatcatgcggtttttgtcattggttctgtttatgtgatggattacgtttattgatttgtgtatgttgaaccagccttgcatcgcagggatgaagcctacttgatcgtggtgggtaagctttttgatgtgctgctggattctgtttgccaatattttattgaggattttcatatcgatgttcaccagggatattggcctgaaattttctttttttgttgtgtctcttccaggttttggtatcaggatgatgtcggtgtcataaaatgatttagggaagatttcctttttttctattgagtggagtagtttcagaacgaatggtactagctcctctttgtacctgtcgtagaattcagctgtgaatctgtctggtcctggacttttttttggttggtaggctattaattactgcctccatttcagagcttgttattggtcggttcagggattcgacttcttcctggtttagacttgggagggtgtgtgtgtccacgaatttatccatttcttctagattttttagtttatttgtgtagaggtgtttatagtatcctctgatggtagtttgtatttctgtgggatcagtggtgatatcccctgtatcattttttaatgtgtctatttgattcttttcttattcttccttattagcctggctagtggtcaatatattttgttgatcttttgaaaaaaatagctcctgaattcattgattttttgaagggtttttcgtgtctctatctccttcagttctgttctgatcttagttatttcttgccttctgctagcttttgaatttgtttgctcttgcttctctagttcttttaattgtgatgttagggtgtcaattttagatctttcctgctttctcttatgggcatttagtcctataaatttccttttacgcactgctttaaatgtgtcccagagattctggtatgttttgtctttgttctcattggtttcataaaacatctttatttctgccttcattttgttatgtacccagtagtcattcaggagcaggttgttcagtttccatgtagttgtgcggtttcgagtgagtttcctaatcctgagttctaatttgattgcactgtggtctgagagactgtttgttatgatttctgttcttttgcctttgctgaggagtgttttacttcccattacgtggtcaatcttagaataagtgcagtgaggtgctgagaagaatgtatattctgttgatttggggtggagagttctgtagatgtctcttaggtccacttggtccagagctgagttcaagtcctgaatatccttgttaattttctgtctcgttgatctgtctaatattgacagtagggtgttaaagtctcccactattattgtgtaggagtctaagtctctttgtaggtctctaagaacttgctttatgaatctcggtgctcttatattgggtacatatatatttaggatggttagctcttttgcatttatccgtttaccattatgtaatgcccttctttgtctcttttaatctttgttggtttaaagtctgttttatcagagattaggactgcaactcctgccttttttttttttttttttgctttccattttcttggtaaatattcctccatcactttattttgagcctgatgtgtctttacaggtgagatgggtctcctgaatacagcacactgatgggtcttgactatccaatttgtcagtctgtgtattttaattgaggcatttagcccatttacgtttaaggttaatatgtgtgaatttgatgctgtcattatgatgctagctggttgttttgccctttagttgatgcagtttcttagtagtgttgatggtctttacaatttggtatgtttttgcagtggctggtactggttgttcctttccatgtttagtgcttccttcaggagctcttgttaggcaggcctggtggtgacagaatctctcagcatttgcttgtctgtaaagtattttatttctccttcacttatgaagcttagtttggctggatatgaaattctgggttgaaaattctttttcttttggcggatcacgaggtcaggagttcgattccagcctgaccaacgtggtgaaaccccgtctctaataaacatacaaaagttagctgggcgtggtggtgcgcgcctgtaatcgcaactactcaggaggctgaggcaggagaattgcttgaacctgggaggcggaggtggcagtgagctgagattgcaccactgcattccagcctgggtgacagagagagactccatctcaaaaaagaatactggccctcattctattctggcttatagggtttctgccgagagagatccgctgttagtctgatgggcttccctttgtgagtaacctgagctttctctctgggtgcccttaacattttttccttcatttcaacttcggtgaatctgacagttatgtgtcttggggttgctcttctcaaggaatatcattgtggtattctctgtatttcctgaatttgaatgttggcctgtcttgttaggttggggatgttctcttggataatatcctgaagagtgttttccaacttggctccattccccctgtcactttcaggtacaccaatcaaacgcagatttggtattttcacatagtcccttatttcttggaggctttgttcatttctttttattcttttttctctaatcttcttgctttatttcatcaagttgatcttcaatctctgatatcctttcttccacttgatcaattaggctattgatacttgtgtatgcctcacgaagttctcgtgctgtgtttttcagctccatcaggtcatttattttcttctctacactgattattctagttagcaattcgtctgaccttttttcaaggttcttagcttccttgcattggattagaacatgctcctttagctcggattagtttgttgttacccaccttctgaagcctacttctgtcagttcatcaaactcattctctgtccagttttattcccctgctggtgaggagttgtgattatttggagaagaggcgttgtgttttttggaattttcagcctttttgtgctggtttctccccatctttgtggatttatctacctttggtctttgatgtttgtgaccttcagatggggtctttgagtggacatgctattcctttctgttgttagttttccttctaacagtcaggcccctttgcttccggtctgctgcagtttgctggaggtccactccagaccctgtttgcctggatgtcaccaggagaggctgcagagcagcaatcattactgcctgttctttcctctggaagctttgtcccagagggacacctgccagatgccagccagagctcttctgtatggggtgtctgtccgcccctactgggaggtgtcttccagtcaggatacatgggggtcagggacccacttgaggaggtagtctgacccttagcagagtttgaaaactgtgctgggaggtctgctactctcttcagagccattgggcagggatggttaagtctgctgaagctgcacccgtagccaccccttcccccaggtgctctgtcccagggagattggggttttatctgtaagtccctgactggggctgctgcctttttttcagagatgccctgcccagagtggagaaatctggcagtctggcctcaatggccttgctgagctgcagtggggtccacccagttcaaacttttgggctgctttgtttacactgtgagggcaaaacgcctactcaagcctcagcaatggcagatgcccctccttccaccaagcttgagcatcccaggtggatctcagacagctgctgtgctggcagtgagaatttcaagccagtggatcttagtttgctgggctctgtggcggtgagatctgcagagccagaccacttggctccctggctttagccctctttccgggggagtatagggttctgtcttgctggcgttccaggtgcccctgtggtatggaaaaaacaatacaacaacaaaaaaaactcttgcagctagtttggtgtctgcctaaatggccgcccagttttttgcttgaaacccagggccccggtggggtaggcaccggagggaatctcttggtctgtggattgcgaagactgggaaaagcgtagtatctgggctggaatgcactgttcctcacggcacagttcctcacagcttgccttggataggggagaaaattccccaacctcttgcccttcccaagtgaggtgatgccccaccctgcttcagctcgccgtctttgggctgcatccactgttcaaccagtcccagtgagacgaactgggtacctcagttggaaatgcagaaatcacccaccttctgcgtcaatcttgctgagagctgcagactggagctctttctattcaaccatcttgcctgggaacacacacatttttctatttgaatgttgccccgggtggtactgttactcttcttttccagtctttgccaccccacatgtaggcagttgccggtatgaaataatcaaaaggataagaatccagcttaaaagagtttattcaaacacaaagctgtggatgcccatccaggaaacacagactccaaggaaatagggtcagtgcttcaaagttgaaaagttaagatcatatttgtataggcagaaaacaaagatatttagcagaataacattttccacacaaagttggcttctgagttacagcaatttgattagttacagcttgtttgttttctttttccaatttaaaagaatatatttaacagtccatcttagaaagtgtgtctttgtgtaagagaagaaaaagggaagttaatctataatgaagatcaacagtaaagagggaaggagtcttctttgacatcctttagttatttgcagcatttagcaaagcagtgtaagttaggggggaataaaaggctaatctgtagtcagggaaatcaaggctatgtctgcctaggttacagctgcctgttagtgactgaggtcccaaaatcacattcctttaaggctcagaataaaagttccaaaatttggttttgaattacttattttcacacaatgaaaatatgaagaatgactgagcattgacagggagatgagttcattgggtggtattatttgcttactgcttgttttttgcctacactaataaaagttgtcaatacttgtgaggatagggaacagaaaaaaatgaaaaactatactttagtccagtagttctcagtgaggtcactggatcagaaactccatcatataagaacttgttagaagtgtggattatctggccccacccaagacttagtgaatcagaaaccttggggacgagaccagcagcctatgttttaagaaaccttcaaagtaattgtgataacctatttcaccccagggattggcagtctgcagcctatggacctaatctggtctataacctgtttttttgtaagtaaaattttattgaaacaaaaccatacccatttgttcattttagtttgtggatgcttttgtgctacatcagcagagttgagtagctgcaatagagaacatatagccaaaagtatttaccatcaggttctttacagaaaaagtttgctgactcctgctttaggccttaggcactagaggcgcaaactctgaatttatgaggatatatttgctaattaaattgagaaccatgaggaaaaaaggtgaaacttttcctgtttttaaaaattttaacctgttatttttcccttttagtcaaggatgctatctaaatgggccttttaattcaaatctactgactatcccgaagcaaaggtcatcttctgtatcactgactcaccatgtaggtctcagaagagctggtaagaaatcattctttatgactcaaatatgggggttctcaaagtatatggtagtgtaaacacttttcatcacatatttatagctaattttgaatacaatttcatgtattataagttaacatgacttagcagtttgggttggctactaattgaccgtttgctaattctttcagtaaaaacagttttagaacatctactctgtaccaggtattttgctaagcagtagggattcagagataaaatatataactatttaactaacctgaatggttgcagacccaggacaagggaaaatcttcaagaaagagtatttttttttttcatagaatgataattgtggagaaaaaaattttaggattagaatagaaaaaaccatgacttcatcctggaaaaacattatgataggaattttttttaattaaaagattatagaatgattaaaaactcttggatgcaagatattttaataaatacaacataggaatagcaaagcaatactgatattgtgcttttaaagtacattatggctgatatcacataggtacaattttgtgattgggatatacaattacaaaattcttttatacacaataacctataaagcatgtgaagagatcagaaaatattattgataatcaagaaaagtaggcactagaaaaagatctatatatgatattgatgctgtattttacaatctttaaaataacaatgatgtttaaaaggaaatagaaggaataatggccaaaatgaatggatacttcgaatagagaactagaacacatagaaaagaaatggacagtctagaactgagaaatgcacttgattaaattaaaagcttattcaagggtttaagaatggattggatacaacagaatacaaaagtagtgaacttgaagacagagaaatagaaaatacccaaactgaagcacagagaaggaaaaatacataaataacagaacaaagtttaaaagacatatgggacacagaagttctaaaatatgtgtgactgaagttccagaaggaaaggagagaaacaaaaggacagaataacttcgcaaaactaataaaagaaagcaaacaacaaattcataaagtgcagtgaaccccaagcaggataaatacaagaaaatcacagctagatgtatgaatcaagcctccaaattataaagaaaaagtttcaaaagcaaccaagcaaggttgtttttatttttcaaggaacaacaataatgatattgacagtgacttgttaacagcaactgtgaactccaaagacaatggcatatttgaaaaagtgtggaaagaataaaacttgacagcatagaattctttatccaatgaagaaatattcttgaaaaattaaataggaataaaaattttttttagtatcctcacttccctgcaacagtaactgtggtgatgggtatgttaattaatttgattgtcataatcatttcacagtaaaaatgtaaatcaagtcattatgttgtacaccttgaatacatgcagtttttgtcaattgtacctcagtaaatctggaaaaaatcttttagtaaatcagatgagaagtagaaaaacgtacatttttttcaaacaaacaaaagctgaaataatttgtagctggcagacctgtgctactaagattcagtaaaggaagtttcttaggcagggggaaaattatccagattgaagcatggaactacaagaacaaaccaaaagcactggtaaggctaaatagatgggtgaggattaaaaagtgttgatgggtcaaaaagttggcaaaggatatgaatagacacttctcaaaagaagacatttatgcagccaacagacataggaaaaaatgctcattatccctggtcatcagagaaatgcaaatcaaaaccacaatgagataatatctcacgccagttagaatggcgatcactaaaaagtcaggaaacaacagatgctggagaggaggtggagaaataggaaggcttttacacagttggtgggactgtaaattagttcaaccagtgtggaagacagtgtggcgattcctcaaggatctagaacaagaaataccatttgacccagcaatcccattactgggtatatacccaaaggattgtaaatcatgtggctgggcgtggtggtgcacgcctgtaatcccagcactttgggaggccaaggcaggcggatcatgaggtcaggagatcgagaccatggtgaaaccccgtctctactaaaaatacaaaaaaaaaaaaaatcagctgggcgtggtggcaggcacctgtagttgcagctactcgggaggctgaggcaggagaatggcatgaacctggaaggcagagcttgctgtgagccgagatcgtgccactgcactccagcctgggtgacagagcaagactctgtctcaaaaaaaaaaaaatcatgctactataaagacacatgcacacgtatgtttattgtggcagtgttcacaatagcaaagacttggaaccaacccaaatgtccatcaataatagactgaataaagaaaatgtgaggccgggcgcggtggctcatgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctatttgggaggctgaggcaggagaatggcatgaacccgggaggcggagcttgcagtgagccgagatcccaccactgcactccagcctgggcgacagagtgagactccgtctcaaaaaaaaaaaaaaaaaaaaaagaaaaaaaagaaaatgtggcacatatacaccatggaatactatgcagccataaaaaaggatgagttcatgtcctttgcagggacgtggatgaagctggaaaccatcattagcaaaccatcacaagaacagaaaactaaacaccgcatgttctcactcataagtgggagttgaaaaatgagaacacatggacacagggaggggaacatcacacactgggaccaatctgaggctggggggctgggggagggatagcgttaagagaaatacctaatgtatatgacgagttgatgcatgcagcaaaccaccatggcacgtgtatacctatgtagcaaacctgcacattgtgcacatgtaccctagaacttaaagtataataataataaaaaaattgatgggtaaacacaataataactttcttttagcatttatgaaatacataaaagtcaaatatataacaatagcatagagggtagtcaaggggtaaatggaattaaatttgtcgtaaggtactagcaatgcttgaaaaacagtaaaaagttctaatttaagagaagctaatattcaaagatgaacattgtagtattcagggggccaattaaaagaccagtagaaaaagatataactaaaaagcttataaggaggtaaaatggcatgattaaaaaaagcttgaataattcaaaagaatctgagaaaagaaaagcaaaaacagaagaaacacacaaaaaataaatagcagcatggtggattaaacacactttattacattaaatatacacctttggggtagaggaagggatctgactagagttgtcagtatattatctgaaatgtcaagttttcaacaaaaattggactttacgctccaattaaaagacaaagattaggctgggcactgtgactcacacttgtaatcccagcactttgggaggctcaggtgggtggatcacctgaggtcaggagtttgagaccagcctggccaacatggtgaaaccccatctctacaaaattcaaaaatacaaaatacaaaaattaaccagacgtggtggtgggcgcctgtaatcccagctactcgggaggttgaggcacgagaatcgcttgaacccgggagacagagattgcggtgagccgagattgtgccactgcacttgagcctggacgacaaagcgagccttcgtctcaaaaaaaaaaaaaaaaaagtaatcttctgactgctcattggttgatgtccaaattatactgatccccccagggatgacttctaggaaaccatgcttaaaaatataatcaaaaacttaagagaaaaagctaacagaaaactgagtaactacacattgcaggagaaacagaaactacacaattagttcaggtaagtcactaaacaaattatcagaaagaagaaaacacaaagccagcaacataataaacctttggtgttggagggatctgatatcaaaactttacagtattttatgtaaaatgtacgattttcaagaaaaatatgtgaaacatgcaaagatacaagaaatttttgacatgtacccaaggaaaacgtaacccatagaaattatccctgaagtggattggattttagacttagtataaaacaaaactgtaacattgttttaataattataaagtaaggctacttttactcaatattggattagaggttctagccagggcaattaggtgagaaggaataaaaggaaaaagtaaaattgtatttgcagatggcatgagcttgtatatgtaaaatcctaagaaattcactgaaacctattatcaccaataagtttatcaatgtggcaggatatacaaaatcaattttatttctatatgctaacattaaggaatccaaaactcaagttacagaacgatttctgtttacagttagcattgaaaaaatctttgaaataaatttagcaaaatagtacaagacttttacaatggaaactataaaatattgttgaaattaaagaagacctaaatatattggaagacattccacgtttaaggatcagaagacttaatattattaagatggcaatattctttgaattgcactagattcgatacagtccttatcaaaatttcagctttgccaaaattgacagtctgatgctaaaattcgtatagaaacgcaagagtcccagaatagccaaaacagttctttaataaaaaagaagaaaaagtacgaggactcccactttcaaattttaaaacttactaccaggctacagtaatttagtatggtactggcatagagatatttctattcaatgaaattcaatttggcagtttctcaaattttaaacatgaagttaccatatgacccagaaattctacttcttgatatatatccaagagaagtgaaaccgtaggtccacacaaaaacttgtgcataaatgtgtatagcagcattattcataatagctaaaattagaaacaacctaaatggctatcaataaatggttaaacaaaacgtggcttaaccatacagtagaatattttttgtcacaaaagtgaaatggagtagtattcatatgccatgaatgaaccttgaaaacattatgctaagttaaataaggcagtcacaaaagactacaaattgtacaaatctactcatataaaatgtctaaaatggacagatctatagatagagaaagtatattagtggttgctatggttttaatgcttgtgtacttccaaaattcacatgttgaaacctaatccccaatgagacagtattaagagatggggccttttggagatgactaagcatgaggttggagcctttgtgaatgagattagtgctcttataaaagaggcctgaggaagctagctatcctgtcagccatgtgaggatacagtgaaaaaagtaccatctgtgaggcagaaactgagccctaatcagacatcaagactgctggcaccttggtcttggacttcccagcctccaaaaactgtgagcagccaagttctattgtttacaaattgcccagactaaagtattttttttttttaggtggtatagatggaattttaatacagtgaaagaaaatagggagtactgagttaatggttttgggtcatctttataattatctggtagaagactgaatttccatcttacatattatatacacagaaatctacagattggctacaatttaggtgttcaaaatgggaattaaaagtattataaaagcatataagattcagaaagtttaaatagataaatattttctaataataaaaccattaaaagttgataacatttttttttcttttatttattattatactttaagttttagggtacatgtgcccaatgtacaggttagttacatatgtatacatgtgccatgctggtgcgctgcacccactaactcgtcatctagcattaggcatatctcccaatgctatccctcccccctccccccaccccacaacagtccccagagtgtgatgttccccttcctgtgtccatgtgttctcattgttcaattcccacctacaagtgagaatatgcagtgtttggttttttgttcttgcgatagtttactgagaatgatgatttccaatttcatccatgtccctacaaaggacatgaactcatccttttttatggctgcatagtattccatagtgtatatgtgccacattttcttcatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctcggatggccagtgatgatgagcattttttcatgtgttttttggctgcataaatgtcttcttttgagaagtgtctgttcatgtcctttgcccacttgttgatggggttgtttgtttttttcttgtaaatttgtttgagttcatcatagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttgtggttttaggtctaacgtttaagtctttaatccatcttgaattgatttttgtataaggtgtaaggaagggatccagtttcagctttgtacatatggctagcgagttttcccagcaccatattaaatagggaatcctttccccattgcttgtttttctcaggtttgtcaaagatcagatagttgtagatatgcggcgtgatttctgagggctctgttttggtaccagtaccatgctgttttggttactgtagccttgtagtatagtttgaagtcaggtagtgtgatgcctccagctttgttcttttggcttaggattggcttggcgatgtgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccctcacgtcccttgtaagttggattcctaggtattttattctctttgaagcaattgtgaatgggagttcactcatgatttggctctgtgtttgtctgttattggtgtataagaatgcttgtgatttttgtacattgattttgtatcctgagactttgctgaagttgcttatcagcttaaggagattttgggcttttttttatagcaagttgaatgaactaagacagtggtcccttgtgactatgggtaggagcgacaggaatagagaatgactgctaatgggtctatggtttctttttgagtttatggaaatattccagaattagatagtggtgatagttgcacaactctgtggatttctaaaattcagtgaattgtacaatttaaaatagtaaattgtatggtatatgaatgatatcttaaaaggctgtttaaaaaacacgtaagcatgttctgtcaccacagtggaattagatttgaaaacatctctcaatagatctgcagaaaatcctcaaattataaataacctatgggtcaaagaagaaaaagcaatgaaaatcagaaaatattttgagctgaataataatgaaaataggacttattaaaatgtcggaagaagctaaagcagtgctttcttgggaaatttatagcaaaaaaagagaaaaattaaaaatctgttaagcttacattttaagaagctataagtttcacagcaaagtaaaccaaaagaaagaagaaaacatgacactgatacaaaaagattacactgatacaaaaatgataaaaaatctgaagagtcatatatcttctaacgaaattaaacctgtagttaaaaaccttcttacaaataaaattgtaggtccagatgactttactggtaaattcttccctatatttaacgaaaatgttgttatgaaaggttatatccaatgccttagttttctatagctgcttgctgtaaactgcatattcatatctcctcacttacaccccaattcatgtgttgaaacctaatcctcagtgtgatggtatttggagctggggcctttggaatgtgattaggtcatgtgagtggactcttcatgaatgggatgagtgccttataaaagagacctcaaagagctctctaatcccttccgccatgtgaggacacgagaagatggccgtcagtgaaccaggaagtgggccatcatcagacaccacatctgccagtgccttgatcttgcacttcccagcctccagaactgtgagaataaatttctcttatttataaaatacctagtctatggtattttgttatagcaatccaaagggactaacacactactgtatcaaattaccatatgcttagtgacttaaataacacaaatttatacttataattctggaggtcagaagtttaaaattgatctcattgggcccaaagcaaggtgtcagcagggctatgtgtcttctggaggctttagggggtaatccattttctttgcattttccagtttccagaggccttcctagagcttgcctgcctggattcctggcccatggccccattactccatcttcattgccagcaatgtcagtctgaatcctgacgctgccatctctctggctcttttatgtctgcctctctcttttacttaggcataggacttagccgtgtgtgactcctgtaatgacaagaacccttgtcattacattgagcacaactacataatccaggataatctccccatctcaaggttagctgatcagcaaccttaaggccatttgcaatttaaatatccctttgccatgcaatctaacatataggttctgtggtttaggatatggacatctttgggggtgattattctgcttaccacagccaatcttacacaactctttcactgaaaagggaaagaggaaacaccagttttttatgaggccagcataaccctaatattgaaacctgacaaggatattacaagtaaattagaggccaacatctcttgtgaatatagatacaaaaatcctaaacaaaaagttacacatataattgagtaatatattaaaatgataataccataatgttcatgttgggaagtattattacaggaatataaagtctgtttaacctttgaaaattcactgcattaatagaataaaagagaatactcatatggtcatcttaattggtacagagaaagcttttcatgtatgttcatttgataaatttgataattatgataaaaaattataagcaaattgggaatagaggggacatttttaatctgataaagtatctatcaaaaatgtttttcaaacataatacataatgaaatactgaacatttttctcctgactttggaaacaagataaagatgttcactgtaaatacttgtctccaacattatcctgtaatttctagacaatgaatgaagacaagataaagaaaaggaataaatattggaaaggaagatataaacccttttatttatttgcagattaccattttgtatacatggaaaatctagaaggctctaaaaatatagtaatagaattaataagtaaattttgcaatattttaattgtacagaaaaattaattatattactctatactatcagaaaatggttaaaatgaaatttaaaacaccatttaccacagcatcaaaagccaccaattacgtagagataaatttaataaaaaatatgcaatgctgctacactccataacttcagggaaaaatttccgtaacaagacataaaaatacttaccatatgggattagatgaataaatttgactacatgaacattaataacctctttattgaaaaaagtcatataaaggccaggcatggtggctcacgcctgtaatctcagcacttagggaggctgaggctggtggatcatttgaggtcaggagttcgaggccagcctcgtcaacatggtaagaccccatctctactaaaaacacaaaaaaattagctgggcgtggtggcgggcacctgtagtcccagctacttgggaaagctgaggcaggagaatggcatgaacccgggaggtggagcttgcagtgagctgagatctgagatcacgccactgtactccagcctgggcaactgagtgagactccatctcaaaaaaagaaaaaaaaaaaaagctaggtgtagtggcgggtgcctgtaatcccagctatttgggaggctgaggcaggagaattgcttgaacccaacagatggaggctgcagtgagcccagagtgcaccactgtactccggcctgggcgatagagtgagactccatcaaaaaaaaaagtcatataaaaagaattgaaaatagtaacaacatctgagaaggaactagaattcagctgtataaagaactttgtcagtggaagaattatggacaactattcattttctattgctgcatatcagattacaacaaatgtagcagcttttgtgcaagagtccacacacagctgagtcctctgcttgaggtgtcataagtctcaaaacaagatgttggctctaccttgttctcatctggagaatcagctgggaatgaatcggctgccaagctcattcaggttgtcctcaggttgttcttcatttccgttggttgtggattcttgatggctctgggttcttgatggctattggctgggggccacccacagttcgtagaggctgcccatagttttttgtcacatggtcttcctcagtatggctgcttacttcatggagctagcaagaagaatctctagagtgagtctctagcaagatggaattcataatgaaacataatcataggggtgacatcctgtcatctttcttttgataagaagctagtcacaggtgttttctacacaaagacatgaacaccagggggcaagggttaatgctaccttagagtgtgtccatcaccacaagccaatagaaaaattagcaaaagacttgaatgaggatttcagaaaaaaaactatacaaatagcatataaacatgaaatgtgcttaaccttattagtaatgaggaaattaaaaagtaaaggtacggtgctcttttatttatcatcagattggcaaaagataaagaacattatatttatacacacacacacacacacacacacacacacacgcagagaaagagagagaaagtttgttttaagggattggctcacacaactgtgtgggcttgcaaggcaagcaagtaggaagttttcaggacaggctggcaggctgaaaattccagcagggttaatgttgcagtcttgaacctgagacaaaattttttcctctttatgagacctcagtcttttctcataaggccctaagctaattggatgaggcccacccatgttatggaaattaatctgctttactcaaagtttattgatttaaatgttaatcacatctgaaaaatatcttcacaacaacatctatactagtgtttgaataaacaactgagcaccataaccaagttgacaccatcgcacacatctgtaagtgtttaccactatgcctgaaaatattgtagctccttaatgactgttacttgttttcctttctgaatgagactttacttgggtctttattttcaaataaggttataaatctgcctgcatctttccagatatacccacactgctttagtttgaggcactcagcaaaggtttctggaataaatagacagaattatagactcatcttatgtgttcctgaagcactctgttttgttcccttattaagcacttagcacttgtttgtattcttcactacactctagcttcattgaatttcagggatggtatctttttcttcattgtgaaaaccagtatattttccagcatatagtaagctctaaatatttgttgaatgaatgaatgagctggaaatactttcatgtaatttttaaagcgatctgacattgcattaacatatgatgttattctcaacttgcttaaatgctattaagaattttagttcttacttttacactgttggtgggactataaactagttcaaccattgtggaagatagtgtggcaattcctcaaggatctagaactagaaataccttttgacccagccatcccattactgggtatatacccaaaggattataagtcatgctgctgtaaagacacatgcacacctgtgtttattgcggcactattcacagtagcaaagacttggaaccaacccaaatgtccatcagtgatagactggattaagaaaatgtggcacatacacaccatggaatactgtgcagccataaaaaaggatgagttcatgtcctttgcagggacatggatgaagctggaaaccatcattctgagcaagctatcgcaaggacagaaaaccaaacaccatatgtcctcactcataggtgggaatgaacaatgagaacacttggacacagggtggggaacatcacacactggggcctatagtggggtggggggacgggggatggatagcattaggagatatacctaatgtaaatgatgagttaatgggtgcagcacaccaacatggcacatgtatacatatgtaacaaacctgcacattgtgcacatgtaccttagaacttaaagtataattaaaaaagaaaaaaaaagaattttagttctttggccagatgcagtggcttaagcttgtaatcccagcattttgggaggctgaggcaggaggatgacttgagcccaggtgtttgagaccagcctgggcaacatcttgaaaccctgtctctacagaaaaataggtaaattagctgggcacggtggcctgtgcctgtagtctccaaggccagaggatcaattgaacccaggaggttgagtctgcagtgagccatgattgtgccactggaatccagcctgggcaatgaaatgagaccccatctcacagacaaaaaaagagaatttaaataaaatttaattttattgaattgaaaataattcaataaaatttggtagagatgctttgctcttgtggataatcaatctgatagggacacataggtgaaagttaaagaccaataggaattaggaaaatttctgccatacagtatgtatgttttagtcatactgttcacatttacctattataaatgtagatatttacccaacaaggggtgtttacccaacagccattgatcatgacaaatatggcaaatattgcataagtttctagaatattgtgaggccccatgcaggaatttataatttatttgtaaataatctgctttttttaaataaggaaaaaatccataaaaacacaaatatatttaataaacatacacacataaatacattcttatttatctatctcctttcttttaatttttaaaggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacaggtaagtttcccaactgtttattatttctgtttcaaaatgttgattacagttaagtcctcaacattttggataggttcttggaaactccagctttaagctaaatgaccatagtttttttcggtgttataatgaaatgacattattttaagatgtgctataagttgtttcacttaaaatgtcagttttcaaaaacttattgatgatattgaggactttactgtattttaataaagtattaccagttttctagttctatgttataactagatgatggattcagcctatattcttttccttatttatctagtagtttttattctaaataaatatcttctcattttagtggttattaattttttaaattaaatggtctccatctgagctaaaatataatggtattctacccatcctaagatcttagtaaatattaaagtattttagtatacactactttagtacctattcatagtacccagtaaatggtgtttgatcttatttctgctttactaatagtaagggtttacctcagatccaatgttgacttttcaaaaatattttgtttccttcaaggacacacagatactttctaggttaaagcctttgaactttatggagagattggaattttaggatgcgttgcagttgggatcttggttaaaaattaaacagattttctaattgtgttcaggtaaaaaacttgtacctcatttaccgtatatatttatctattttattctataagctgtggacatcaaatgctgaaatatgtttcaacatctgaatcagatggtacagattgctgcagtggaaaatcaggtgagattacaaaagtcatatgtatttgagtttaagagaaatttcttacaatgatttttagaatgggaaaatgaatgagtttaacttcagtttatccatctttaaaatgaagattattattttttacccacttcacagaggacttatttagaacaaattataagtaatagatggtgaaagtaattcaaagaataaaaatgtcccatacaaatgaatgtagtcttcttaggttatgtctattgtttataaatagtggaattatttatattaaacattgaaatttgtagtgcacaatctaaatccaaacggttttgcataaattttttatggcataaagaggggttgttttaaagtgtggttaattatatcattctgaaatattttgtatcctcatacaagacatattgtgttgatgaaattatagttgttttataaccttaaaatttgatgactcaaactaccagtagtagttaactaagtaactcagaccaacatttcccctgagggcagctagaaaaggtggatgaattatttttttaaaaaaaatctacttgaagccattgaagaactaaaaaaatcttatgaatcaccagtacaagatctgttggaagacagaactccaagaaagtgagcctggagtttggggctatcaaaagagtgtatgccaattccacagagaccaatgactgataggatgagcaattttattagcagcttcatggggctaggaagacagaggctagagttgaaggcttgccatggtttggataacttgataaactctaaagtgttgtatcctaagaaaaaagttaaaccaaaaatagataagccttttcagggattataggttcttctcaatccctttacataccataaaacttacccttttaaagtgtgcaatttaatagttttttgttttttacattttaaaggattgttaacaaataaaataaaataaaaagactaattcttcacaaactcttccaaaaaatagaagaggagggaacacttcccaactcattcttttttttttttttgtatatcattacaatggaattcagttcagcaattaaaggaataaacttctgatacatgctgcaacatagatgaacttcaaaacattattctaagtgaaagaagccaggcccaaaagatcatatattatatgattacatttatatgaaattcttgaaagacaaatttatagagacaataatcagaacagttgttgcataaagtgagaatagggattaactataaataggcatgaaggaacattttgggtgggggtgttgagaatgttctaaaattggattgtaatgattgttgataactgcaaatatactaaaattgttaaattgtacacttgtgggctggatgtttgtgttcctccaaaaattcatgtgtcgaaatcctataccctgatatgacggtattgggaggtaaggcctttgggaggtaattaggtcatgaaggtggatccttcatgaatgggattagttcccttataaaagaaccccagaaaactctctttcccaccctctttcccaccgtgtgaggatacaatgtgaaatcggtagtctgcaatactggaacttggccaggctggcaccctgatatcagacgtccagcttccctaactgtgagaaataaattcctatttttttataagccactcagtctgtagtatccaattatagcagcctgaactaaggcattttacaatgggtagattttaatggtatgtaatttatactcaataaagtttttaaaaagaacaataatttattaagtgtcatatttctttgggtggactagcctcaactgggagattctcacctgaggactttgatgagattgcagtcagtgcagtcagatattggttggggaagcagttatctgaaggattgattgggcagaatttccaagatgggttactcatgtgccttttggctattgaccagtccatctaaatatgacccctccatgggcttcttcagtttgttggcagcattccaagagagtaggaagtggaaactaccagttcagttaatggctgaactcagaacagagtgtcacttctgccatattctgttatcagagcagtcatgaggcctgttgagattccagagggttggtaaataaatgctctgtcttgatagaggagtgacaagaatacatttcagaaaagtgtttgggacaagagatagtgttgtagacatctttagaaagaaatgcttcatttacctcacctgtttttattattatctgtaagataatagttattaggagttcatatcattaaaaagtaaattatgtaatatacctcaagtgcaaacaacttttagattaacttctattttagaatatcattgtagttattgccttaccttaccaagaatactcgaatagtctaaatttaatttcttagactaatttttttcatttggaaaaaataatattttctaaacagtaatacttccagatcatcatctaatcaattaatgattggtatattcattgtattaagttgagattatactgacatttattaatcacctattatgtataacatcttgtaagatgggtattattatccaaattttacaggggagaaagcttgccattattaagtacgaaaatcaggatttgaacctagttttctgaaactcaactccaatgattactcttaagaatttttttttttttttttgagacagagtcttactctgtcatccaggctagagagtacagtggcacaatcatggctcactgcagcttccaactcctgggctcaagcaatcttccctcctcagtcttctgagtagttgggactacagcaccatgcccggctaattaaaaaaatttttttttgtagagatgagaactcgctctgttgcccaggccagtcccaaacttttggcttcaagtgatcctcccgccttggcctcccaaagcactaggattataggtatgagctgttatgcctggccaagatctctttttacaaaaaaacaaacaaaactctacatattgagcttatagcatgtaattatcatataatcagcacccagatccagaaacaaaataagaggctggccaaaatggccaactagaagcagctaatgtgcactgctgtcatggagagaaatagaaggggtgagtacatacagcaccttcaactgaaacatacatgtacacatgttgggattcatcaagaaaacaacccacagagaatgtagaaaagcaaggcaggatgactgcccacctgggagtgacacggagccaggggagcctccctcgcccagggaagcatgagtaagtgggcaaccctggggacccatgcttctcccataggtctttgcaacccttgagtcaggagaccctcctcgtaaacccactgcaccagggcttgcagtctgatatgcagagctctgtggcatcttggcagagtagctgctcaggcacatgtggagccccaggagctatagatacttgggtttctaggcaaaagcagctgcaacttggcaaagtaggaggttagacccccatacagacccctaagaagtagctgaattcaggggtctgagcagcaatggtcttcaggtcccatgtccacagcaccttgcaggataagaccactagcttggaactccagccagccactggtagcagtgttgatggagctcccagagggaggggtaggctaccatctttgctgttttgcagccttagccattgttgccttcagtgtaaccaccctacaaaaatgcagccagcttgcttttttatgtgggtccctgacctctcttctcctcactgggcaggacctcccaaccaaggtaaccagccactcttgccactgtttttcagctggcagtggttccgagcctccctgagatagtgctcccgggggagggacaggccgccatctttgctgtttcacagccttagccattgttgccttctggctctaggaagtccaaggtgactaggtactggagccgtctctcaccgcagcacagtagctctatgggaaagcagctagactgctttttcacatgggtcccagatcttatttcttttcactgggcagaatcctgtgaccaaggtctacaaccacccctgctagtgttttctgtccagcaacagtttcaaactttgctgggatggagttcccagagggaggggcaagctgccatctttgctgttttgcagccttaaccattgttgcctttgggatttggagagtccaaagtgactgggggctgcagcagaccccaaacacagcccaactgttatataaagaagtggccagactgcttttttacacaggtcctcaaccctatttctcctcactgggtgggacctcccaactagggtgtccagccatctctgctggtgttttctgaccagcagcagtttcaaacctccctgggatggagctcccagagggatagggggactgccatctttgctgttttacacccttcactgttgataccttcaggtgctagataaaccaaggtgactagggactggagtgtacccccagcatactgcagcagccctacagaaaagtaaccagattgtttgttacttgggtttccaatctcatatctcttcactgggcaggtcctcctggcctgggtctccagctcccctcacctccaggctatcaagccagtagcagctctggaactccctgggaaagaactcccagtgggaggggtgggttgctatctttgctttctcacagccttaggctttgctgtcttcaggctttggagaatctgtggggaccaggggctagctagtccatacccgagcacagagtatccacctcacagaaaagtggtcggactgttctccacgtaggtcctggtcctcacttctcctctcaacctggtactctagcacaaacacgctgtccctgtcagaccacatcaatcagaggcagcccagcagttaaaggaagagccacatgcagagataagaaagaaccaatgcaagaactccagcaacctaaatggtcagtatcttatgacctccaaacaaccacactagttcttaaccaggctgagctggctgaaatgacagaaatagaattcagaatatggataggaacaaagataatcaagatcaggagaatggcaaaacccagttcaacaaaactaagaatcacaataaaatgatacaggagctgacagatgaaatagccagtatgaaaaggaacctaactgatctgatagagctgaaaaacacactacaagaattttgtaatgcaattccaagtacagcaaaagagaccaagctgaggaaagaatcttgaaacttgaagactgactctctgaaataagaaagtaagacaaaaattattttaaaaagaatgaaaaggaatgagcaaaacctctagaaatatgggattgtgtaaagaggccaaatctacacatcattgacatccctgacaggagaaagcaaacaacctggaaaacatatttcaggatatcatccatgaaaacttccccagccttgctagagaggccaacacccaaactcaggaaatacagagaactcgtgcaagattctactcaagaagatcatccccaagatgcataatcatcagattttccaagtttgaaatcaaggaaagaatgttaaaggcagctagaaagggcaggtcacctacgaagggaacctgatcaggctaacagtggacatctcagcagaaaccctacaagccagaagagcctgggctcctatattcaacattcttaaaaaaaaaaaaaatcttcaagaatttcatatccagccaaactaagcttcctcagtgaaggagaaataagatccttttcagataagcaaatgctgaggaagtttgttactaccatttgttactacgagacccacttaaaagagatcttgaaaagagcactaaatatgaaaggaagaaccattaccaggcaatacaaaaaaacacagttaagtacacagacccagtgatgtaaagctaccacacaagctggcttaataaccaggtaacagcacaatgacaggaacaaatccacacacatctatactaaccttgagtgtaaatgggctaaatgccccatttaaaaggcatagagtggcaaactggattttaaaaaaagtaagacccaatgatacactgtcttcaagagacccatttcacaggcagcaacacccataggctcaaaacaaagggatggaggaaaatctaccaagcaagtggaaatcaggaaaaagcagaggttgcaatcctaatttcagacaaaacagactttaaaccaacaaagatcaaaaaaggcaaagaagggcattacataatggtaaagggttcaattcaataagacctaactattctaaatatgtattcacccaacacaggagtacccagatttataaagcaagttcttagagatctacaaagtgccttagactcccacacaataatagtgagagacttcaacactccactgacagtattaggtcactgaggcagaaaattaacaaagatattcaggacctgaactcaatatgggaccaaatggatctgatagacctctacagaactctccactcaaaaacaacagaatgtacatttttctcattgccacatggtacatattctaaaatccatcagacaaccctcagcaaatgtaaaagaactgaagtcatgccaaacatactcctggaccacagtgcaataaagatagaaatcaagactaaaaaaaatcactcaaaaccatgcaattacatggaaagtaaacaactggctcctgaatgacttttgggcaaatagtgaaattaaggcagaaatcaagaagttttttaatacgaatgagaacaaagatacaacctacaaaatctctgggacacagccaaggcagtgttaagagggaaatttatagcactaagcagccatatcaaaaatttagagagatcccaaattaacaacctaatatcaccactaaaataactagagaagagagagcaaaccaacccaaaagctgacagaaaacaagaaatagccaaaatcagagctgaactgaaggtgattgagacacaaaaacaccatccaaaagatgaatgaaaccaggagttgattttttgaaaaaattagtaagataaataggctgctagctagagaaatacagaagaaaagagagaagatccaaataaacacaattagaaatgacaaagggggtggtaccactgaccccacagaaatacaaccatcagagactactatgaacacctctttacacacaaactagaaaacctagaagagatggataaattcctgtacacataacccctcccaagactgaaccaggaagacatggattccctgaatagaccaataagaagctccaaaacggaatctgtaataaatagcccaccaaccaaaataaataaataaaaataaagcccaggaccagatggattcacagccacatcctaccagatgtacaaagaagagctggtactatttatactgaaagtagtattacaaaaaactgaagaggaaggactgaaagtattacaaaaaaatgaggaggaaggactcctcccccaacccatactatgaggccagcatcattctgataccaaaacgtagcagagacacaagaaaaaaacaaaacctcaagccaatatccttgatgaaaattgatgcaaaaatcctcaacaaaatacttgcaaaccaaattcagcagcacatctaaaaggcaatccaccatgatcaaataggcttcatccctaggttgcaagtttggttcaacatatgcaaatcagtcaacctgattcatcacataaacagaactaaagacaaaagccacatgattatctcaatagatgcagaaaaaggcttttgataaaattcaacatcccttcatgttaaaaactcaataaactaggtattgaaggaacatacctcaaaataataagaaccatctaggagaaacccacagccaacatcacactgaatgggcaaaagctggaagcattccccttgaaaacgggcacaagacaaggatgccctctctcaccactcctatttaacatagtattggaagtcttgaccacagtaatcaggaaagagaaagaaataaagggcatccaaataggaagagaggaggtcaaactatccctgtttgcagacatgattctatatctagaaaaccccgaagtctcggcccgaaagctccttaagctaataagtaacttcagcagagtttcaggatacaaaatcaatgaacagaaataactagcattcctatacactaacacagccaaaacaagagccaaaccaggaacacaatcccatttacaattgccacaaaaagaataaaatacctaggaatatagctaatcagggaggttaaagacctctacaatgagaattacaaaacactgctcaaagaaagcagagatgacacaaacaaatggaaaaacattctgtgctcatggataggaagaatcaatatcattaaaatggtcatactgcccaaggcaatttatagattcagtgttattcctaacaaactaccaatgaaattcatcacaaaactagaaaaagctattttaaaattcatatggaaccaaaaaagagcctgagtagccaaggcaatcctaagcaaaaagaacaaagctggaggcatcatattacctgatttcaaagtatactgcagaactgcagtaacaaaatatcatggtactggtacaaaaacagacacatagaccaatgggacagaatagagagcccagaaataagaccacatgcctacaaccatttgatctttgacaaagccaacaaaaacaagcccattaatggggaaaggactccctattcaataaatggtggtgggataactggctagccatatgtagaagattaaaactggatcccttccttacaccatatacaaaaatcaactaaagatggtttaaagacttaaatgtaaaacccaaaactataaaaactctggaagacaactgagtcaataccattctggatatagatactggcaaagatttcatgacaaagatgccaaaagcaatcataacaaaagcaaaacttgacaaatgggatgtaattatactaaagagcttctgcacagcaaaataaactatcagcagagtaaacagacaacctatggaaagggagaaaatttttgcaaactatgcatctgataaaggcctaatatccagcacctacaaggaacttaaattgacaagaaaaaacaaacataaaaaagtgggcaaaggatatgaacagacaatttgcaaaagaagacatacatatgggcaacaatcatatgaaaaacagctcagcatcactgatcattagcgaaatgcaagtcaaaaccacaatgaaacaccatctaacaccagtcagaatggctgctgttaaaaaggcaaaaaataacagatgctggcgatgttggggagaaaaagaaacacttatacactgttggtgggagtgtaaattagttcggtcattgtggtagacagtgtggtgattcctcaaagacctaaaaatagaaataccatctgacccagcaatcccattactgggtatatatccaaaggaatataagtcattctcttataaagccacatgcgtgtgtatgtttattgcagcactatttacaatagcaaagacatagaatcaacctaaatatccaccaatgatagattggataaagaaaatatggtacatatacaccatggaatactatgcagccataaaaagaatgagattgtgtcctttgcagggacatggatggaactggagaccattatccttagccacaggaacagaaaaccaaatattgttatgttctcacttataagtgggagctaactgatgagaacacatgggcacatagaggggaacaacacacactggggcctgtcagagggtggagggtgggcggagggagaggatcagaaaaacaactaatgggtactaggcttaatacctgagtaatgaaataacctgtacaacaaacccctttgttacatgcttacctatgtaacaaacctgcacttgtaccactaaacttaaaaaataaataaatgaaaaaaaatcacagctagtgaagtagtgaggctaggactcatttctataagtagtatttagatttgaatccagattctattttactatatagtttgggctctatcttatatgtccatagtggaaaagtaataaatgattatcatagtttttctaagagaaaaggcaaagaaaagaagatgtagtatatatacatcatggaatactatgcagctataaaaaagactgaggtaatgttttttgcagagacatggatggagctggagtcaaactaacataggaacagaaaaccaaatactgtcacttataagtgggagatgaatgacgagaacacatggacataaagaggagaacaacagatactggggcctacctgatggtggagggtgggagaaggaagaaaatcagaaaaaaatagtaattgggtactaggcctagtacctgggtgatgaaataatctgtacaacaaactccatgacacaaatttacctatatgacaaacctgcacatgtacccctgaacctaagataaaagttgttttttaaaaaagaaacaaaatattacccacacctcaaaattacccatcatgaccccttccaatcatatgccccaaagataatgatctttttgtctttcatacgcttttgaacttttcttaaagagaatcagagagtatatacttttatgcctggcttccttcactaaacattatatttttaagtaccatccatattgtagttcattctctttgctctgtagtgatcaattgtgtaaatataccacaagttatttattctactgtcgataggttttgggtaatttccctgtttaagatattacaaatagaatgaatatgaatgttttttaacacgtgaatgaatgctatttagctatgaatactgctcttcttttccatgtgatttgagaaaagaaattattacattggtagagatataactcaccattaataatattatggtttaaggtttacatgtgatttaatcttattgatttgtaattatgattttagaatttttatctaaaactcagagatgttggaaattgtttatatcaaattggtaagaaaatttctattgataggaactttttctttttctcacttttataaagaatatccacttagcatccatgagtagatatgaaaggtgagtccaatacaggaagtgtctttgttgcctgagcataaggtatctaggcaaaatagcacaggaagatacaacttaatggtatcgtgaaataatttagattgaactccattatgattcattttatctaaatatttttaacaattatttttcatgtaaagctgtacatatagggcacattttactcctatatattactatatatattttttgaaaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatgtaaaagataaactttcaatatgattatgttaaggtgaaatataatactgttagtactggtttcattacttttgcccagaacaagatttttaatatagtagtattttttaatttttttacttataagtcactataactgaaatattgcttgggttacaaataatacagtaacttgttctaattctatcatcctaaagcaacaaactgcattcagttttaaatgaacatattttatttagttttatataaaatatattattttctattctgatattttcttttgcgtatgtgaaggtatagagaatatgtgcatgttactaaaaacaatgaaaacaatgtatttataatggcaatatagttttgttcttaaatttcaaaatttaggcttttaaggaaaagaaacacctatttcttttgaaaaattatcctggtaataaatgccaatataaggatatggttttttttcctcttaccctttgatacctgtaactactaaaatgaaaataatagactttggatttgtgtagtaatttggaaatataatacttttattcataaaagtaatataagaagattaataagtcttacacccaggagttatgtttttagtttttgaagataacattctagaaagagaaattagaagggcagataagactatatttaagaataaccattatagaaaatagtactgacttttttaaatgtttaatcctaagtgttctcattgtaatatatattttacagtatttataaaagataaaataaagttgttgtttccctgtatgtacagattgaacaggaagtatcactggacctgattttagtagaagagtatgactcattaatagaaaagatgagcaactggaattttccaatttttgaacttgtagaaaagatgggagagaaatcaggaaggattctcagtcaggtttgctttcaaatatctactttttaactgtaaattaatttttcttaaatctttataaaaagcaaaatctaatatgtaatggtttaagcactagttcaacaatgacattgttcattatttttttcagaaaaaaataaatatatacataaaacaattatatataagatgtagatcatactattatatatatgacaagtagtttatttgaccatattaatgggatttaatttatgccaaagaaataataaagatttacattttcttgaatgtggaggttgaaaaggatatgaaaatatcatctagttctaaccattgcaatttaagcttcatttttttcacctgcactccctatactttacccaaggccggatgattcatttcatgctagaaccatgggaaagtactttgattttaccacccagactcagggttatacctgatgggtccgcataacagcatcagattaactgccccaaaatattactctcattaattactttcatatcttatttatgaaatgcaaaaacgtaaggataaattttgtgaaatatataagttcatttaattgaagttcttagggataaaaatgtgataaacttagtattgttttgaattttgtttttaatacccaggactagattagaatagaattcacatgaccttcagtaaattaggaataaaaagctaaggagaagaatggaaaaattaaaaattgggacatgatatgtatggtaagccttctttaattttcagtggctttagggtgacatcttccattctgatttttttgaaagaattaattgtaggcaagttttaaataaattattaaagacgtatattaatacatggttaacattccagaatacaaatcacaaaaacattatactcagctacaaatagaaattctgatttttaaagtaaactttattttaattgacatttaggttatgtataccttatttcaagacactggtttattggaaatatttaaaattcccactcaacaatttatgaactattttcgtgcattagaaaatggctatcgagacattccttgtaagtattaacatattttattatttaagttcaaataatatgggttttgaaactctttatcatctttctcttcagatggtcccttaaacacttttaaaactgcttgtttgaaattttcttttttttttttcttgagacaagagtcttgatcttgtcgtccaggctggagtgcaatggcgcgatcttggcccactgcaacctccgccccccacgttcaagtgattctcctgtcttggccctcgcaggtagctgggattacaggtgcccgccaccacacccagctaattttttatatttttagtagagatggggtttcaccatgttggccaggctggtgctgaactcctgacctctggtgatccacctgccttggcctcccaaagtgctgcgattatagacgtcagctgccgcgcctggcctgaaaaatttttaaatggagttttaaaaagaatatttgtattatactacctagatttaactgactactgttaacattttgtctgttttttgttaacattttggtatatattctccaagagttcttacataaatttattttttgtaaaggtggtcataatattgatacatatttatgatctgctttttcacctggttgttatacagtatacatctttctatttttaaaattaattgcctgtgtactttatctttttaaaagttagtcaagagtttcagaaaatcattcacttaaaaatgcttaaaattgatcatctaatttcagtttttaactgtgttctgatttatggaataatttaatggctattatatattatgtttgaatataatttgagtttcatattagaaaaagatggactgtctttatatattgtctacagtttccctccatgtggacacatttttgagaaattaattctataaatagtgaattattcttcaattggcataactcactaataatgtttaataatttaagatgagttacatatactataatttccacttatatattgtgcattcaaaaaagtggttggattttataaatggaatatagggatactttaagatggacttcaagggaaatggaacgaaaagaaagaggtggtaaggagtcttcactgtcagcttcagttaggatacattagttaagaaaatagtctctggacctaacttttctaaactttaaaaatttgtgaatgagaataacaatagtacctactccataggtagtactaatataagataattaatgtaaagcacgtatcagaattcatgacacttagtaaattgttagtaaaaggtggtgatttattaataataattaagttcccagtgtacgccatgtcatatctataggcaaaacaatattattttatctactaatgcatacatacacattaaatatttgttgaagtgttaaatttttattggatatcgacattaactgcaatcattagattcacataggttatcttattcaatcttttttggcaaagttgtattatctaacttttataggtgagaagtaaactcagaaggatctttcccaagattataaaactagataccaaagtagtgtttcagttttaggtctatctgagttctgaagcctatactctttacactatgccacattgccttttcacatagttgaatttcaggaaatagatgttttattgatcatatatgatgtgtcagacactgtgctggatgctttcacatatttagtatttaattcctgtggcaagcctgagacatagtatttctgacctttttgtgggggacacaaatgtaagtaaccagaatttgtaactgttctgtgtacaaaactgttttgtgtgcaaacatgggtctctgtaatccagacactacatgatatttttgaaagccagaaaatagccaccttgagaacattttccaatgcctttcaatactccttggttatcctgccttttctttggcacctttactatgttttcatagtatatgggaaagtttttaaaagatattttttttaatacatcaagagactttagatgaaataaaattcaattgtggggaattagtctgtcacatcttttttatgaggatatagtatgactaggaaattattgtactttttaaatgttgtgtgttaaacctaacagaaaaacgttttggtgactttagatcacaatcgtatacatgccacagatgtgctacatgcagtttggtatctgacaacacggccagttcctggcttacagcagatccacaatggttgtggaacaggaaatgaaacaggtacttccttctacaaatctcttaattattttgatcaggaatagtaaatcaagctttctcatttcattacctctgttcttttaagtttttcattaagtaaccgtttagtacatacgaaggactgtgtacgtttttttaaccacttatccccaagttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaaattttttttttgtttcaagtacatcacatacatttaaaatacataacattcaaaaaccaaagagaacattttcaaaagccttgcaaagtatttcaatgatgacattaaaaacttttataaacaaattttgcttccaaaaaagttaatgctattccttatcataaatataatagtttatataaatacaatgaatcataacatttatagttctcttattctagcttattaaaagggccaggcctggtgactcatgcctataatctagcacttctacaggcttaggcaagaggatcacttgaggccaggagtttgaaaccagcctaggcaacaaagcaagaccccatctctacaaaaaaatttttaaaaaatttagctggatgtggtgacacacacctgtcctagctactcagaaggctgaggtgggaggatctcttgagcccaggagttcaaggctgcagtgagccatgattatgtcattgcactgacatatatcaagacagaatttgctcagttaccaatacttgagaaataacattaccatactaaccagtgtaaatgtcatagactcaaccactgatattactttttacattttggtagttgagtctaaagtatgcattatttgtttaatggatttgctttatgtcactggttcatttttgtctgccatctgtatttattctttctagtgcccttcattccttccaccagtcctgtgcttttattagagataattttcttcaacttttttgttttagctgtcattttgtcttagaagaatatatttatattttagcatgtttgaaggtattattccataatcttgtgactttcacagtttttgctgacaagtcaagacttaggtcatattgagaaatataatatataaatataatatgttcctttttctctttcctattggtttttagcattttaactatgatgtactcatgtaatttttttttgtattaatcctgcctgatgtttagtgaaccttttgaatatgttgattggtagttttttactggtttctatcatgctcttcaaaattcagcctctccattgtctaattccaaagccgctcccacatttttaggtgtttgtcacatcagtacctcacttctaggtgccaaaagtctgtattagtttcctattgctgctgtaataagttaccagaaatttagtcactgaaaaccacacaaatttattatcttacagttctggaggtcagaagtccaaaaaaggcttcactggagtaaaatcaaggcatcaacagaactatttttctcctatatactctagaggagaatttgtttccttgcctcctccaattacactccttggctcatggccctttctttctttctttctttgtttattttggagacggtgtctcactcagtcacccaggccagagtacagtggcttgatctcggctcaccgcaacctccgcctcctaggcgggttcaagcaattctcctgcctcagtctcccaagcagctgggactacagatgcacgctgccatgcctggctaatttttcgtattttagtagagatggggtttcaccatgttgcccaggctggtctggaactcctgagctcaggcaatccgcccacctcagcctctcaaagtgttaggattacaggcgtgagccactgtgtctggccggcccattctttaaagacagcagcataacatcttcaaatttctttttgaccctgaccttttgatctttccaaggaactagtgaaaatcaatccagctctgcaaccttggctttctgtgcagaacacacttaactgacagtgactctcttaattttagtctctcttgtagtctggataggctgagaatttcctgaattatcaagtccttattcctctttgcttacgagttctcccccaatctttctttttcctctcatatttactataaacagtaagaaaccagactacaccttcaatgctttgcttggaaatttcctcaactaaatgtctaagttatcatttgtaagttttgtattccacataactgcaacacctaattcagccaaattttctgttactgtgtaacacggattcccttgcctctagtttccaataacatgtttctcatttccttctgagcattcattggcaatgaccttaatgaccatttttctatctccagtctgttctcaatgacttaggtatagtattctctaagacaatatatgttttctctctcatgctgcacacttccttctgagttcttactagcagtgttatgagttctcatacatagtgttatggagccaagtatctgtagaagaaaggaaaccaagtagctttgggaaaccaaatagctattgcaatggaaaattatgatgaaaactaagacaagaaggaccatgggatgtgctgtcctattctcactgcactggagaactaatggaaaataaatgacaagtttagggctgtaattaatggttggagaaccaggtagcatctctgactgacctaaaagaaacccttattttttttttaatttattttattttattttttttttgagacggagtctcactttgtcgcccaggctggagtgcagtggcgcgatctcggctcagtgcaagcgccgcctcctgggttcatgcgattctcctgcctcagcctcccgagtagctgggaccacaggcgccctgccaccatggccggctaattttttgtatttttagtggagacgggttttcaccgtgttagccaggatggtctcgatctcccgacctcgtgatttgcccgcctcggcctcccaaagtgctgggattataggtgtgagccactgtgcccggccaagaaacccttattttttatagtaataggatcataacttctgaaaataaaacccaatgtctgatcctgaagttgcttgaaatacaatgcaaatgagtttgtggcctcagtagacttcttatgttagaattaagatatcaaatgggaaataaaggatcctgataatcaaaaagagatcatttggatagatttaaataaatgttgccttgtattccccaaatcctgctgattcttcatgctgggaagcagtcatttctccttgtgttgattgcctgaaaaccctgtaattacctcacttgagattcttgatttatagggaaataattcacttctaaatccaactccactgtcactcatttctttgagatccataattaaacttaaatcctgcagatcttaggggaataagtattaagtctgaacaccagaataatttaccaattcatattggtagaaacctgggggatatatgtctgaatagacttaagggtgttagaccagggagaaaggaagatgtacctaccagagattctggagtcagtgtattagcttgagcaactggcagtggctctaacagtttgcctcatgagttgtctaaagtataggcatcagatgaagtagaattgttgaaactccttgtatactgtagaggaaggaatccagaagctcacaatgttaagatgttgaaatggggtgatcatattcaattttatcacccatccctaattttatccccaagaagtatcctcctttatcacagtggtgagaaatatatttcagcattaattcctggagagtgaaatgctatgctggtcctacagccagagttaggggcctatggaatttaggtgataaaaggattttggcctgggttcatctcataatggtagttagcagaaccacacccattttctgaatgtatagtttgagtaaacatattcagcaactgtcagaatcccttcatcaattccttgatctttggaaagaggaccatcgttgtaggaaggatcaaatggaatctccaggaattgcctcattctggcaaaacagtgaaccaaaagcagtataccacattcctagatgagttgcagaaatcagtgctactagcaaatacttaatagatgcaggaatggtgatttccatcacattgctgttcaacttaattatatagcttttacacaggataagtagatcctggaaaatgatggtggattattctcaatgtaatcaggtggttactctagttgctacagctgttccagatgtggtctcttcttttaataagttaacctaacttgtgatatttggcacagagcaattgatctggagagttgtttttcctccataactcatagcaaaattcacaagaagacatatatttacatctggcaggcatcacaatacacttctattgtcttagttctgggctatgtcaagtctttcattctctgttataatctagtctgttcccgtaagttatcaaggtcagccattacattgatgagataatgatgaatagctccattgagcaagaagtaacagatatcctagatgccttcataagagtgccagaagatgagagatgagaaaaattgctaaaaaattcagagatctgtcatatcattgaagtatactagggatccagtggtctaggacatgttgagatatttcctccgagttgagggataactgatacatttgaaattctctacataaagggctctttggattctgaaggcaaattcatgacttctgagtactattgctccaaaatactactgtaaggctgtatgtgcaacccagagcaagagaagcatgtgaagcaatttctactcgttgtgcaaattactctgccatttttccatctgactgccaaaagaaaatgtcttttgcagatagagatcccctttggagtctctagaagaccactacaagataattacagtgtaaatacatggagttttgaaacaaaaccaggcagctttcctcaaataattattttcctttctgtaaaagcagctaaattgttgttgcactttggtagaatctgaatacttggccatgggcactagattaccatgttacctgcccataatgaatttggggccctctgatcctccagttcataaatttgtcatgtgcagtagttctcaatcatcaaggggaagaattacttacaagattagttttgagttgctcctaaaagcacagaatgtaagttcagacttccatgacatttattcctaatacaccaatacctcttccttaatccatagttacggctttgtggggaattccctatgaccagttgacttaaagagaaagaccagttgccctggtttataaatagttctgcccaatatgccagtacttcctcaaagtggatagctacagcattgtaggatcactcaaaggtatcttttgaaaggtaataaggtaaatccttccagtgagcaggtcaagcggtgaatcagttggtcaagaaagagacatggccagctgaaaggatctgtactgatttatgatcagtagctaagagcttccttggatgctttgggacttagaaggaaaaatattttaaaattggagtttttaattggacaaggtgttttagttagggggtttatggctaaccttcccagagtggaaggtggatatttgtttgcgatgtgaatgcttactatgatgcttaattttacatgtcagcttggctgggcagtagtacctacatatttggtcagacattaattttaatatttccttcagggtattttttggatgagattaacatttaaattgatggactttaagtaaagcagataaccctccataaggtcggtgggcctcatccagtcagttgaaggccttaatagaaacaaagagtgacctcctctgagcaaacaggaattccaccagtagacagccttcagacttgaactggaatatcagctcttccttgggtctttagccaatcagcccaccctgcagattttggatttgccagcctccttaatttcatgagcaagttccttaaaataaatctctctctctctccctctctctctctctctatatatatatataaaatatatatatgaattatatatattcatatatatatatgaataaccctcactaatatataatatttgccaaaggccattcactgcaaagaaggctcttgatgatcaggtggacaaaatgatctcttatcttatagcgatcagtctctttccctatgaactccagttcttattccgtgggtttatgcacacaacagctaagtgtattagtctgttctgacattgctataaggaaatacctgagactgagtaatttgtgaaggaaagaggcttaattgagtcacaattctgcggctgtacaggaggcatggctggagaggcctcaggaaacttacaatcatggctaaaggtgaagggaaagaaaacaccatgtttctcaggctggtctagaactcctgagctcaagtgatccacctgcctcggcctcccaaagtggtgggattataggcatgagccaccgtgcctggcccatgctgttttgattactatcgctttgtaatagattttgaaatcaggtagtctgatgcctccagctttgttctttttgctcaagattgctttggctacttggaatgtttttgtggtgccatatgaatttttttttctatttctctaaaaatgtcattttttttgttgctaagtatgtagaaatgcaattgatttttgcatgtttatcttgttccctgctaacttgatgaactaatttattagttctaatagtttttcagtagatttcttgggatttcctacatatacgagattaggccatctgtgaataaagatagttttgcatcttcatttccaatctggatgtcttttactgaggcgtccttttaaatgtgtcagcaaatttttaaaatcacagttttctgaaacgaagtgaataaatgggattctaagtagttatgtttcattgcccttgccaactgtgttcttttttgtactgttatttttttggaaacatatataagctaatgttttaagatcctaatatataaattccaagtaattactgaatttaaaaggaaatattttgccatgtttgatttttaaaatatattttaaaattgtagggaaagtccagaatgtgtatcacataggaaaattcaaattattgactctgtattgatatttaaagtcttattagaaatttgagtgcttacatatatcattatgcatataatttaactgcctcatgtttgctttttataattatttaaaaaatagctctaagccggtgtagtggtacataactctagtccaagctactcaggtggctgagggcaggtcaattgagatgaggaattagagggtgtagcgtactattacgattggacctatgaatagctagctgctgcactccaacctgggcatcatagcaagaccccatctctaaaaacataaattttaaaaaaatgctctagtgtgggctattccaaaacttaattttgatacaaattataaatagcatgaaaataatgagatatatttataattgtcactagtgtattaaagtcatgttaaaaaattcttgtgatggtgtattgagtcaactaaaataggattaaataattcttttggactttaacaagccagagcattatttctaggttcccccaatgaatacaaccaaggaaactttgtacctaatatctgtggttttatgtgtctactttaaatatagtttctttttccttcttatactttttaaaggtttcttttgcaaaaataatagaatgatcatctagatagataaagccaccaaaaaagaagaaatcaatggtaagatattaagacaccagaagcacagtgtggatagtgaacatattgtttctaagaagaggataaaaatagagttatgttgactgagatgttccccagttttccatgccttttcattttccactattttttattccgttatattatatggagcttcatgaaagaaaacaaaagggagataaggagttgtagttagggctacaaatgaaatgtaatctttccggatgagatttgaaaagcatctatgtagagaagcttagtttggtaagatattaaattcctaaatctttgtaatgttttcatcaaattttattctctagtattgcctttttctgttatatcatatatcctggccattgtatctatctagtcattaaacagcaaatatttagaaaatcagaggtttttaaaattattatttgcctgagtaagcatcaaacttgtgtgagaatcctatcacgtcttgtaaagtaagcaacttcagggtcagatttaacactgttcctctctactaacatgttaaattgggaataatatactcttttaagttcatagattttagttcttacttaaatcagcaaataaaataagtaagcatattacctatgagaatcccctccatagcaaaattgtgaggaatttatgtgctaatgctggtttattttgctatttattgtttctcagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggtaggaaatatttttaagaacctttaaagagtaattctgaaattttcagtcatgctgtgtatccctttataaatcattcagttgaatcatatgtccaatccatctgactttaataccctacattttaattaattggataacacatggcattaatgtgatgtgtgctaggaaattaggggaagaatcaacttcttgaactagaaaataatagacagtttttgaaacaactcattgttttgtgaaattctagagtccttgctgtcaatatttttgtctttaatcaaaccagcaaaactctgactgtatttaagatttctgttccgctggagccaagatggccgaataggaacagctctggtctacagctcccagcgtgagtgacgcagaagacgggtgatttctgcatttccatcggaggtaccaggttcatctcactagggagtgccagacagtgggcacaggacagtgggtgcagcgcaccgtgcgcgagccgaagcagggcgaggcattgcctcactcgggaagcacaaggggtcagggagttccctttcctagtcaaagaaaggggtgacagacagcacctggaaaatcaggtcactcccaccccagtactacgcttttccgacgggcttaaaaaacggcgcaccaggagattacatcccgcacctggctcggagggtcctatggccacggagtctcgctgattgctagcacagcagtctgagatcaaactgcaaggcagcagcaaggctggggaaagggcgcccgccattgcccaggcttgcttaggtaaacaaagcagctgggaagctcgaactgggtggagccaaccacagcccaaggaggcctgcctgcctctgtaggctccacctctgggggcagggcacagacaaacaaaaagacagcagtaacctctgcagacttaaatgtccccgtctgacagctttgaagagagcagtggttctcccagcacgcagctggagatctgagaacgggcagactgcctcctcaagtgggtccctgacccctgacccccgagcagcctaactgggaggcaccccctagtaggggcagactgacacctcacacggctgggtactcctccgagacaaaacttccagaggaacgatcagacagcagcgttcacggttcacgaaaatctgctgttctgcagccaccgctgctggtacccaggcaaacagggtctggagtgcacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagaacgcctctcctcctccaaaggaactcagctcctcaccagcaatggaacaaagctggacggagaatgactttgacgagttgagagaagaaggcttcagacgatcaaattactctgagctacaggaggaaattcaaaccaaaggcaaagaagttgaaaactttgaaaaaaatttagaagaatgtataactagaataaccaatacagagaagtgcttaaaggagctgatggagctgaaagccaaggctcgaaaactacgtgaagaatgcagaagcctcaggagccgatgtgatcaaccggaagaaagggtttcggtgatggaagatgaaacgaatgaaatgaagcaagaagggaagtttagagaacaaagaataaaaagaaacaaacaaagcctccaagaaatatgggactatgtgaaaagaccaaatctatgtctgactggtatacctgaaagtgagggggagaatggaaccaagatggaaaacactctgtaggatattatccaggagaacttccccaatctagcaaggcaggccaacattcagattcaggaaatacagagaacgccacaaagatactcctcgagaagagcaactccaagactcataactgtcagattcaccaaagttgaaatgaaggaaaaaaatgttaagggcagccagagagaaagattgggttaccacaaagggaagcccatcagactaacagcggatctctcagcagaaactctacaagccagaagagagtgggggccaatattcaacattcttaaagaaaagaattttcaacccagaatttcatatccagccaaactaagcttcataagtaaaggagaaataaaatactttacagacaagcaaatgctgagagattttgtcaccaccaggcctgccctaaaagagctcctgaaggaagcactaaacatggaaaggaacaactggtaccagccactgcaaaatcatgccaaattgtaaagaccatcgaggctaggaagaaactgcatcaactaatgagcaaaataactagctaacatcataatgacaggatcaaattcacacataacaatattaactttaaatgtaaatggactaaatgctccaattaaaagatacagactggcaaattggataaagagtcaagacccatcagtgtgctgtattcaggaaacccatctcatgtgcagagacacacataggctcaaaataaaaggatggaggaagatctaccaagcaaatgaaaaacaaaaaaaggcaggggttgcaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtaacctacaaagagacttagactcccacacaataataatgggggactttaacaccccactgtcaacattagacagatcaatgagacagaaagttaacaaggatacccaggaattgaactcagctctgcaccaagcggacctaatagacatctacagaactctccaccccaaatcaacagaatatacatttttttcagcaccagaccactcctattccaaaattgaccatatagttggaagtaaagctctcctcagcaaatgtaaaagatcagaaattatggcaaactgtctctcagaccacagtgcaatcaaactggaactcaggattaagacactcactcaaaaccgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccagaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaagagagaagaatcaaatagacgcaataaaaaatgataaaggggatatcaccaccgatcccacagaaatacaaactgccatcagagaatagtacaaacagctctaagcaaataaactagaaaatctagaagaaatggatacattcctcgacacatacaccctcccaagactaaaccaggaagaagttgactctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggattcctccccaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttcgggccagggcaattaggcaggagaaggaaataaagggcattcaattaggaaaagaggaagtcaaattgtccctgtttgcagatgacatgattgtatatctagaaaaccccattgtctcagcccaaaatctccttaagctgataagcaacttcagcaaagtctgaggacacaaaatcaatgtacagaaatcacaagcattcttatacaccaataacagacaaacacagagccaaatcatgagtgaactcccattcacaattgctacaaagaggataaaatacctagcaatccaacttacaagggatgtgaaggacctcttcaaggagaactacaaaccactgctcaatgaaataaaagaggatacaaacaaatggaagaacattccatgctcatgggtaggaagaatcagtatgaaaatggccttactgcccaaggtaatttatagattcaatgccatccccatcaagctaccaatgactttcttcccagaattggaaaaaactactttaaagttcatatggaaccaaaaaagagcctgcatcgccaagtcaatcctaagccaaaagaacaaagctggaggcatcacgctacctgacttcaaactatactacaaggctacactaaccaaaacagcatggtactggtaccaaaacagagatatagatcaatggaacagaacagagccctcagaaataacgctgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggagataggcatgggcaaggacttcatgtctaaaacaccagaagcaatggcaacaaaagccaaaattgacaaatgggatctaattaaactcaagagcttctgcacagcaaaagaaactaccatcagagtgaacaggcaacctacaaaatgggagaaaattttcgcaacctactcatctgacaaaggattaatatccagaatctacaatgaactcaaacaaatttacaagaaaaaaacacacaaccccatcaacaagtgggcgaaggacatgaacagacacttctcaaaagaagacatttatgcagccaaaaaacacgtgaaaaaatgctcaccatcactggccatccgagaaatgcaaatcagaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggactataaatcatgctgctataaagacacatgcacacgtatgtttattgcggcattattcacaatagcaaagacttggaaccgacccaaatgtccaacaatgatagactggatgaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcagtcataggtaggaattgaacaatgagaacacatggacacaggaaggggaacatcacactctggggactgttgtagggtgggggaaggggggagggatagctttaggagatatacctaatgctaaatgacaagttaatgggtgcagcacaccagcatggcacatgtatacatatgtaactaacctgcacattgtgcacatgtaccctaaaacttaaagtataataataataaaattaaaaaaaaaagatttctgctcctcctatttaggcccattgtatggctagaaagctataatggttgagaactattaatcttttttgttgttctcttttttcccttaagatttgccttaataccagagctaaaatctcttacttctgaatatattagtgtatgtaaaaattcttctggtatattatttttgtacctagtatagctggtaaaatataaaattcctttaaggtcacaatttgcatgaaagaggcaagagttctcaacaaatagatactgtaattgcaatagctttaaacattaggacttggaactaaatatgtgttgtgttttgctttgttttgttttttgagacggagtcctgctctgtcacccaggctggagtgcagtggggcattctcggcttactgcaagctccgccccccaggttcatgccattatcctgcctcagtctttggagtagctgggactaccacacccagctatttttttttttttttttttttttagtagagacggggtttcactgtgttagccgggatggtctcgatctcttgacctcgtgatccgtctgccttggcctcccaaagtgctgggattacaggcgtgagccaccacgcctggccctaaatacgtggttttaagtagaatttagtgtggttgtggtttaagcagatttttgtgtggtagctgggtttgtttatgctggggattcctgaaatgtgatctgtgtgtttctaattggatgctttatgaagagtaggtgctcagtgatagttgctgaattcatctcacttcccacttctttattctatgtttaaaccttggctctgatcctttcattttctgtagccattttctgtttttcttttttttcttcaatctctttcatatactccaacttttttaaaaataggagatatattctcttgaattgtgagcatgtgtgttggggtcgggggaaggcatgtagggaactatgaatatgtatatgtgtaaatgggtataatggggtgtgtgtgtgtgtgtgtgtgtgtgttaatgggttaaaagggccatgtgattcatttatccaatgagactttattaatagctcatgatttccagaggtaactttctgattaatttaaatctagttactagtagttgcccactttctaagtattatttttttaaaaaagtaccttctaagtggcacatattttcttatttgcaataccattctgtaagaatcagatgcccattctctcaaacctagcacatcataatctttgaaaatcctagtcctttggtgaatcatagacctgaggattaatggcatagtggaaaaagcactggacgagattaaaagtcctgtcttagatttctgattgcccacttattagctgtatgacctcaaataaaggtttattcctctgaacctaaaaatagttatctgatatgattaaggaggtaacatatggaaggttttatactgtttctgatggcatgagaagctcctgaatcagaaatcacataggtagaagttacttactgttctagtccactctgctgttttgttttgctttgttttgttttgagacagagtcttgctgtgttgcccaggctggagtgcagtgacgtgatcttggcccactgcaacctccatctcctggattcaagtgattctcctgcctcagcctcccaagtagctgggattacaggtgcctgccaccatgcccggctaattttttatttgtagtagagacagggtttcaccatgttgaccaggctggtctcaaactactgacctcatgtgatctgtccgcctcagcctcccaaagtgctgggattacaggcatgagctaccatgccggcctactctatgtttttattacagctttcattttcgtaaagtatatcttccctcaaggatgttagaaatgagtgaattccaatgttaactgtctcacatgaagataatttaaaacaatgttatatgaacaacttatacaagttgcatactcaattgttgtcctaatcaaaatacagttgtgaagtctgaacatgatatcaataatcacgttatttctaacttctcattgttacgaattgccattagatgaagccataggaagtgctagaatggaaaggagatggattagagagttcagctgtgaaaatgcatagcctcttacctagtctccttgcttgttgtctgctctccttcagtctgttctcaacatgtcagccagaatgtgaccctgtttcagtgtgttgcatcactctgttccagactcttttgccaggcgctgtggctcacacctgtaatctcagtgctttgggtggctgagacatgaggattgcttgagcctaggagtttgagaccaatctgggcaacatttgagaccctgtttcaaaaaaataaaaacaaaatagtaaactctccaatggcattcaccttacccctagtaaatgacaatcataaaatgttctgcaaggccctacattattggtcccattaagtctctctctcttttttttttttttttaacttactcaagtctagtctcactggcttccttgctaataccatctctgtccctttctgagagtgtttgcactttctgttctccctgcccagagggcttttcctttagatatccgtatacgcattttgtcacctccttccatctaaaatttcaaaatccccttctttataccattatgctccttctctgctttttttccattgcagtgatcatttaggatactatatattttgtttatgtactttgttttttatatgtatcttctcaatggaatataaagttccacaagggcagggatttttgtcttttattccataatacctagaatagtgcttgacatacaaaaagcatttagtaaatatttgttgaatgttgaaggatgtctgaattctttgctctgtagtactcctaggttttctgaaaaatgttctgtgcttcccaaagtaacgaagtttatgaggccttcttcaactagcacctgtgagataaggacccttgtaaaaatctagggcttaatgtggttaagtaacaaagtaggttctttcatctttggaaactcagtgggtctagtcaggccataattaatgaaagatattatagtttcagtgtaatatagacagtagcatataataccaccagctgggtcaagcattcttcttcattctcatggtaaggaatgtgtgctagaaagatacaggaggattcttgccacgaaagaaggtgatacatatagtcaggtatatcctggaggaatgtcagtattaataagattctaagagatttctgagctatttccaaatgagaagttggctgaaagatgcaggttagtgcttgagatagtaaaatttctggaatatttttatgagactgggtaaaaggaaacaaaattttaagttgagatttttaaatgttttgtcttccaaaatatggattaagatgactaaacacatgaatctgttaccccttcttcctgagaatgcattaaaataatagtaagttatgaagttcattacaacagagagcagtaagaggaggatgggtattatcaccagcagataaaagttttttttataacatttctggaaaatgaaaaatggatgaatattgacagataaaacaaaagtacccagcacagctggaaccccagagactcctgttaccatttgctcctgcttgctctccctgtgcatacacacacctttatgcagagtgactaaaaccctatgtttacctccaggcagaaaactcatctcttagatattgaaggaactgcctggagagagtaacagttcctggagtgggtattagtagtctaaagtaaatttctctcattctagacatctaatagctggcacccattattctaaagcaaaacttgctaggtaacaaaccctatccacatttacatagttcccactcactcatcccaaggggagagactccacaataaaacatacataacagcagagagattacaactgaaatctagaattttttttttttttttgtgagacagggtctcactctgttgccaggctggagtgcagtggcacgatcttggctcactgcaacctctgcctccagggttcaagagattctcctgcttcagcttccgagtagctgagactacaggggcatgccaccacgcccagctaatttttgtatttttagtagagatggggtttcaccatgttggccaggatggtctcgatctcttgacctcgtgatctgcccacttcagccacccaaagtgctgggattacaggcgtgagccaccgcacccagtttaaaattcatttttctatatacacagaaaaccaaggatcatcagccatggcattaatcagaagcttggaaagaaaaggctaagatggaaagaataactgtcacagggagaatctagggaatagagaagcatctaattattttttttaaaatgtattctcagaatttgaaaaatattgcatccataaagtaagaacaggaaactataataaaggaacatcagaaaacaagttaggctcttagaaactaaaaatattactgcaggaaattttaaaaattcaatataagcattggaagtagaagtccaggtagtctgtcccaggacatagaccaggaagataaaaagagaatatagggaaggagaagataagatataggggactaggtcaagatgtgactagtggaagttctaaaaagaagggagtctttggattgaaggggctcactaagtgccaggaaagttgaatagagaaaaaaattcaaacaccacacatagcacatcatggaaaaatttcagaacaccagagattttgtttaaaaaaaaaaagaattcccgagaagatgaaaacaatacatctataaaagaacaaaaattcaactgtcattgtattttagcaacaatagatgctagacaatactggaatgaagtctctaaaattctaggggaatttattcatttatttatttgttcaagtatttattgggtgcatattgtgggataggcactatttaggcattgttatattaaataaaacatgggaaaaaatcttgcccctcatcgaacttacattctagtacagcaagaaaataaatacataaataatgtgtgtgagcaagagagagagagagagacagagacagagcaagagaaagagagaccaagagagacagacagagagagaaagagaagattatgacttaagagctaggaaataagtaaaatgagaggagataggaagtgctggcataagagtattattttcaagttagagttctatattcagctaagctaccattttacatgagagcaaaataatgagattctcagatatgcagtgattttaaacagtcatatcttgaccatcctcagaaagttattttaaaatgtatttcagcagaagaagggtggtaactaagataaaggaagataagggattattagaaatttttgaactgatacggtttgtctctgtgtcctcacccaaatctcatctcaaattgtaatcctcacatgtcaagggcagggccctggtgtgaggtgattagaccatgggggcaggttctcccatgctgttcttatgatagtgagggagttgtcatgagatctgatggtttaaaagtggtagtctcccctgtgtgtgctctctctccctctcctgctgtcttgtgaagaaggtgcctgcctctccattgccttccactgtgactgtaagtttcctgaggcttccccacccatgtggaactgtgattcaattaaacctcttttgtttataaattacctagtctcaggtagtatctctatagcagtgtaaacacagaaaagaacaaaccgagaacagtgtaaaagaatcctgagataacagctgtttgtcaagactatttctttaccctataaaaaaacaacaaaactagctgctttgtgttctgtggcaccttatttatctgctatctctctactgaatttttttttgagttgggaatattattttttaaatgaacaatctttcttaatctttttcacttgaagtgccttcttagttggccaggtgtggtggctcacgcctgtaatcccagcactttgggagtctgagaagggcagatcacgaggtcaggagatagagactatcctggtaacatggtgaaaccccgactctactaaaaaacacagaaaattagctgggcgtggtggcgggcacccgtagtcccagctactcgggaggctgaggcaggagaacggcttgaacccaggaggcagagcttgcagtgagctgagatcgcgccactgcactctagcctgggcaacagaacgagagtccatctcaaaaaaaaaaaaaaaagtgccttcttagtcatgagataatggctatgacctagatttttgttaatgtttcctcctgtttcttatgttttaaaaggggacatttgttcagattagtcagacttatcctttgtatgatctaagtccttcttatgtctgaagggttttctctttttgttcttatttaagtgttactatttgctaagattctgtcagtttgtattaaaccccttctcagatctttccaactcagagggtgaaaagtaagatttatgaccaactaatttgttttgccaaagtattgatgtatttgctgtagagagaaggatctatagctagaaaaagcaggtaacaagatgctttagcacaaagtcaaaggatgttagtttattgcagctccaaatgagctgggaccctgtcttttttctctgcttctaagagcccgcagtaagagctgaggcttcattatctgtttgcttgaaatgtttttcttatttggtttaagcttggtctgctgctctgtgtgctaccttcaagtattcttctaaagtagcattgacatttgcttcctacttactgcttcatgattctttcttgcctcccactcatctttgagcttgtgagtctactggggatcagcagggaaccccttccacttactcttcatataggctttttccttcttatgcagtgacttggttagcttttctcaatccattctcattttcaccatgtctttgaagtttccagtatggtcattatatctagattctaatactgattcagaccttcccccctccgcccattttatatttctttggcaatttcaaagggtaatttgaatggtgaaagaattccgaacttgctcatttttttaaaaaactgatcttgctatctgtaagtttattaagtcagctagcttcacagggcattcattgtacattgtgttgtattgagcccagaatcagattacttcctcctgaacagacagagctgttctcatagttaagtccttgtcacatttgagcatgaattagtcaaatcattattaaatgtaaatgaccccttagggagttttcgaagcttactctttctgtttggtatttataatgtttagaagttgtattacaggtggtatgaaatgcctttatatggctcattgcaaagtttaaatcataccattgcttttataaaaccaaatagcttaaaaaataatcacttagtgttatgcatctgtgcttaaatctaggctatagctaattttcacaaataagtagagctattcaattaagctctcagaatatgtatcctacctgagatctcattccgtccttctttctcattacacagtaggctccatgaaaacagggatagggttttaatttttatccctggcctttaacacaacttggctgtagaagtttttttaataattactatgcttatttaataatttaaagaattgcttaatttgtagaggtggaagaggctttagaaattctatactccactgattttaagtctgtattccaaagtcctagagtactgaggaggcacctcagggtcttctgctggagtgaagtgtagaaaaagtgagtagttccacaccatttgaaccagaggatttgtgtttttatctgttacatagttctgttttactcccaggccctgtgtgaggatgggaatccaggatatgtccatctcagacaggcaggtctcttacttaccctggacagtactgcttcctcttctttagtcaccatcaccattgactccagaatgactaaacaacagaaatgtattctgaaacctgctctagatccctaatgactttattcacagaagtttatctgagaaggttttctgattaaatgaaatagacctcaaagtatcaactttacatctcttgggaggcagcacggtgtctgcaaagataaactttaaagatatataaccctttcacttactagagctatgtatgttggaaggaaaggtgtatcttaacctctttgtacttcagtctactcatttataaaattatcacaacctattttcacaggtactaaaatacctggtaaaatgcctagtatatagtaggtattcattgtttgtatacttccaacctgatattaaagatattaaactttaatatctttgaggtgtctgcctcatttttctatatttctttttaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggtttgttatgaaaattagtgcctgatttaaaaaatctttattgtcagtgttactgataaaatatgttttttaatgttaagttagaattattactacttaggaagtaacaataaatagttgatataaaataatatatatgcctatatttttaaaaataaacatttttattgttatggtaacatttcctaaaatattattgcttgttatattttctttcgacacataaacttatactattgtgactttatttcacatatttttcacatagaaacaaaccagttattagaaacaaaccagttatttcaaatgagtttaaagagagatttgacaaagccatgctcagtgtcaagtaaggcattatataaaattaactttatgtgtttcttaagaatccagttaattatgtctacctcactgcacctgttataccttctttatattagtgattctttagctggctagtttagggaaaaggaagcaccctcttctacttgagaataattcattcattcaacaagtatttattgggattgcccactatgtacagacattgtactaggccaaagaactcatattcaccaggggatcaagaatcactgccccagtatgacggtggtactcatgggactatgctttatccctcagacatttgaggtgaaaaaagttgagaaccactgctttagattcccaccctggcttgcaggaagctgctattttcttgatgacttttgtgacctaaaagaagctgtacctgcagggtagagaaactggtaacaaaggagtactagattagacctgctggaaggagacccttatatatgttgctgtcatgacattaatgaaatgcttataaaaatcagtgagaagtaagggtacctttaaaattatttcatagttgtatagtcttattcactttaatttttaaataaaattcatttaagtgcttaagtcaccttttataggtaaaagattatctaatacaatactttgaatgtgtattccttaaagacttctattttgaagtctctcaaaaaaatgccatatgaatggggctctagacttcctattaagtttcaatcaaaagagctcttctctcaagtgttttctatggtggtgttctacatatatatttttttttttctgaaagagtttggtgccaaaaagcaaccatcacactgaagttcaaaagctatgatgtggctcattcttttcattttttacaaaatgaaattttagttcttgaaaggctttttttcagctaataattatcatttatttaaataacaatatttaacattttccgtgaacaaggcattttttcatttattaatcctcatagcagcatggctagattggtactacttttcctacttcatagatgaagaaagttagattcgaataggttaagcagttttttcactgttacacactgaatttttgattcagaatacaacttgctgattcatgacattctgagtcaggatttaaaactatagggccagcttctcagacttgtgttcagttcactatatcatgttgcctttcacagcaagggcaaacttctctagcttcttaagtgttcttttttgaggtagaaataagtagttataattcttatatgattttttgatattgtgtatgtactatacttaataaatacatatatatatatatacacacacacacacacatataattcatgattctttgtggtaatcacaaatattgaaacccatggttagttatatgttttgctagaaagcattttttagaaaggaaatttaaccaatagaggtccatattatggaataagctgattttaaaaagaactatttgctgaaatttctttctgtcatttagacaggaaacagttttaagataatttggtaaaagcaaacaaaacaacaagttttaaaaatgccttcagaacctaaaatgatgttgtttttccaaaataggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcaggtaagttgaaacctgagcttggtgggatttttaagagctgtcatgagaagacactactctttgggttttggatagctttattaagtgtttgaaatctgagttgctttgactgggaagggttaaaaattgttgcatttgctttggttcttagtattttctgtgttctgtttgcctttgctgttaaaattttaaaaaataacttattccctatcttgactgagctgaatatactcatgagtctacaggtaaggctgttagcagccgcaaatccgagtttgcagcaacctcaattcttgccccctcagaagaaagaattcaactgaggggcataaggcagagggagagactgaaccaagttttagatcagaagtgaaagtttatttaaaagctttagagcaagaatgaaaggaagtaaagtacacttggaagaaggccaggcgggcaacctaagagatcaagtgcatggtttgacctttgacttggagtcttatacattggcatgcttccagggttgtgttacttctcccaattcatcctttgaggtggctgtcacatgtgcagtgacctgccagcacttgggaggggccacatacacagtgtgtttactgaaattgtactcatgctcacttgaggcatttttcccttaccagcccagtgttcatggaagaaggtcatataccaattaaactccaccattttgcctcttagtgcacatgcttgagcccactcacccacctcctgagatcttaccaggaagctgctgatcaccagtttctgttgggtgactgcctttccctggtgccagctgtgaccaattattattttagagagacagcttaacctatcacctgatggtcacctgacatttctgatggggttgggggtgggccctctcctgctctgcccatgtctgcctgactactttctataacaagtctagactacattatgattccaaggtctctttcaaccctgagattctgtaacctagaagaatttatttccagatgaagtggtttttaagttattcagggtgtgctcagaatatatttaaagaatatcaatccattttcaattctgctataaaaagactaactccctgcagtaggaacatcaactgggaagaaatccggacagagggctacaaaatggagagaatagacacttagtggttctcaaggattcaaagatataagcaggctcttttgttcttaaatctttttttgagacagaggctttctctgttgcccaggctgtagtgcagtggcgcgatctcggctcactgcaacctctgccacctgggttcaagcaattctcttgcttcagcctcctgagtagctgggattacaggtgcacgccaccatgcctggctaatttttgtatttttagtagagatggggtttcaccatgttggtcaggctggtctcgaactcctgaccttgtgatccgcccacctcggcctcccaaagtgttgggattacagacataagccactgtgcccggctgttcttaaatctttaatttttttttaaattattctttaagttctgggacacatgtgcagaaggtgcagttttgttatataggtatacacgtgccatggtggtttgctgcacccatcaacctgtcatctacattaggtatttctcctaatgctatccctcctctagccccctaccccctaacaggcccccatgtgtgatattcccctccctgtgtccacgtgttctcattgttcaactcccacttatgagtgagaacatgcggtatttggttttctgtttctgtttttgctgagaatgatggtttccagcttcatctatgttcctgcaaaggacatgaactcatccttttttataactgcatagtattccatggtatatatgtgccacattttctttatccagtctatcattaatgggcatttgggttagttccaagtctttgaaaagcattcctatttctccacatcctctccagcatctgttgtttcctgacgttctaatgatcgccattccaactggcataagaggttatcccattgtggtttttatttgcatttctctaatgactactgatgatgagcttttttcatatgtttgttggctacataaatgtcccacgatgcataatcattggattccccagggttgaaatgaaggaaaaaatgttaagggcagccagagagaaaggttgggttactcacaaagggaagcccatcagactaccagtggatctctctgcagaaaccctacaagccagaagagagtgggggccaatattcaacattcttaaggaaaagaattctcaacccagaatttcatgtccagccaaattaagcttcataagcgaaagagaaataaaatcctttacacgcaagcaaatactgagagattttgtcaccaccaggcctgccttacaagaactcctgaaggacacactaaatatggaaaggaaaaaccgataacagccacctcaaaaacataccaaattgtaaagaccatggacactatgaagaaaccacatcaactaacgggcaaaattaacctgctagcatcataatgacaggatcaaattcatacataacagtattagccttaaatgtaaatgggctaaatgccccaattaaaaggcacagactggcaaattggataaagagttaagacccatcagtgtgctgtattcaggagacccatctcacgtgcagacacacataggctcaaaataaagggatggagaaagatttacccagcaaatggaaagcgaaaaaaaagcaggggttgcaatcctagtctctgatgaaacagactttaaaccaacacagacagaaaaagaccaagaagggcattaaataatggtaaagagatcaatgcatcaagaacagctaactatcctaaatatatatgcacccaatacaggagcacccagattcataaagcaagtttttagagacctacaaggagactcagactcccacaaaataatagtgggagattttaacaccccactgtcaatattagacagatcaagacagaaaattaacaaggatattcaggacttgaactcagctctggaccaagtggacctaatagacatctacagaactctccaccccaaatcaacagaatatacattcttctcagcaccacatcgcacttgttctaaaattgaccacataattggaagtaaaacactcctcagcaaatgtaaaagaatggaaatcataaacagtctctcagaccacagtgcaatcaaattagaactcaggattaggaaactcactcaaaactgcacaatgacatggaaactgaacaacttgctcctgaatgactactgggtaaataacgaaattaaggcacaatgacatggaaacggaacaacctgctcctgaatgactaccaggtaaataatgaaattaaggcagaaataaatagacacaatgtaccagaatctctgggacacagctaaagcagtgtttagagggaaatttatagcactaaaatgcccacaggagaaagcaggaaagatctaaaatcgacaccctaacgtcacaattaaaagaactagagaagcaagagcaaacaaattcaaaagctagcagaagacaagaaataactaagatcagagcagaactgaaggagatagagacacagaaaacccttcaaaaaaatcaatgaatccaggagctggttttttgaaaagattaacaaaatagaccactagctagactaataaagaaaagagagaagaatcaaatagacacaataaaaaatgataaaggggaaatcaccactgatcccacagaaatacaaactactatcagagaatactataaaatttttggcattaaaataatctttccactttgctgaatctgccattttttggggtcccgttttgaggcttcctacaatgtaggagtgcactgatttcctgacatgcctaacattttgttatctccaaaatagcaactacacctttttggctttggaattacattccttaggaatccttgttggccctaattatcaggaaaggtcaacatatctactaggtgagggctttcttaacatgagtggaaagtgggagtaattgagcctatataaccatgcacctggtatactttgttacttccagattgtattgaaaatgtgcaatgttttacacccaccagctaaacatcccaacacaataatgtatactctgctgtttataagttacaaaatgccgtactgtataatcatggaaagattattaatattttactattatctatttaaattatatttaatttcgggtagtaaatggctatatttacctaatttgtaagattatactatgcagtttgcatattctcattctcagtgataattgaaacttgctttagagctcgcccatggatctcatgtttacaaaagaggaattttatgctagggaaaatgttatctttatattatatgtacaaatgggtaataaaaaataatagtgtatgtaaattttagaaaattcactagttcagtgagagaacattagaaatattcatttaggtcccgcatatcattttaaaagcatatagaattaatacttattaagcaaacctggaagccatgcctgaggttgaatcctggcttctcttccttatctccaatacgaccttggttgggtaagttacttaacctctctgtgccagtttcctcattgataaaataggaatgatggtacctacctcataaggtttctgtgaggattaaatgaactaatatatgtagacttcttagaatagtttctgatacataagtgctcaataaatgttaactattataatttcatatatatcactaaaaacaatatgttatctcagagagtttcacttaatctaagtgtcattattcaatatcaaagcaggaaaatgtcatctgatatcctcccacttatgaaagttttaatcatccctcatcagaactaaacttctttctcattctggttatgctattaaactttcttcagatattgatgtaaaattctaaccatgcccaactttttttttattatactaattatactgtctttagatgcctacagccatttaactgccatggacttagaaaagccaaactcctgggttatatctgtgaaattacagagtcctatagataaacccaactgtttttggaaaaatatcaattgttttcttcctcatagacaataatctcgtaaaagatttctaatcatgggacagttaatcacggggacagtttctggttgtttcctcagagttatgttggctcattacagaacagacactccttacctgcagaatttgtacattgtggggagtaatttatcccaaaccagttcagacactaggactaaaatgttaatagtaccatttggagaatgctcagtacttgctaaacactttatattaatatttcctttaacctcatcatagcatccctattaggtagattattattcagattttacacacagtgcatttgtacatagagcttgcccaacaccacacaggtagtagtctgatctcaaattaagccctagaagccacagtgggagagtaccagaaggcaggccgttggggatctagccccaggatcctcacctcaatcgtggtagctctactttatttgtttttcatattaggttttctgattttgaatcattagagagttctgctgttaaaaaaaaaaaaaaagggggtggaggtagtgttattgaaaagcacttgcaaaattcagctctgtacatttgagatataactacaacaaaaatgtttctattatgcttttgcccctagataaagagaatccataattgacactatggaattttgcagtttgtcagtaaaatatctgatacttattttaatagatctgtatgtttcttattaactgagtatcagccatattggttgatgtgaacagaatgtgagaataaagttttgtttaggatttctcaatgttaaattcttacagttgaaatgatagattgatgcttattcataaaaaatattttgatatagattgtttattttaaaaaaactcaagataattttaacagcaaagctcagtggtggttctttcaccagttaaaaatgtacttttctttttaaaatatgcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaagtaagaatatagggacattataatttatttaatgttataggttgagtattccaagtctgaaaatctgaaatatgaaatgctccaaaatccaaaattttttgagtgccagcatggtgctcaaaggaaatattcattgggacacttggatttcagatttttcaattaggggtgctaaatataatgcaaatattccaaaatcagaaacccctctggtctcaagcattttgaatagggatattcaacctttaataactgcatatatccatttaacttagatttggaactttgtttctcagatacagattcagcagtcattacattgagtaaccactatctaaatgttcagattcaacagtcatgttttgagtaacttctatatgccgggtactgggtgaatactgtcatacaacaagcattcttattcttatttaattaaagtaacatctcttgaggtgttgtcctccagccagtactcttcacagtacctgtgcatgcacgatagggccatcaccacatctgaacatatgtgaggtggatcctcatggcaagtcctccttcatgtcactccttttcacacatctcacccccaatcccactaggcagctgaggagcacaacttccatagcagcctactaatctgctgttcacatagacttgagaagtagatcaaaacagtgggggggaggggggaaggaaaacatacattccctggctgtagagggagagccaattttgtggcattatgaatttgagttaccaaactgtaatgacatactttcctgtataagacaattagtataaatggaaaatgaaatgaaaattatcactttgtaattgtgaatgaaatcagttatttgctcattttaaagtagaatttaaattatacctacataagtattgttttgattttcaagcatgcaataaatcagaccagacaggaaaactacaaagaacctcccactgcaacacacacatgccttgtatttaggattagcatggcaaatcctattaaaatgtatttaaaattctttttttaaaaaaatggcattagcatctgaaggttgactgacttctaaaaattatactcccccatctctactaaaaatacaaaaatatgctggaaatggtggcaggcgcctgtagtcccagctactagggaggctgaggcaggagaatggagtgaacccatgaggcggaggttccagtgagctgagatcgtgccactgcactccagcctgggcgacagagcaagactccgtctcaaaaaaaaaaaaattgtactcatcaaaatgttggtaattgtgtttaattcaatacataagaatgcccttaaaggttggtttttaactttgggttattttcatttgaaatttcagcacgcttcttccctctccaccatacccagccagttttccctaaacctcttctctattttgtttttatccgtaacaataccatctaacatattcctgttttgcttctttctgttttcctagctctttccactagaatctgaacaccataacgcagggattatttttatagtactatttcattatattatttttattatactattattttatagtactgtttacttttatactcccagtgcttagatacctagaataggcacttaatatttgttgaatgattaaatcatattgctatgattagaatatatttattttaaatttcacagaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactgg

SEQ ID NO: 37003 - DNA, 67446 bp, Homo sapiens
atggtgacacattggctcccatggagacagatgaacctactgcttcagactctaagggcaaatctaaaatcacaccagcaatggctgccagaattaagcaaatcaagcctttgttatcaggtgagtcattctcctttctcctaccttttctggctttcagtcccttagtcttgaaacagattgagttggaaaggctatgttgtttcacctaaggaagtttaaaacttctgtgactcatttttaagtgtcctttgttgagtggctgctatgtgacaggctttgtactagctgctacggatacagacatgacagaatcccttcctgagagccatatctactaccctcccttctttaatttcttcctcctacttactcttcaactattgcatattgttgctgctccttccatttcactgagatgtctcagcaaggcatctacaacgtccttgtcctaagtcccttctcacttgtctgcagcatggtagttgacccaccatctccatctagaaatattcttcctttggtgcttgtgttattaagctatcttgattctcggataactatctggctcttccacctagtcttctctttttgtgttccttgaacataactggcaagagacatagtctgataggtgttttatattaaagtcactttggcagctttattgagactgtattggcagcatacaaaactgcattaatgatttgcactggtctgtttgcccttttttttcccctttaatgtaataccaatgtttgggaacctatttgtgtgttcgtaaattgtcgtcactttctggcaccttaatatagaggaaaatggagacctaacttagaggaatctggggcccttcgtaaaagcaaacagaaaatggcctttggtgtttccatttgttacctcaaattcccattgcattttacattttacttttaattagtttaattctccatttattttaatttgaaagtctaccaacattaccttcaaaggaaaattgaccaagcaagaagatgttcatatttctctctccttgctttgtcatatttctttgatcttggagcattcagaggtttctgtgtgaacccagtccatatactgtttctctttggttactggccttttgccatcctcttgtctttggactacctttaagcactttgctatctgttcacctgaaagcagtggtgagaaagtgtaaacccaatgattggattcattaggttttcaaagtctgggtatacccatatctgtagactattccctaattaggataaagaaatcttaatttggatgtaataggaagaagaaaggactgttttccttgttcctatactgtatacatttgagcttattactaaattttagcaggatatgtaacctaggctcaagtagagcctatttttacacactgagtttatatgtgcatgtatatcctgaaaagacatagatttaacccttgagcaacatgggggttgaggcaactcctccacacagtcagaaatccatgtataacgtttgactccccaaaaacttaactactaatagctatctattgaccagaagccttaccagtaacataaacagtcgatggacacacgttttgtatatgtattatatcctgtattcttaaagtaagctagataaaggaaaatgttaaaatcttcagagaaaaatatatttactattcattaagaggatcatcatagaggtcttcatctgggtggtcttcacattgagtagctgaggaggaggaaggaagtggggggatgttggtcttgctgtctctgagatagcagaggcagaacaggtcaaggaggtagaaggaaaggcaggtatgcatggtgtaactttgtggaaatacacagtactttctttctgacttggttgctttttcatttctctaaaaatgtgtctgtacaataccaatttttcttccaccgtttgctttagtttcggtgcccatatcatagtaaggtccacatcataaaaagtcaaaagtattctttagtaatcagaaccctctgccagattgtcttatgtcactttggttcctggcactgcttctacatcttcttcctcatcatctggtatcggttcagaagcactcatctctatcaagacgtcttctgttacttgctctggtgtggtgtttattagctcttgaatttcactgagattcatatcctgaaattcttcacccatgaccttttttttgctatatccacaaactcgtgatttccttgattggcgctgtcataaatcctgttaagttctgcacaatatcaggacagttttctccaacaggaatttatttcaggcttgatggctttttctgtgacaatgatggcatcttcagtggtgtaatccttccagactttcgtgatgttccctctgtcagggttctcttccacagcattaacaatcctttccttagagtactgtgtgtaatagccttaaagccccttatgactctctgatctagaggctgaattagagatgtggttttggggggcaagtagaccacttcagtgccttttgtgttgaattcatggggctctgggtcaccagaggcattgtctaatgtcaaaagaactttaaaaggcactcccttactagcaaggtacttctgacttcagagacaaaacatcaatggaaccaatccagaaaaggggtcttgttgcccaggccttcttgtacaaccaaaagaccagcagctggtagtttatctttctccttcaaggctcggaagttaggagctatataggtaagggcagtcctgattataaacccagtagcatttgcacaaaatagaggagtgagtctgtcccttcctgccttaaatccttctgctcacttctattccttactaataaacgtcctttgtggcctttttttttttttccttcaaagtagggcacttttgtctgtatgaaaaaccctttcaggcagataccctttctcaatgatgttcttagtggtgtctgggaacttatctgttgcctgttggttggttgtcagaagctgcttctcctattatcttgacattctttaagccaaatctctttctaaaattatcaaattatcctttactggctttacattctccagctttagatccttcactttccttttgctttaagttttcatatagtgagttcattattttcttgaattgcattagaatctatagatttgtctttattatggcaatcctgtacccacataaacgtgcattttcaatatgaaataaaaagatttcacaaaagtgcaaggttttcaagcctgctggtgtagctgcagcaacagcttcactaatttccttttgtttgttttacaatggtctttacactgaattcatttttcctgaagtggtgggcaatctgcaatccatatcaaataattcaactttttcttgaagtgtcatgacttttccctgcttcttgggagcacttccaacgtcactagtgacacttcatatggggtcatagagtgacccaggtttattccaggttttcagtattgcggtaaacatgaaaaacaatgcgagaaccatgagagatcactacacaatttactggagagatgaactgttcatgtagaagtgcttagcctcacacagtgttttaagcagattgtggcaacacttgagctcaccacagtatcagcaggtcgtggctacaaaattattacagagtataatatgtactaaattttatccagttactcaatactgcttatttactgcaaatggcaccgtgtataagtgtatgtgcataagtgtgataaatattaaatttttataatttgtgtatattttatggtagtaaatgataaaatagactagtatctacatatattttatgcgtttatgacatacctaactttttgttaatttttcaatattttgaggctacatgtttcatctgagagttttttcaaattgtcaccaatctccaaaattttcagtatatctattgaaaaaaaattcacacataagtaggcatctatagttgaaaacctgtgttgatcaagcgtcagctgtactttgattcagacctagcccttcttgtctctggatcatgaaataacgtttcatgaaaaaacgtgaaataacgtttatttttaaaatgctatggcaacattttcatttatgattttaaaagtatatttcattgtagaaatataaaaacacatgaaatatttaaagagaagctggaaagcactcagttttttgtgttttcttttacatatgtttatatttgtatgctgccttttccttgttgaattatatattgaaaagcatcctatgaaatggaaaatttgagatgtccataatctgcccaattccttaagaagctacttgtaaaaattttcctgcttttcctagtttattttttcctctgggactacatattttttgttgtgatcagactatgtatattgtcagtgatcttttcttatctaagtggctaatcatttttggcattttaaaagttttctgtaggcattttaagtgactttatcatccactagatatcatttaacttaaatatggtttcaatttatgttcctctagcagtatgagtgcttatttgtcttttacatttggtatctgttgagtgccacatatctgtctcctaccgtcaaaagtggcatttgttccttgtgggacttcctttttggattattgaatgtagaacaaatccaagtgttaactaggggttgtaggaggaagtggtgagtcataaaaatatgttaatggtaatatgtctgttgtaattaaaccattctgagaatactgtacagtcttattctgatttctgggtttcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggtgaagttcagcttgagattcagggactagaaagttacaataaaaaatatgtaagttgttcctatactacttaaaatggagtgtgagccactgaatttgagaatttggaggtcccttgtttactctagaaaatgaagtgtaagttacttgttttggttgtacctagtacagaacatgggtaatattttaagtatttacagtcaaactgcatttcagtggtcttatataggtagtatcccttatccaaaatgcttggggccagaaagtgttttgaattttggaattttttgggttttggaatatttgcggaatacttatcagttgagcatctctaatctgaaatgctcccatgaacatgtactttgagcgtcacgtcagcaatcagaagtttcagattttggaacattttgaattttctgatagggatactcatcctgtattctttagtaggtgggaggtgtcacttcagtgtgtaaattttactcttgccttttacatgaatttcctattgcttctgtctctgctttacagaaggttaaagttttgcctttttttccactttcaggctgacattcttcatctgttcagttggtttcacatccccaatgctgtttgatgagaggaagtatccctaccacctcatgctgcaaaaatttctctgctccggaggccacaatgctctttttgagtaaggatcaagttgcttcacagaggagcatttcttggagtttgatctttgctgtgtgccttcccagcccactgcttttaagtaccctatcttgtaacagtgggatatatagaaatagctattggttgtatccttcagtgttctgggaagtaaccatgtttgtctccatttaccttggagggtaggatttagcctcccctagagttgtgtttgtaagggtctctgctttttctcatgtggcttccagttccaagtatgggtttttaaaataggtttgtctttttctgttgtttctctgaatataatttttctgctattcttggtcagatgatttcaagatgagtttcactggtttaggtttttttgtgttttttttgttttgttttgttttttgttttttttgagatggagtctggctctgtcgcccaggctggagtgcagtggcgcaaactcaactcactgcaaggtccgcctcccgggttcatgccattctcctgtctcagcctcccgagtagctgggactacaggcgcccgccaccacgtccagctaatttttgtatatttagtagagacgaggtttcactgtgttagccaggatggtctcgatctcctgacttcgtgatccacccgcctcagcctcccaaagtgctgggattacaggcgtgagccaccgcgcccagctggtttaggtttttaagactctaaaaagtaacggaggagaggcggaacaaaagaaaaaaatagtatagctgaaaactgttggacagattagacgtaatagctctaagaagagggacgtgtagggccaatatagagattggggaccttttagatgtaaaccccccttgccagggtaaaatactaatattctgtctacttttccttatttgaatttagaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagtgagtattcagtattctaaaatcaaaaggaatttctcatgctaagtcgttcccactctattttgtcctgcttaatgaaataacatgcttatttaagaaccactggatccaactcccagatagggctgccttacgtaagggaatatagaccatttgagaattttccgtgataaacatttgagctgtaaatttcagattggtacttgcattaggccgttcttgcattgctataaagaaatacctgagactgggtaatttataaagaaaagatatttaagtggcccacagttctgcaagctttggaagcatggtgctagcatctgctgggcttctagggaggcctcaggaagttcacagtcatggcggaaggttaagtgggagcttgcatgtcacatggcaggagccaggaggtggagggggtggtacacactaactcactatcatgaagacaacactaaacaatgagggatccacccccatgacccaaacacctccagcattggggattacaattcagcatgagatttgggcagagcaaatattccaaactgtatcactgcttaaggttgagtaaaatgcctcttctctgtgcctccttagacctcctcatgttggccaattattttgttgctggtactagttgtggaaggactgttccataggtctttaacttaatccttctgagctttgaattgaagcaaaatgattttcacacacttttcaaattacttacaggcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacaggtagggtactggcctcacactccagggtccagactttgcacccaatggagtgtgatgcttacggattttctaagctcacataccactgagtccctggtcacattaaccaggagacagtttagatttcctccttctcttagtatttattttttttctcctgaggaaaactggagtatagtcctgatgctctgcacaggtaatactcctttcaagcatgttgatgagtattctcagtagcctcctgctgcctcagtggaggcaaactgtcctcagttactttctggttaacctgtaaagagaatggatattgtgaaccagatttattctccaacaagagctttctgaaaccttagtcacctacaaaacttttgttttcacttgcaaataaaatgtataaggggcattttaaaaattgggaggccagaaagaggagaggggaaaggcatgtaaagtcctgccacttccatctcaaagagcattttaagattttcttcctggagtttgtatgtatgtgtgtcagcttttatgtctggagtcctgttcaaatctgtctactatatacacttgtcccgttttttatcattaaagtaataaatactctcattaccaaatttggaaaatacaagacttttaaaaggcattcgtaattttatcacacaagatagtcattgtctcctttttcagtcagtcttgtgcctaatttttacgtcgttaacatcaaataatacatatacttgtattgctgttatcaagaacttttttttactaattggtcattcttttattgttggatgctaattttcttacagtttgatgttttaacactgtgttgtatagtttccttacgtaccaatccttacatacatctcatgattattgcctggtagtagattaactaggtcagtttttcaggcacttgctctgttaccagtttgttttccagaaagttgggaccaatttatacttctttgtatgagtctcaatcttttaattataataaccctgttaatcataataaccatgcatccccccctaactttcttagaggatgaaatcgagaatcttcttggctccttacccaatgtgtagcttagaatgctatagaagcaccaaacagaaaggattgttcattttacctaattgccctagctcataaatgctctcagcccagatgaagttagaaaaagttatttccatcttgaaaaggttccttccttttaaaaatgtatttggatttccgttatgtgattctgagcccttgcattctttatgtagctcatggacatgggcttcacaagggaacatgcaatggaggcactgttgaacaccagcaccatggagcaggccacagagtaccttttaacccaccctcctccaatcatgggaggagttgttcgggtaagttggctcagaagcagtgattttccaggatattggtttgactgctgaagtcctttttccccttattattctgtcattggtcttcctttctataaactgcttctcattttcagacatgtccatgccagtattttcttttcataataacagaagttttctgtcccccagcaatacaaattactatactttgtttgcacaagaacccccagtcacaaaacaatagaagaggcacacttttctaagatgtagaatagatgatcacactgtaagcctccttcctatacttagttttacgtgtgattttcctcatctgttcttgtttgtagtaaccacataagcctgatagggtttgacttatacaagagcagcattttgaggcccttcctctctctttagcttgagcacaagatgtctgattgcctgtgagttgcagtggtcttgttgggtttctttgttttgagtgtgtatccttactggatattctcttaacactctaggatctcagcatgtctgaagaggaccagatgatgagagcaattgctatgtctctgggacaggatattccaatggatcaaagggcagagtcacctgaggtaactatggaacactgcatcctaaagggcttggcacatgaatcttagtattctgtgaacattctgctagtattgcaaactaattgatagaattcaaatctaaaggaagacatgagaagagtactaattcatcccagctttgccatccattattgagctaccttgtattgacctgaagctttaagggaggcatatgaagcgttaatctttattgtcaaataagagacccaatgtgtactcagtagtgccattaggccgaacttggctgtatatttctaggtgacagttactttaattttccctgctggcacagaatatagaacagtgtctagaaatgattttgcgggaggtagtatagaatgctacaagtgacttgacagtgaaagttgtttgaagcatccctcccttctaccttccctgtcttgccttaaactttgtggctgccacatcctggatgaaagtatcaaccgcttgaggagaaggttgagggtaatcatatggtagagcaaaaacattctcagagtctctcttatctttcctccttcacctctcctgtgtattattcacacttccttccctgcttccaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgagctctcaaggggtcagaagaggggagtatgtgaagtggtttgcctgcctgtgtcaaaacctgatttctgaaaaatcagcatattttcattctacctgatatgggtatattctctatttggattctttcgatctggtaatcctgaaacagtgtgttaactacatcgcacacacaaaaatgtctttagaagggaaaaacaaagctctccttttctacttttctcttaaaatgtctaaaatgtgcctcacccttgagtcaggttcgtcccctggactaatactgaataaatgttttttcctatgtaacagccgcttgaacaactgagtccccatcctgatgaatacttgtgacctgatatttgtcctctttttcttttctctcattatgaaattatgctaattatagaagtgggataagaaaggaattaccttaaatccccacacccagatagccagttaacatttcgattgtatttaagttactggaatcttgttttatgtaatgtttcattctagaagcagggaaagaaattaaaaaagggaaaacttttttctgggctttgtaaaatagaactttaatgcacaagaacacaagtaaaggaaaactggataaaacattttttcacagaaagttttagtgtctattttttaacaataattctgagagagagagataaaatgaaagattgctgatggaagtataagttgatagaacctttttggggttgactgtatgcaccaggaagttttaaaatactcatttcctttaacttagattttaggctgcttatagtctagcctaataaagtaattgtttagtggtgatcctttagtagcatacatcttttgatatagattctaaatccctatggtaaatatgttagatttacctacctttctttagtgaatgtgttggaggcagagggagtattttaaaaggttgagaatattttcagaaacctcatcttgctctgcggttccgtgacttaaccctttttttgcttttctaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggtaagatttagatctttggggccttgtaattcattcatgaaagaattatcaaacacttaacatatatgaggcattgaagacgataaagcgaagaataaggcatgagtcctgcatttcatgagcccagtttctgataggctgaaatgcatataattacgtataaaatacagcattctgtgttagaatgataacagttttatctgggtttaggaaagtcatatgcatcactttggattcatgtgagaagggcttctgagaacaagcattaattgaattgagtcagaattgtgaggtggtagtttaaaaaaaaagtatttaaattactaacagagcttggtcatagaatattttttgctcttctgaggaaacctaactggcagccacatagtagagtagggtatgcaaattggatgtggtcaatattgaggtaatagacattagatgaaatcagattcctctctcttttccttgcctatttagtcagcagattatttgaggcaagagagtggtttgggcaagacctgatccaaccaacgtaggaactaggaggcaattgaccttggacaaatgacttcatttgtggctcattatctttaaaacctgaacttaatgaactgaaccctttacatacagcaaactcaggggataaatccaatataagagtcaaactgtgtaacagctgtcttgggggtttcctttatcatggaagtgataactcttactgtagcactttgtaaatagatacttgtgggaaaggtttcagagtactaaagagagaatcattcatggacccccatctaaaacaaatcacaagtaacagtcttgtattttcttttagtgttttttcctgttcatttaagcaattgggataagactgtatagaaagttttatattctttttgttaagtattatgactattttcccatttgctatatacattagtccatcttttgaatgttctctaatttatttaaataattacctatccttggacatttacttccagtgatttcctgttaaaagtaacactttggtgtagccccagtaagacgaaccattaactgtgtttaattattccattttccttgaaagattataaaatttctctgtaaatctaaagctttacaacttcaacatagactgcacaaccttggtgataaaccatttccatattaagcatatacattagtgccaggcactgggtactttatattaatatatataaaacctcaatcatcacaattattctgcaggtaaaaattatttcctctgacccatgaggaaaccaaagcctagaaaatttaacacatcttagattacacaactggtaaatggtaagaggtaaaatttgaactcaaccaattctattattatttacccttatgttcccctcccctatcccatgctaatctttgttactgagtagaaattggtatctggttgttgttgttttttccctttgatctatcaggagttgaagctaccttgtgcttgggtggttgaatcaagtggcatccttaatgtcctaatcaaactcttggaagtggttcagccctgcctccaggcagccaaggagcagaaggaagtccagaccccaaagtgagtaaccctatatctaccctagtttcgtttctatttccctgggacatgggcctgaatcaggcactcttctggggcatgtatggggcaaatttgtggtacttctgtagttttaaaattataaaggaagcatctgatgaaattaagatatattttcccaatttgtgcaggtttcttgctttcccaaaacagatcatttttcttttttaggtggatcacaccagtgttgctcctgattgatttctatgaaaagacagccatctcctcaaaaaggagagcccagatgactaaggtgtgtaatgtagtatgtatgactgcaggacggtttagcttcctgaggcaagagtagaccagaagagaatatgagagagtagtgaagaatatagaagtctctgaccaatgtataaatctcttaagggattttcatagctaggtttctcttctgaataatttactctggaagtaaattttgaaggagtgtgctatctccagaggaggagcggcttttctgttatgtaagggactgagtatacagcaatcctaccaaaaagcaaacactccttagatgaagattattgtgccacatcatctcactaccttcttggaaacagaatttttgtttcagtacatctcaggtgaacattccccttttagggaaaatcagtagaaacaaaaggaaagtagaaaatggcaagataaggggctgtagatagtttttttgtctaggaaaagtatcttagtccgttttgctgttgctataacgtaataccacggactaatttataaaccataggctgggcactgtaggctcacgtctgtaatcccagcactttgggaggctgagacaggtagattacttgagttcaggagttcaagaccagcttgggcaacacatggtgaaaccccatctctccaaaaaatacaaaaattaaccaggcatagtggtgtgtgcctatggtcccagctactcaggtggctgaggtggggagatcacttgagcctgggaggcagaggttgcagtgaaccgagccggcatcgcgtcactgcactccagcctaggtgacagagtcagaccctgtctccaaaaaaaatatttaatataaactgtacaagtttatttggctcatagttctagaggctgatctaagggaccacatctggtgacagccttagtgctgcatccttctattgcagaaggtggaagagcaagaggtgtccaaactcgcttttataaccaacccagtcacaataactaacccagtccgtggataatgacattaatccattcatgaggggcggagtccccatgacctaatattatcttttattaggccccacctcccagcactgttaaattagggattaagttttcaacacctgaactttagaagacatgtttttaagcgtgtagcagagagactaaggaatgtgagagtaaatgcatatgaaaaatgttcttttggtttttaaaatttattgtccagtatatttctttttcctgggtgagttttagcagtgaacactgatgaagttactatttcttctaatcaaccttgaaagaaatacaaagaaactttgtacttttatgtttagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggtacatgctcactcaccaagcttgtctaacccgtggaccacaggccacatatggctcaggatgtctttgaatgcagcccaacaccacacattgaggtttttttgtcgttgttctttttagcttatcaaatatcgttagtgtagtttatgtgtggcccaagacaattcttcttccagtgtggtccagggaagccaaaagattggacacccctactgtaaactttatcaaaaagaggggtatgtgttttggttttcttctttctgaaccagcattcctaacgtgttaggaggaggagagttaccattacctaattaagtatagatttcagaaaatcgagtcttcctaaggtcattgattagaccttgggtctgtagcaatttgatactatccctcttagaaatgattttaagtgtttagtcaagggctagggagtggttagggatggtatttgctctgttggaaggtctacagttcattataaggccttgtgtatgccacttgccttctggggactttcaggttttttctctgtaaatgataaaggtgggataaattgccagagttccttcctgttgtagcattttacctgggagatgtccctcccctcccccacctttataattcatttttggtagaggtttttttaatgtctgtttgaattcctaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatggtatgtaccaagagtgttttacctaaagctaatgtgcctttgtggcttaaggtctggccaatttcattgtgagttattttcatcagcttgattaacagattaaagatacgtaggcctcccttatgctttttcatctgatcttaaaattggtatttggcatgcttctcttaataggacccaagtgcttggccaattacttaggagggaggcgtgggaggaaataaacatcaagttaaactgtctaaaactgttattttcccattttatagatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggtgagtgtgttttgtatcagattctggtttagctttacatcatacctatgttctccttggtctgagaacaaatagacttctggttcttcttagggtatatagctagatatgtatactgtatactccacccaacagaattttccaactctatgcttgggagcttgcttaggtatggtaggatgatcctattgctagaaagtcctctccagcaatctggttttcttttttttctttttttctttttttttttttaatctaggtttcattaaccaagccaaaaaccgttagtaaagaactgggataccttcccccaagttcataccttcagaatcattcctttgtaggagtacctctcgggtgttcagccaagagactattctcaaaacactgtattttggaatataaaagtatagttaaagctttttgaatgtttgtaatctgccaggcactgtgatagacacttaacaaatatccattgtgcagatcagaaaacaggttattatattttaggaaacttacaaaccagtggaagaaatagcaacgtacttataaaaaataaaaacatttgtaaagttaagacaatagtctgggtgtggtggctcatgcctctaatcccagcactttgggaggcaggtaaatcacctgaggttagaagttcaagactaggtgggtgtggtggcatgcacctgtaatcccagctacttgggaggcagaggttgcagtgagccgagatggtgccattgctccccagcctgggtgacagagcgagactctgtctcaaaagaaaaaaaaaaagaagacaacagtggagggttgaggggcaaatgtcctagtagtgaggcttttcctcctcagtacttaatacaaaatcctttcttctgctgattctttgtcatcaataatgactgttaatagactttgcttccgttttcctctcttgggacattgtttcccacatttataagcagtgttgcaatatgcgtttttgtgcctaactttgttcatgtttaagatcgttacttagagatttttagtaattggatcaaaaggcattacaagtattttttaacttgcttgccagaaaagtggtatcagtttttgtatatctgagtatacattttagattcttcagacagttctttacacagcctgcttgatttcacctcacatgtgccaaatcaagagaaagagagctgttaaaggtagcttgtatggtgatccacagtccaggagataacccagcagggaaggaacaactatatacaactaaattctgattttagaaacttgaaatgcttgaaacgctttctataaagaaatgtttaaaagttacaagttcaaagtgctaggagaaagtgtaggtcctcattggatgagggaaaacttttaaagttttaactttaggtaaattatagttggggtgtgggaaacaaaggaacatcagtgacagtcttaacgtatcaagatggcaaaatgtaaagtcttggtactattcattgctagtacaggtgtggaaaaccaggcatactcttaactttcggtaggagtggaaattggtgtagccacatgggagggcaatttggtactcttggtctaagatatcctttgacctagaaattctatggctaagaatttatctgataactaacatcaagtataccaagatgcatatataagagtgttcactgtggaattgcttgtaatatcaagaaactagaggtctaatgtccagcagttgggggctggataaattatggcttatccttaatattgaaattaaacttttctgtgtttattaaatggaaattattttataattacagccagacaggcaagatacagagggtataatgtgctaaagggcatgattgatttggtttaaaaaaaaaaaattaagataccaaaagatgtttttcattgtgagcatgtagtttgtgaaataacagataatggaaaataatacaattgagttattttcttcgtgctttcatggatttttccattattaacaagcaattttatgagaagagcagaagcatagctatatgtaagccctgtgttatcaaggcaaacaatatataaatagttcagtatctccagtggctatcattatctcagactgatggttgactttgaggcataaagaaaatatttaattgtgttcctgtacactaagtggattacagtgttacatgtttttgaaccattctggtttaaaattgtgacagcatttggagaggctcaggagctgacattttaatgtggaagttatgtggggtttatagtcttgacacatctcccagtttctataaagatcacatgcagtctggtctaataattgatagttttgagacatgctgcaacttttttataagccaggttttttgaatcaagaagggatgggacgggacttaaaaataaaatgtcattctccccaaaatcaaaagcttttagtcttggtaactcttgactgcagttgtatttttagaaagtagtgtttaatcgacagtgtttctttctctctttactaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactggtaagtttcgcttgctcctggcctttgatattaagtttgtggcctggtataaatccagaaatttatttatgaggaggtctgtaacttgaagagcctccttaggcaagtattaggacatttgctggctaattgattgtttgggtcaatttattaggtacttcagtagcttctctgggccttgccctgttgtaatccctgccagagacactgaggactcattcattctagtccttcacttcaaagagctcattttggtggggcagtaggctttacatatagttaatggtttacaaatcaagtgataattaagggttaaatggatgtatgtctcgtgtaacacagtgcgaaatagacgtcatctgtgtattcctgccaagaaatgtttgacctgtatttaattatgaggaaacaattagataaatacaaattgtgagatgttctatataagacaactggcctagactcttcaaaaatattaatgttatgaaagaaaaaatacaggatcatttcttatagagaaaagtagactagagagataatcaccaccagccttggttgggctgtggatccagataaaagatttggagaaatttgagtgctatgtattaggtaatgtaattgtatctgttaaatttggggggtattataatggtattgcagttctgtataaaaatacccttgatctcccctctgctgacttttttggtaataaaaaagaaaatatatgtccttgatcttaggagctacaagtagatgtatttaggagtagtcacttggtaattctggatgaaaagtatatagatgtttattatactattcgaacttttctgtaggtttgttggatttgtttttttattttattttttttttttaattttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttccatccacacagacccggcaaccatccgatttctcaatttcttccccacccttcccgcctttctattccacaaaaccgccattgtcatcatggcccatccccaatgagccactgggcacacctcccagacggggtcgtggccgggcagaggggctccccacttcccagtaggggcggccgggcagaagtgcccctcacctcccggatggggcggctggccgggcggggggctgacccccccaccaccctcccggacggggcggctggccaggcagaggggctcctcacttcccagtaggggcggccgggcagaggcgcccctcacctcctggatagggcggctggccgggcgggggctgaccccccccacctccctcccggacggggcggctggccgggcagaggggtcctcacttcccagtaggggcggccgggcagaggcgcccctcacctcccagacggggcggctggccgggcggagggctgacccccccacctccctcccggacggggcggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgaccccccacctccctcccggactgggcggctggccgggcggggggctgacccccccccacctccctcccagacggggcggctggccgggcagaggggtcctcacttcccagtaggggcggccgggcagaggcgcccctcacctcccggacggggcggctggccaggcggggggctgatccccccacctccctcccggatggggcggctggccgggcggggggctgactcccccacctccctcccggacggggcggctggccgggcagggggctgaccccccctcccccctcccggacggggcggctggccgggcggggggctgaccccccacctccctcccggactgggcggctggccgggccgggggctgacccccccacctccctcctggacggggcgactggccgggcagaggggctcctcacttcccagtaggggcggccgggcagaggagcccctcacctcccggacggggcggctggccgggcggggggctgacccccccccacctccctcccagacggggtggctgccgggcggagacgctcctcacttcccagacggggtggctgccggacggaggggctcctcacttctcagacggggcggcggccgggcagagacgctcctcacctcccagacagggttgcggcccagcagaggcgctcctcacatcccagacagggcggcggggcagaggtgctccccacatctcagacgatgggcggccgggcagagatgctcctcacttcctagatgggatggcggcggggaagaggcgctcctcccttcctagatgggatggcggccgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcgcctcgggaggccgaggctggcggatcactcgcggttaggagctggagaccagcccggccaacacagcaaaaccccgtctccaccaaaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccatggaaggagaccgtggggagagggagggagagggagagggagagggagaggagggagaggagggagagggagtttttttttttttttttttaataaaacgttgggaaggggatgaaattattttggaagttccagctatgtgcctgcccctgtgctgggcatttctcagttatatcctcatttaatcctcaacataaatttggagagtgagaaaattgaggtttgttgaattaacaactggatttcaaaaccagttttctctaactcaagcctttactatttggtactgctatattaaatcctgtggaatttaaggaaagtataaaccaggttttatagtagagtacttgaacattaattgaaaatggtctcctatctcaagccttctatatcatacatgcccccttctgagtctttattagtaacctagtttaggtactgcttcatgattgactggtttttctctctcattttggcttagcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaaggtatgtggctagcctacctcaggaggctgggcactagaggatatgttactttgcctgggtcatttcagccaactcatggcttagtgagcactcactatgtgcccatactctggggctcaagatgaataagatacccattgcatgtctgtgaagaagctaatagtcatatagtatgacataccaggatggtggtaagtccttagggtgaggcaccttacctagtgagggtgcacaggtaagaaaatttctttgtgtacatgatttctaaaatgaaccttgaatggatgagattgccagagttctgttatatgagaatacacaccatacgggggaagaatgaacaaagatttagaaggagataatagcattctgtgagaggttgaaaataagacaccaggaagtctctaatgttttcatactcaagcaaaacctttttattgtctgaagagctggaggcaatattaggaggtgtgtctgagtttcctaactgttgagaccaccacacccatccacctttattcctagttaaggtgcatcttataagcattaggaaagtcatgattgatttgcttggaacataggtttccattatagtaaggtccttctggattttattcaggacatacttatttgataggtccacagaattgccaaaaattgatgaatgctgcctttaataagcaaaagaaatctgagtcttgaccttggtgcttttcatctgtacagaaccctgatccatatagaattccttggttctcctatcaccccagaatctttaccctatctcttatcacctccccgaaatagtttagctatatagctgtggcaaccatttattgacccaccactgcatgagcaatagtgccaggtatgttcacttaaggtttgtagttacagcttaggaaagtgagactaagttaattgcctgtggtcacaagactagtttttgtaattttagggtgaggcactctaacattatctgtaatagcaccatgtaaacagtcatagccacttgatgtgaaattgaccaagactgactagataggccttaacattgtccaattgtagaagaggtttattttgtttttgatggttgttactgttttcctagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatgtaagtcaattccaacagcgttttatctttcttctcatttttcaatgcctgtgtggtctcagtatttagggctatccccggggaatttcaaagatattaattgtgatgtatctgtaaattatctgttgcctgtaaagacaaaattggggtgtccctggagacttttttttctctcctaggattagaactgttctttaattttttttcttttccctttccttccccgcctcccccacagtctcccagtcactgtatttataatagcctcccacagattatagtataaaggtgtaaggtggttaaaaggttggccaaagagaatctgtggcattcccagccagtgccctgggaaggagttctgccatttgcagacgggtgcttttgaaattcataatagctcaggagttttcttcttcttcagagtcaggtctttgctgcagatggtgcctccactgagacttccgcatctgggacctcccaaggagagggtaatgatttgcttttctcactaccatgttcttattccttaggaaaacaacttgaaaaaactgtaggtgtcctgtgcagggggtaggagaatacagacttaattattacgtttactggtctaagtgaactttctcaggtgagctcagtgttctgtaataaagggtctctatatgctaaagttaatggaactgtaagttaaccaacctagtaatggttgctgtggtaacatattttagttttactttttaaatcacaccataattatttggggggtttctaaaaactggcttatagagattttatgccagtgatattgttctagctacatgctttacgtggtggatgcctgtcttccagcaatgttaacagagcccattgactactcaccatgaactagaaaaatgtccctgggagtaagtctaatgagacctttaaagagctgcttctccttagataggaaaggtctttgtgatccaatttaggagacattttgtttaaaatcatactagttcctggagataaatttaaaaggctaacattagtgaaataattggttaactcattttactgggtttactggccatatgtagtgtatagcgtggatgatggtgctgattcaagggaagcattacccactatgtggcagactatattggacaccaaaatggatcagatttgttccctgtacttaaagtactttgtccagtgactgagacctgcaagagttataatgcaggataactgccagaatgaaggcatacttggataagatataatggacatgtaaagtatctcacagtatgtctagatgagacaggaaagcatttatggaggaggtcagcatttgagctgaactagataaaagtgtgccaggcagacggaagaaagaagtaagggagcaagacaagtttgaagaactgttagtagagtgtttctggagtatgtaaaaggagggaaatggagggagatgcacaaatagttggacaaagcatccctgttgtactgtaaccacataaatctgagacctgagttatcctggttctctgctcttgcactgcagtgtcacgagagcattcagtttgtacaggtggcttaaagtggaggagaaatagcattcttttccacctaagacttgattttgccagtgttccagtgtggaattgaaccagtgtttgacttttctcaacagcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggtaatatttccaacttctatttaagatgttacactgtacttccatcatttgggtaccgcctgtgtcagacactgctgggaagctgtgcatgctaagtgctaacccaagtaatgagtgagaagaggcatcttcagacatgcaaggccgggtgcggtggctcacgcctgtaatcccagcactttgggaggctgaagcaggcggatcacctgaggttaggagttcgagatcagcctggccaacatggcaaaaccccatctctactcaaaatacaaaaagaaattagccaggcgtggtggcgggcacctgtaattccagctattcgggaggctgaggcaagggaatcacttgaacccaggaggcagagattgcgggaatcacttgaacccaggaggcagagattgcgggaatcacttgaacccaggaggcaaagattgcagtgagccaagatcgcaccatcgtacacctgcctgggtgataagagcaaaactctgtctcaaaaaaaacctgaaagagctaggccttttttcattaggttcactgagagagagagttaatgagatttgttctattgaaagtccctttttatgcattgtggagattgaagagggaagactggagtcagagagaacagttaggaatctgatagagtaatctagtaacgtacgatcttggtgaagttggaggaaaatgggtgagttgaagaaatatttttaaggtacaaatggacaagaattgggtttggaagatgaaaaaggaaattaagactcaaggatgtttcttgatttgtgggggtttttttaattgcttttatgggttggcatctaacaagaaaatagaatggggtggggaaggtttgaagagaaaatgaggagttttgagaagtatctgtgggacatctaagtaaaagtgtctaaaggacagttgaataaaccatataaataagaatataggtgttcatcttccagatgtactcacacatgtgcaaagacaccagatgtggtagcagtattggtaataaaaataaaggaaaagccttaaatgttcattagtagagctgtggaaaagaatgaagtgtcctgatgcagaattatcctcaggttagattttttaagtgagtggggcattttgagaaactgtatcacatgttcccgcatatgtaaaatgggtgcccaaatattttttcccgtaagggtgccttgttttgtggatcacattgtaattttatggttagtaagtggcaaaagggtctgagagtgagtaggggcactagtgttgccatctttgaaagcaaccgccatttttaaagctattcttactttaatccaagtttaatatacatagaaaaatacacaaatcttaaatagtctgtttttcctaggtaaccactagccaagttaaataaagcattacaagctccctagaagctgccctccttgttctttagtgcatctcctcccacccatttcaccttcactcaagataaccattatcttgagttctcgtgccgtaatttggttttgtagttcatgtaaatggaatctcatagaatgtactctcttttttgcctggcttcttttgcttaacatacttgattcattttgtgtgcaggtgaagtttattttcatctgtataaaattccactgtggaatgtaccatgtaccaaaacaaatacatcttttacccattctactgctaataaacatttgggtaattttgcctttggagctatcacagatagtgctgctatgagcattcttatgaatatatataagttcgtgaactacccaatttctgttgggtagtatatgcctaagagtaagaattgctgagctctagagtatgatagttgttctgctaatgctaaaagttttccagagtggccaggtcagtttatattattaccagcagcatatgggagatcaacagttggtgttttttcattttactgattttaatgggtttgtagtggtattgcattatagttaaaatttacatttccctgttgaccatttttttcatgtctttattggccatttgttcattctcttttgggaaatgtctattcagctcttttactctattttcctattgagtttttaaaatatattctggacataagtcctataaatacataaataggcttcctttttttaagagtctcactttgtctcccaggctagaatgcagtggtacaatcatagctcactgcagctttgaactcccaggctcaagtgatcctcccaccttagcctctcaagtagctgggacctataggcacatgctaccacgcccagctaattttattttttgaggtcttgctatattgcccaggctggtctcaaacttctggcctcaagtgatcctcccgcctcagcctcccaaaatgctaggattacaggcatgagccatcacacctagccaggctttattccaaagctttaactcatttatgccagttgtattcataatttataatagtattacctgtgggttaacatatttaattacaaatttattaagtatctgcctaatatgtgtccagtgtcctaccagtactgggtactggtaagtgctttataaatactattgttaatcctcacctccacactgcaaggttgttgatagtgatctctttaatagaggagagaaggctcaaagaggtaagtaacttgcctgggaccatactacagagtagcagagctaaaattggaagctagggctatgattccaaagctaagtcctttctacgtggttattgagaaaatagttttaactttgtatgtattcactactgggaaattaattgttatttctaattgttttgttttgacaaggtcactttattcagtttctcagactctcaaattattcaatgcattttctttattgaggtaaaatttatataaagtcaaccattttaaagtgtactgttgagtggcatttagtacattcgcagtgttgtgcaactgtcacctatgtagttccaaaaatgttcagtgtattttcatccaaaatttgcttgaatgacaatagaatttgtttctaagataaggaattgtctaggcaggaattgtagttagagaaaaaagaagagtctgacttaatttccttcctctattgagcctttttcgttactttaaataaccttgcattaaatatttttgcatattagtttctgtgactctgctgtctcttgctcagctcttaccagcttctattgtagcacagggtcctgggcacattgtaggtgtcagtaaataatttcaatttaattgaacactgaagggtttatagcacttaattaagaatcaaggtttgaatcctcagcccttgattaaattcttctgtgcaagccacttctttagggggcttcagattaccgcttatcaaatgagaaaatacttatctatttatagatttgctgtaagtagttctattaaatatcacatgtgaaaatattttaagataggtgcaatagcacatgcctgtagtctcagctacttggaaggctgaggtgtgagaacacacacacaggagtttgagactgtggtgtgcgatgatcatgcctgtgaatagccactgtactctggcctgggcaatatagcaagacctcatcttcttaaaaacattttaataaaaataaagtttttaaaaaatgtttttaaaaatacatgacatctacataacagtgtataagctgtgcagtgggaaatgggtggcatttggaagttttctaaaatctgggtttgctccttacttgcttgtatctttgagccttggcttcttcatctataaagtggacctaataatcactcattgggtgacttaaggaaatactatgtgtgtgtgtatctttggtcctgtgcaaatgatatggcataattgtgcttgtaagtaaatgtcgtgattcatgacttttcaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggtaagattcatacctgtcccagggctaatagccaagaacatccccttattcttcttcttagtccatgggtggttttgcacttgaacaaaacttcttgtcatactggcatcatatactctctggtccgctcaaatagttctggcggttggaaatagccagagcactgattaccattagagtaagtgggtaaacctagagaaaacaaagggaaatgttaagtgtacttttaaggtcttcaaggaagttgagcaggttatttgatcttatattttaaattttatttaaagtaggggctgggcacggtggctcacgtctgtaatcccagcgctttgggaggccaaggccggtggattgcctgagcccaggagtaggagttgaagaccagccttggcaacatggcgaaaccctgtctctacagaaaattagctgggcgtagtggcacgctcccgtagtcccagctactcgggaggctgaggtgggagtgtcacttcagcccaggaaggttgcagtgagccaagattgcgccactgtactccaccctgctacagagtgagaccctgtctaaaaaagagaaaacgaatgctatcaccttagggagtgtgttctcacctgtttgtttagatgttatttccagaaggaaatacaaaagttacaggagggttatctgaggctattttgtgaagacttggcctgagaaatggctatattcatatgatagagatgtcaaaacttctctcccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccaggtaaaatcatgccccagccccaggcttttccttctcttcagcctcactacacgaatgatgtggaggtagctggtgtagtgggaaaactttgggtacaagtgggagacccaagtctttcttattgtggcttttagcacttgtctttcttaaagccttggttcttacttgctataaactcaagagttgaactataatagtgatttttttttcaagcttccccccactttaaaaattaccacttattagaagattatatgtatattataagaaatacagatgagtaaaaataagaagtagacactgtattcctaccacccagataccatgattaccttattggtttattattcagtgtttttctttgcatgcataaataatgtattctttactaacatgatatgatacatgctattgtgttgggggaaatttggggcattttcgtttttattttcagttactggtcacttccttgctatgaaaataagtttcatcctacctaatgcccaaatccataattaagcatttttctccaaaccagaatccaattaaggacttgtattacatctggctatgttttctgaatctctcttattctaaaacaattttttttcattatttcgatctttattttgtttttgttgttcatgattccagcttgttgaagcgaccgtgtttttgccttctaaacttggtgcagttgcttccttgcagtgtagtttaacttaatcctttacttcctgatattttctgtaaacttctagttagatctagaggctttagaggcttattgaagcagtttaaacattttgggctgaaatgtgtagcctaggtgatgtatagctcatattgtatcgtgggagacacatctcccatgataattgtcactttttgttcttactagaaagtcatctctgttgttattttggcactttacaaatgtctacactatcaatcatatacctaaataatagccttaacatcagttgataattcttgcctggatcaattaatttctttgaggcttatgaataaaagctttctaatttctcatttcgaatacattattaactggcatttttctgtgttagcctcacagggaatgtctggttgtgctaaaatataatttctattataaaggcagtataaaaacttaatttctttctatttacatttgagattcaaatgtaggtttttttctggctttctatttttaagtcgtattatggactcgacttttcatgtttgttttgttttgaaactagtgattgaatttatttggatcactgcagtcactttttcatgctcaaattattacacctttgacctatgtggccccttcaagatgactaaattgtccttttgctacaaacctatcaattttttgaaacatttataaatgtcaaactcacagtactgtaatgaacaccatgtgtctacctagattaaccactgctgaacattttgctttatttcttcccttcctgtcctttcaggagctgaatcatttgaaattagttgaaaacactgtaaaactttacctctaagtacttgatcatctgtctcctaagaacaaatattcctttatatgggtacagttccattgtcatatccaaaaaatttaccaataatataataatactaaatttatacaattttatatacacatactcccagttatttcaattatgtctttatactctgagggagagtgttttgatccgggattcagtgagtatcacatgttgcatttggttgtcacattttttttttttatgacattttcctgttttgatgaatccaggcttgatgtcttatagaacatctcacagtctacattgatgtaattgctcccttaatggttagggtcaggttaaacatttttggcaaaaatactacatgggtgatatttgcccttctcacatcacgtcaggagacaggtgaataccacttggtcccaatacttgtgatgctaaatttgatcacagccgaggctggtggatcacttgagcctaggagttcgaggccaacctgggcaacatagtgggaccctgtctctgcaaaaaaatacaataattagctggacatgtacgcctgtagtcccagctttttgggaggctgaggtgggagggtggtttctgttagatttccactttgtaatgaataattccattactatcattattctttctgatactcagctgggcctgtggtaatgatcccattaattttttttccccatttttgttgttatttttcctctttatagaaacaggatctcactatgttgctcaggctaggctcaagcaatcctcccatctcagcctcccacagtgctgggattacaggtgtgagccatcacgcccagctgtcccattaatttttgaaagctttttggcacaatgagatatcccaggcttaccttatcccttccttgccctattcctgggatcacttgttctgacgagtcttggttacttttagtgtgatgtgatatcagagactgccatcttggtactactagtgagcatatatatatatatatatatatatatatatacacacacacacacacatacatacatacatacatacatacatagactcacacataaatacacacataaagcagataaaagcagagctgctctggtgttagtgggcacctggttggtctcacacaccttattacacttagaaatcataccacacctccaactgcagcccctattgtacttttattgaactctaggaagccctacagagtataatttgaaattcacaggacttcaaactgttatcagccgggcgaggagggcaggttgcctgagctcacgagttcgagatcagcatgagcaacatggcgaaaccccatctctacaaaaaatagaaaaattagctgggcatggtggctcacgcctgtagtcccagcgacttggaaacctgaggtgggaggatcacttgagcctgggaggtggaggttacagtgagctgagattgtgccaatgtactccagcctgggtgacacagcgagaccctgtctccaaaaaaaaaaaaggaaaacttttatcatgttccttcctttgagcttttagggtttggggactaaatgctggtggtttaaaaaaaaaaatcctgagtacatccgagaagtggcttgcttgcatgtggtcatccagaatacattctgatttccagtcaagaatttgttactcatgtgctttccatggccccatgaaatatggcattgatttaactcttgcttttagggtgggttccttgaagacatttaagtcaaaattttttttttctaaacaaaagtagagtgttagttgtacgaccttatgccccttttctcttagtagattccattgtaagaagcttagtgtcatttagaagatagacacctagtatttctgtgctcagtccatctctttatcttcccttatctcagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggtagggaatcagagccaatggactggagaggtgggagtagttgctttatgggcctgggatcacaactgttctggcttggtggtgtttccctgggaacttgctggccttccagagatctgtcatagtggcgtgggaatctgccccacaaagaattccttcaaaatgcagccttgtttggctatcctcacacgtagccttgtcttttcctttgtcacccattcgtttattctctgagaacttacaaacttgcccaaggaagggaccttattgtctttgcgcttgcctcatggtgcccagcacataggcactctttgattattttgctggttggttgattgtttcaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggtagggaggcagatcacccagcatttccctgttgcggcgctgaaccaaacccttgccaggtggtgtgggtgggtgagtactttagatccttgcctcaatgctggctgctttgcagaggagcatgggtgatatgcttagtagatgctcagtaaatgtgtttgtactgtattaaaagaggggtgggggcagggccaggatgccatgtactatgaaatgatatagatcccaaccagaaaacttaggcacaggtgaaatgttgaagtagaaagctgacctgagaccgttgggccccgggtctttgatttactttggctctggtcattattggaagctccttaacaccaccttatgcctatagcaccagctcttgctggggcattaaaacagcagtcttctaaagaccctaaaggaaagcattgtaatttctggagctggtagcattgggtaagaaattgggcctgtggtcctaagctgctggctttaaagagatctattatgtcttcctggacagtataaagacaacccagtatcagataactgggatggacccatttgaaggatagtctggttgtggattggtagcacgtggtagtttctgtgctaattagcaccgaatgtgtggtttcacgtaacatcctctgtcacatgttatcctagaaatgtatgctgctttgctggccttttttagggtttcggtgctagcacaatgatagacttgtgtgcatccatatatatgttctatttctctccaggttgagaatgagctggaggacctgatagatgagttgcttgagagggatggcggatctgggaacagtacaattataggtgagagccccagaactgagtatagcctcttcctttgcctcagtctctcttgggaggaccctttttctcatcatctgcttgctcagctctgcctaagggctcatagccagcctagatcgctgcttgtcttgatgttgacggtcttacagatgagaaattcacaagacgtctacaggcctgtggcagtctaaagtgttgcctgtgtgggggaggtggtgggagtggccattgatacagatgatacatcaagcacatcaaaagagtgtttattcatggaggcctagaggaggctgtagggtgagaaagcgctgcctttcagttcttcaatgaagtccaggggctttctgcccctgagtctcagtagtgtaaaaagaatgatcattccctgagggtggccctttataaatctcagagggaaaatggcaaaggtaccctactgtcacctggctctgagggtgtatgtgttacttgtttttactttgttgatcaaggaaatcaaaggataaatggaagtagacacgtattcttaagttttacaaagcttttttatacccagtatcctctgtggtttcacaattagtgggattggcagggcagatgtgatcatcctgttttacagatgaggaaactgagactcagacaggtaaagtgactggccaagctcacctagctagctgacagcagacaatccaggtcttctccctcatccaaaaaaaagtggatatctgctaggtgtacatagctactttagacgcacccagtctggaaagggaagtcctctgttgttcagtgaaggctctgctctgtaaccttcagtgagcagaagtggagaggatgaatcacaagaggacgtgctgatggatgaagctccttccaacctcagccaagcttccaccttgcaggccaaccgagaaggtgagagtgccgaggccagaaaggcctcccttcttgccctgcacgtctgacagacactacactagggttttcctggaggcagctgcccacatgtgcagaataaggaagcatctgtctgcatgcgctgacatacaccatccactttatcctcagccagtttttcaaataacatgttactactgcttgcccaaagtttgtcacttcttacttggttcgctttcttctcacccacctgctatcatcgctccaggttccctcttgccaacaggatatagtcaatagcaaagtagggctgaaaaggcaagggggcaccagcagacttggccaagtcctagaccatggctcctcaagcaccaccctctagccagcctccacattcagccaccctgctcagtgtgttgatgcattgattggcactctcaggaaatcgggtctggctcactaagtctgtacatcaccccagatctggttcttcctctcatagagtcagatatcccatcaccttcccactcagcctgctggcctgcacagtagcctgttttctagctactcagtttagtcctccaatgtgctccctttgttttagattccatgaatatcctggaccctgaggatgaggaggagcacactcaggaagaggacagcagtggcagtaacgaggatgaggatgatagtcaggatgaagaggaggaggaggaggaagatgaggaagatgatcaggtgaggggggactgcgtttgggttggttcagatgacctcttccatgggaacatagagctgcagaaaaccaacagtctgggttgctagcctcagcgtctccctccctcatgtgcacatgtggccatggcaccaggcttcagaaaacccttacctccagcaattctccatctcctattttcccttaaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctagtaagatacaggggctcagctgggtttttctctcttgattcttatacccttctctagggtaagccaagcagtggaccaaaccgatccgatacagacagcacttcttttcctatgctgacttcctggggcaagggatatctgaatccatctgtctcattagtgtatacttaggagaaggaatagtgagaggctgcttttgttcccttcacctcagtaaataggcagccattttagagcctggacaacttgatgatttgcttgattaaaaaaaagaaagagaccaaggctgactgcatcaggcacccatgtgcacaccacagtggcagggcaatcaataatccttatgtccataacacaagatcttgagggtttgaatggtcacctttgagcttggctttggggagcagatttgaacatactcactctattcatccaggatgcgtcttttcgggagaacgagtgaatctcttcctcccccatcaccgtgaaacttcccttttagcgtcaagttagaatcgagttcttagaatcaagctgtcttgatagggcaggtcttgacaacttaaatcacaagcatgatgtagcagaaaacactgaactgttctggtctgttttcttggccaattaatctcttacctctttgagcctcagtttgtcacctgtaaatgaaaagttcgagaaaaaaatgggttggattagataactttgaagataacatctatgattattttgcatttttgtgattttcatcagtttcccttagagttgagcctctgtccattcagcaaattgaacaatatttgaggagtgcctactgtatcctaggtactagggatacagcagtaaagaagaaaacagtcctcgttcctcataggagtggtttattaggaatcataactaagcaggcattacattgcactatagtaagagagcacagaggtaaagagttacctaacccaatctgtggaagtcaggcttcacagagaaagtgacatcttaggccaagaagagaagagcaggtaaagaagcgggagaggagtcttcaaggtgaagggagcagcatgtatctgaggggcctagaagcatcactgtgactgtagtgtggaaaatggattgggagaaggtactatttaggaggccgttgcagtatctaagtgagagatgatggcataagctatggtagtgtcagtgattgtagatgagttgtgggaatgagggagaaaggacaaagctcaggtttccgtgtgaggaagtaaggcccaggagacatgattctgcttgaacaaacatggaagaaatttctttttgacactgacccttttacatattgtccttgcagcagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggtgagttacagagatctgttggattcatcggagctcttgtaagaattttcactgtgctttagcattgtcttaaccttgggggaaatagtccatcacttaatgttcttgtcatacacacaaataaggtatttgttccatttctttgtggattacatgtgtagccttttggggagtgcagccttttggggaataccaaattatgtcaatagttctgcgcatgtatttagcaattattaagtgtctcatgccaagcacttaacactttagatatagacgggacaagatccctgccctcaggcttagagtttagtgagacaaacaatcttaagaagtaaaagaaaggcatataagtgttgtaatggttggtgtacagacgacagagagggtgtagtggaggcaatgtgacctgacgcagtgcctggcacgtgggagcttattgacacccacttggtgccaggaactatggaataatatacaacttaagtacaaaaccagggtggtattcagaaaaataacttagacttgtgtgcacatcatcaggtttataatcatgttctgcatttaatagaggatgcatgaagaggatctcatggtaacaggttgcagggcacctctggacttaacagtgatcatggtacccaccattaccctacaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggcaagtttgtgtggtgaaagggagggtagaatttgtcagattctactttttccctgctgaggaaaagcaagacagtgtctgccctatagaaaacccccattttataggagccagaaccactcagtgacttagccatgggcaacaaaaactttattgtctctaggtacttgttatgttctaaacattgtgatagaccttgggtccttttagggaaatactgcaatttttggatcggtggatcagttaatgcttgacaaggccaagaatctcattcccctttgctgtccctacaggaaccctgtccagcatccccacagccctgacccgctggacagaagaatgcaaagttctcgatgctgagagcatgcatgactgtgtttcaggtgcgtggcagcttggttatcagggcaatagtgagccttccagagctagggcaaacgtgtggagagttgtttccctggttctctgtggctacaagctctgcctcttggcttcctccctgaccccaccagagcagcctttgatttttgcctctttgaaacagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacaggtgattcccaagggctgggaggattcatctttgactgtgtctgccgtaatgtggttttggcatacacatggcaccaggaatcactgaagaatcctagaacgttcacgttgaacctgggaaattttttatttcaaattcaccatacattgacctggtttttaggggaaagaattcaaacctagaggggagatttctcaagtgtcaagggaaaaactggagccagaagcagaatggcttctcactcaacagtcacactgcatagtctctaccgccaaggacagcatcaagacaaggagaaaaaccttatctaagtccatgctcttagtcgcccacttccatttctgtcggtgaactgccagtgtggggaatcttaccgagatgaccccattccgtcatttgagtaagatcagcctaggtgtcagatcagagaaaatgtttgtactctgaaccccatcaccacatgtcattttttctagggctcacatgtataaaatcactaatacaattttggtttagaaggaagttacctacttttttctgaaacttctgggacctcagacagagatcttttaaatgtctgagtaaatgttgatagaattatacattacagtgtatcacttgatataaaagggggaaaaactgatagaaatacaaagaaataagacttgagagtgaaagactttagtataccctactcagcagttaaggaatcaggtagattaaaaataagggtagtgaagtgttcagttaaaataacaaggttgatctaacaaatatctttatatagaactttttacctaatacacacattgtttcaaacttgatataggatgaaaaataagtgaacctagcctgtgactgaaaagactagagtggacaaaataaaaaataagccccatgaagggaaaaaatacatagatgaaaccaagaaattcttgctagaatgatcatgatcgtgcccatccctaaggggtttttattatcctttccttccatatttatttccccctcagccccaaacaattcttgaacctgagtatgtatagagaaattggtcatatatttgcacagtgaaatgatcaccttcctttggtcacatggccaaagcattctccattagatcactgaactcctagatggtctgggtggaggatggtgactattacagttgacctctatcttaggtgcttgcaaagtcccacattggtctatcccttctttttgcagtgtactgcatctaagtcaaatgactccactgaacagaatctctcaggtaactctccttccctttctcccttcttactaatcaattggttgcttctttatcctgatagttccgagtagctggcccacataggctgaagatggacactggtgctctgtgggatgaggtagtagattgtatagttttagggtcataccccatcttggagataactatacagtctactgtctttcccacggtggtacacttcttctccgactggctctgttcaggttcttgttctggttattatctactttgttctggcatgggtaatgaggtcatgtgtcttgttcatttcctgactgcaactctgtcctctgaaacagcatgttcatgtacatctttgaagtggctggtcctttgatgaccaccatggtgtggcacttcatgagaataactgatgacagtggttctcaaatgccagtcctctgtggaaacgaacaaaatcaaggagctttaatgcctttttcataaagctgaatttattccatttaaaaggctgtttttgtatttagagatcatattcctaattctgtggtaccaaaatatttttattaaatgatgttgattggatgttttttcttacatggctaaactaaaagttggcaacccctacattagtctctactttttgttctttttttaattaaattttattggtccatggaatctaaaagtctaggaacattgtcttggatagtgtgctgttcatgaaggtagctctctgggcttagtggtatgactgccgtatgtttcctattccctctgatcttcttaacaatggtcagtagccattttgtgattctatcagttggttcatgtgatatcatatgtctcccccacccatatttcctcagaacattcttctgcctccctacacctgtctcctttcgcacttgagttggaaaatgattgtaccaaagcctgcacaatattttttaaagcagtgaagtagggtagatgccttggtacccttaatctagcaaaagatctttaaaagagtctgtcaccatgtaaaatggccttttgcctgctgcccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcagtggttcatgcctgtaatcccagcatttttgggaggccgaggcgggtggatcacctgaggtcaggagttcgagaccaacctggccaacacggcgaaaccccgcctctactcaaaatacaaaaattagccaggcttggtgacactcgcctgtggtcccagctactcaggaggctgaggcaggagaattgcttgaacccaggaagtggaggcttcagtgagctgagaacacgccactgcactccagcctgggcaacagagcaagactctgtctcaggaaaaaaaaaaaaaaaaaaaagattttgaagggctggacgcagtggctcacgcctgtaatcccagcactttgggaggccgaggtgggtggattgctagagcttaggagtttgagaccagcctgggcaacatggcaagaccctgtctctactaaatatacaaaaaattagtcaggtatggtggcacatgcctatagtctcagctacttgggaggctgaggtgggaagatcacctgagcccgggaggtgaaggctgcagtgagccatgattgtgccactacactccagcctgggcaacagtgagaccctgtctccaaaaaaaacaaatagagttttgaacgaaattctgaccatttcttgctccaaatagatgaagtgggaggatcaataggattttggtagttagattttctgtgtacctataggtcagagacatttagcctcaccctatatggcctgaaatcttcccccttccacctgcagggcacagaaaggattttattcttagaatccacagagtcagagctccagttcttgcattcttgggacagagatagcactgtgccttaaccttcatccttagtataccagaccagagatgttccttggagtatttttgttgtggggatgatcactggctgggtgggatacttatcaggccacatttgctgattggggtggctcccctcatcattggctggttgccccttaaccactattattgttctttccgagaaagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataagtgagtagaatttcaacatttggggaggatgaaacaagagggaagaaaggatgtctttgtagcttctctttgctcttttgcttgagagaaatagtaggagttcaacttctcaaataataagatctcgtcttgcgcattcactttcttaagtgaagttgaggtcctgaactggtgatagttgaatgtctaatgatattggtgatgataccaacagttcattgaggcaattactctgtttctgggctatcaccccaggcttattatttaaaaacaactctccagctgggtatgatgactcataatcccagcactttgggaggctgaggcagggggatcatttgagctcaggagtttgagaccagcctgggcaacatagaccccatctctattggggggaaaaaaaaactctccaaaatcgatggtgttatttacatgagtaaactgaaactcagaaatgaaataattagcccaagtcactctgtaagtggttgaactagaattaaaacccagatctgtctgactttaaagattactctctccttccacagttcccaggatggcaagcatgtcatcccacacttagagctctcccattctcctggcagacactgtttatctcatgacactatttctcactggtttgaaatggggcctgaaaagtcttctcagcagtatttcaacaggataaattgatacctgcttgccatccctgctctataccatcttgcttgtgaagttctctggagagaccctaaggtgtcagttttttctttcaaggaaccttgtttattttattttattttattttatttatttattttttgagaaaaagtctcgctctgtcacccaggctgcagtgcagtggtgtggtcttggctcactgcaacctccgccacccaggttggagtgattgtcctgcctcagcctcccaagtaactgggactacaggtgcacgccaccatgcccagctgatttttgtatttttagtaaagatgaggttttgccatgttggccaggcttatctggaactcctgacctcaggtgatccacccgcctcggcctcccaaagtgcttggattacaggcatgagccactgcgccctaccgaaaccttgtttatttagagaactacagggatatgcacgtgcaagtggtgcctgcagtgaatcaaagtgaaaaaatcccttacccgggctgggcgcggtggctcacacctgtaatccaagcactttgggaggccgaggcaggtggatcatgaggtcaggaattcaagatcagcctggccaagatggtgaaaccccatctctactaaaaatacaaaaaactggccgggcgtggtagcaggtgcctgtaatcccagctcctcaggaggctgaggcagagaattgcttgaacccaggaggcggagattgcagtgagccgagattgtgccactgtactccagcctgggcaacagagtgagactccatccccctgccaaaaaaaaatcccttacctggtttgcctagggaagatgtttcacaggcatgcctggaacacagtaaatgttcaagaattgatagaaagggcttcagctgaaccttagaaatctcaaagtgagattgagagggggacagcaagggagaagtgagaagtctgagctgagatgcccctaaggaagcagccctatcaaagaccttatctgtcattttgccccggttccagatagaaacctaacctctccctgcaacttcttcctagcctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacaggtaagcatgtgtgggcaaaagaagggtaggatatattggagggtctttcaaagcacatttcatactcgtcaactaatggacatgcttgttatgctggggagataaagctggtttctgtgagaaaggggtattgtagcagtgttttataaacgagaagacataatacagacagcaacctgagcatgatttccctcagctccccacctgcatcctctgagagctcttccaccagagattctgccgtggccatttctggagcagattcccgaggaatcctagaagagccgttgccttcaacaagcagtgaagaagaagatccccttgcgggtgagttccgtgtatgcccaggtcatcctgggattgttttggcttctagtagcccttggcatggaaatgcccaccagccaaacagttccatttagatggagggcatgtatgtgggaggactgacaataagcgggggtgctggtatggcataatgaaacgggtccagccttaggagtcaaactgatcttggctcactcaaattcccccactctgccacttctaccttttacaacctagggtcattatttaatttctgtgatcatgaatgataccgagggggtgatgatatctgcgtggtaggttatttatgaagggtaagtaacagtgcatgcagtctagcaaataacaaaagctgttctgagcccagggaaggtggggtgggccttctctgtgtcccatgtcttgcaagcagtgaagacatatacactggtttccctcaaggagtgacatgggtttattttctccaagtacatattaggcaccaatagaggtgtgagaggctgggcgcggtggctcgtgcctgtaatcctgaaaatttgggaagcagaggtcagaggatcacctgaagccaagagtttaagaccagcctgggcaacatagggagaccccatctctacaaaaatatatatgtaaattagccaggcattttggtgcatgcctgtaatcccagctactcaagatgctgaggcaggaagactcgagcccaggagctcaacactgcagtgaggcaagggttgcaccactacactccagcctgggcaacagaccaagaccccgtctcaagcaattaataaggcgtgaatccctttacatgttatatctcccttcaggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtatgtgagcgggaaggtggtggggccaggctgcctggcaggagaaatgccctcattgactttttctgctccataggtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccgggtacagagggaggcaagtgggagggctctggaaagctttagccagatgaggctatgttttcttacctttgtattacctatatccagtttacaccctctccacaatctcagttttctttttctttccttccagctttcaccagtcgcttaagtggcaaccgtggggtccagtatactcgccttgctgtgcagagaggtggcaccttccagatggggggtagcagcagccataacaggtacctttgtctatttttaccttaccatatcaccactcaagtctattagcccagctcccttagttttataggtggagaagctgaaatcctgacaggcaggatggatggtctctctaagccatttccttgaataagtgagagagccagatctttggactccccattcagaaaactacaccttttggttagtcttgctaccaaagaccacaatcgcaaaagcaggccggcagcaggtgctaactatggttttaacaagaaggaacaccacttgtctcccatgcaagtagtaaaacaactaaccacctgccttgagtttgtaacacctaggctaaggaagtatagaggagtgagttagccaggctaaaacagagtgggcctgacatgccaaaatgtgaaaggagtgattggttcctacaaggccacaaactcctggtagtctagagaaggcagaaactagcattgtctcctagacttaggtatggtcagattttaccagtcgatggatgatacctgggctggaatctctgctgtcttctcagtcgccgtgtgatgtagggcaagtcacttaacctgtttgagcctcttgtttatcatctcaaaaatgggtggttctcggccagttgtcgtggctcacacctataatcccagcactttgggaggctgaggcaggtggatcacttgagtccaggagttcaagaccagcctaggcaacatggcaaacccaatctctactaaaaatacaaaaagtagtcgggtgtggtggcgcgcactagtaatcccagctactcgggaggctgaggcacgagaatcacttgaatcctagggggtggaggttgcagtgagccggtatcacgccactgcactccagcctgggtgacagagcgagactccatctcaacaaaaagctggtgggggtggggggcttcattctctaagctgtacagcagccctgaaaggatgatgtacagtcattgtaaagtgcctggtacatagtagacacctaagagggcagctgttactatgaagagcccttggactggacacccacctttctcaagcctccttggagatacctagctcattcccctcccccattcttatgcctaatcccagagctctagccactgaagtgttacccaaaaaccatgttctgtttccaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtgagggtttcaaacccaactcctggggatggaagaagggtggcagcaagagcctgggtgaaagttgaacactaagcaggctagcgtgtctttttgctcttattttaagtgttgagccctgtattgtttctaggggattgtcctatatatttctggggttttttcttcattcttttccatttttatgtatgtcttatttagtcatcaaaacaactgggctgtatgattcctgttttacagatgaagaacctgagattcagaacattttattcattttgtcttatgattagaaagtgatggagctggacctagaatttagtgttctttcaataataagcattgctgccatctatcaaaggcctgccttgtgccaggcactgtgcaaaatacatcatgtcgtttaatctccaacaactttgcaaggaagtgtagttatctccattttataagtgcgagactaaagctcaggaaaagtttgctcgtgagtctgtattgctacaaagccctcattcatttctctaggctgctttactgtctgttggataaaactcttatatgacatatcccccaatatttaccaaaattgtctgaaggagtctgggaaccagttgtcttttccctatcaggaaggctcatcctctgtgaagacgtcctagaccaagccttgtcctccttttcccggcaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaagtaagtgtggatgtagactgggagctgtggggtatatactgtggcacccacttcacccccttttccatccagatagttctccctcagtgatagcaatcagcttggtttgtgtttgtgagaacagaatgtgttcattctcaccctcatctgtcccagttctctcactctgtctcccttcctccatccccgtctctctgtgtctctctctttctctctctcccctgcctctcacacacacactcttttgaaggtcagcaggcattcactgaatgtagcttccctaggctaggcaccagaaggaggaaagaaagttaagttccatcctcagggaattcccagcctttccagttgtgttgagggagccagttctcatgggaaatagttcaagggcgggcaggatacagtgtgattcagagtaaccagatcatcccaggaaataaaggtaatgagccctgccacagattagtaagaaagaattatctgaagaagtaggttttaaagaatagagtgggccatgatggtgggggaatagttggaagaaatgcctggggtttctttttcagcttagaagttacagtcataagagtcctctttgagtttatggtgagacgtgattgtgccactgcattctagcttgggcaacagagcgagaccgtgtctgtaataaaaaataaaaagcctttatcatcccaagtcatttagatttgcctttggtgggtgggttttctttttcagtactttcccattttgaagccctgggcaattcagcgattccttgattttgtcacttagtccctggcttgtgagtttcagagaggcttacagtgttctgtctgtttcctcaaagtttctcccactactaagggcagcaaatctccagcgaaggtgagtgatgggggcagcagcagtacagactttaagatggtgtcctctggcctcactgaaaaccagctacagctctctgtagaggtgagtccaagctcttctgatctgctaagacttggggagaaaggataaacagggtagataatgattttgttctcaggctggggcttactccttctgtcttctttttctcaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaatagcagaagtaaagcattttctctttctgaaggtttccacttaggtgcttcctctttctggaatcctttcctgaatccccaagctgaatcagatacctccatatccctataacacagcctccatgctccctctgtcgtaacacagattaccctgggttatcatctgttttcctctgctcagttgtttgaaagcaaggctgggtttgtctcctcatccccgctgcccggcacacagtggtgcttaatgaagagaaaagagaacacatgggaacagcagcgcctcctttcttctccatgctgggcactcgtaagagccccataagacagctgaggcagcttcaccccttcaaagtatgtccctacactgcattcagcctcaggaattacagagtcagaatagtactctctgcttttgtgtaattttgagggtataaaaattctaagaacagttacaaattacctcgtttctatcatcttcctccctgttttactgagaagaaagccaaaacccagggtgataaagtgattggaccaaggagtacagccaggttttctttcaacatagagtctgtctaccctgtcccaccctcatcccaatcatgagtctccctagatcttggctacatacttagttctctctctccttcacccccatgtccctaagtctggggtgataggagagttggttggcctgtataactcagggtgttctttgctgcatgaaaattacaacgttcttccagaaagaatttggcctctgacctttctctcttggctgccaccatctattccacacctatgggccaggcactgtctaggcactctaccatataattatctcttaattgtcacagcaacgttatgaggttaggcagtaatattcccatcccagtattaatattggttagcaaattgggtaaggggtcaagaaatttgcctgaaaccaccacagaacctcagtaattttgagagatatatgggatttcaaccatggtctgtttagctccagaggagatactgtttctcttctacatgaaactcatttcatgcagattcagcagatccctgtggccataggtaaattggtagtcccaggtgacggttcgtggacacgcataataagctgaacagagcacgattccagctcactctaggttctctgcagctgagcaatgaagagtggcctaagcaggtgtcttagagagatttggcttttagccactttaccaggggagtctctgaacacttgctgactcctctgcctgctcaggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtgggtggtagccaccctttggctgggggcttgaatctgggatattctggaagatggctcttgctggtttcctggtcttttttatttctctgggtgattttcgtatctttcctatacacacttgacccatttttttctacttcctacttggaagatttccttctgagtttccttacccctctggttgacaccaggaagccttgcttgctttgggtgtttatactttgatgctgtcaatatacgcaagccacctctacactatccaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggtatggaactagagtgtccagttgaggggaagggttggtggcggtaaagccagattccttggaggtgcaggacttaacggcctgtctccttcctgtttgacctttccaaaaggaaaatgattatccttttttcagaatgttgatggctgcattctacatctcattcaagctatctgcgtaggaaattcattagggggagtgggaattaagggggagtggaaatctggcagggaagttgggggccagccttttgctgaacaagacttaactcactaggtgcatctcctttctgcttccttggtcatttctaactaagccgtggcttgacaaatcattttccctacctctttcctcctgtcccacagaaccctctcgcacaaaaccatccgtctgtctagcatcatgccccctgcccttatctgtaatggtaaatcttagcgcctgatgatgagcactctgaagcttcctgagctaaagctcaaaagacctcagcaagatgccctgtggcagcccaggagataggagagagaatattgggctttccctcttcctatattttatatcttgccttcctctttctctttctcccaggttcctccggtttaggctcagctagcagcatccaggcagctgttcggcagctggaggctgaggctgatgccattatacaaatggtacgtgagggtcaaagggcgcggagacagcaacaagcagcaacggttagcatgatgcctgtggcccctcattcatttgtctctccactcatccccccaccatgtcatcagtggggtttcattgcctttaccttgtatgcttttgcattaagtttgctatatgaatgcttctggacaaaagggttactttctgttggtgttttcctatttgttgattggtttgttggtttgatttgatttaaagcttggccatcataccccactcccagctatccagtcaacagtggcgcttttgcaaactgcctgatgctaagtgttgtctgggttctgaggggttatggggtgaagttttttttcagtcccatggaacaatgcaggtacatcagaaacatctcaggaatcctaccattgaaagtcccccaagcttggtacatatcccacacagccacttctgtctgtggctgctccctccaccctgccctctgcctttattctccataatcccttggcacctaggcactcaggcacttttaggaggaaaccttcaggtacttaagtagccagctcagtgttggggtcccggcattgagtggctgcagtaaaagcctggcatcacatgtgtatgctgtggcactccctcattgttttcctgtccttgcaacatgtaagttacctttccaagatccaagaaaggtatcctaagacccgatatttctttgcgtataattactattatacagtatggttttattgagtaggcagggaaaagccttgaacttaggggcagtgactccaggaaggtagaaagggaaaataaagctgttattctggagtattttttctgccgagtctctttcccattacacgaaaagatgtcggctttttaaataatcccgctcatgagaggttgctctaattctcctattatttccccttttgtgagcaaacagaaacaaagagcagacctaccttccacccatctgaattttttatacacacacacacacacacacacacacacacacacacacacacacacaacagaagaagacttgaagtctatatacaggaggctagttctgactggtcacaggtctggattgtagactgtaggaaatgtaagcatccaaggagctgttgggaaaagcttacaaaacacagtggagaaaagcagaagagttgggaaaggcatccttttgtcctggatagctacagttttccccacccaaatatgggaagcttctttgcaagctcaatgtatgagaagtggaagggccaacctctagcctgtctctaaggaaagcagagttgcacccttatgtgatttttgtctcccttttatccagtcggagtctagccagtcagaggcgtctgtccggagggaggaatcacccatggatgtggaccagccatctcccagtgctcaagatactcaatccattggtcagtactacttcctgtttccagccgagcaaaagggatagccagtcttctggaatgtctgctgaatcccctgctcccagcatatataagcccagtgttttcccatttgttccagtaaaccctggtttctgtaaatgatgacaggtgtttgacaaccaaggcacacttttctttcctgtagtaaaggaaagaaaatggtgggatatcatgcattcagacagcatgtttttatggggttttctcttgttgtggtggttgtttttgagacagtctccctctgtcgccaggctggaatgcagtggcacgatgtctgctcactgcaacctctgcctcctgggttcaagcaattctcctgtctcagcctcccaagtagctgggattacaggcgcccaccaccacacctggctagtttttgtattttttttagtagagacgagtttcgccatgttggccaggctggtctcaaactcctgacctcaggtgatccacctgtcttggcctcccagagtgttagaattacaggcatgagccactgcgcccagcccagcatgtgttttaaatcttttgttttattattgaggcagggtctttctccatcacctaagctaagatacagtaacatagtcatagctcactgcaacctcaaacttctgagctcaatcgatcctcctgccttggctatctgagtagctggaactgtaagggacaggccaccatgcccagctaattttttttatctttgtagaaatggagtctcactatgttgcccaggctggtcttgaactcctggcctcaagccatcctctcacttcagtctcccatgtcttctttctttcttttttgttttttgacacagagtctagctctgtctcccagggtggagtgcagtggtgcaatctcggctcactgcaacctccgcctcctggattcaagtgattctcctgcctcagcctcccaagtagctgggattacaggcgcctgccaccatgcctggctaatttttttttttgtatttttagtagagacagggtttcgccacattggccaggctgatttcaaactcctgacctcaagtgatccacctgcctcggcctcccaaagtgctgggattacaggcatgagccacggccgaccagccttagtctcccgtgttttaaatcttggctcccccatttactgcttctgggacctgaggcaaacctctttgttaggtttccttgtttaaaataggaatgttcagttgttaggattaaatgagttaaaacatgtatagtggttagagaagcacacgatgaatgctattgttagcagcatttctcaaagtcagtcatacatagaatacattttggcaccctcataacacattcccatggaatagtattcttgtaggacaaccattgttatcctacctttcatcaggatttggggagatagatattattttcgtgttctgtattcaccttcttttacctaaggtcatatgatttgcaagtaccggagccaggattcaaacctaaggctgtcagaaccttgaagaatagtcaggatttgggtaaaggatgaacagcaaaggtcaggaagaaacctaagcagggccaggtgtatggggatcaggggttgatgagaaaacagtcacttactccccacccagaagatggggttgtgtcttgctgcttagctactgagcagaggttagaataagcccccagtgagtatcaggaaaagtaccagccatgggattccatctgtcataccatggcttctcagggttttaaactgccccaggacaagatgactaatttagaaggcattagaaggccgggcgtggtggctcacgcctctaatcccagcactttgggaggccaaggcaggtggatcacgaggtcaggagttcaagaccagcctgaccaacatggtgaaaccaagtctctactaaaaatacaaaaatcagccgggcatggtggcttgtgcctgtaattccagctactcaggaggctgaggctggagaatcgcttgaacccaggaggcggaggttgcagtgagccaaggtcgcaccactgcactgcagcctgggcgacagaacgagactgtctcagggaaaaaaaaaaaaaggcattagacttaaggttagaaagatttagtttgatgtcctggtgctgtcttcctcagaaaccaaaatgaggaaaagacagcctactttccaaggccagctgtcagaattcaatgacaaaagtgtcctaaaacatcctgtgtaaactggaaggcaaccatccaaagctccactgttgttacattaccctgaaataatccacagattctcttgaaactagtgaggcagtgactagactagcactatctggatctgcagtagcacctgtggcttttgagcaccttaaatgtggctagcgcaactgaggaaccagattcattattttatttattctgtttaatgtaaatgccatccaatgcaggtcctagaccttgtttcagatgttgctcggtgagtaccactcagtggccagtggtcccctctacttgttctgtatattagttggtgcgtgtggtctagaaagatctaagcagaagggaaattttgaagactttctgactctcttctgtgtgccctccagcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctaggtgagttgtgtcctaaaggcccaggtcccaacccagtggtctgctctggggcccttcctgccagcttgtttttcttccttccaggttactcctctccctcagtgtctctgtaatgagaattcaaaagagaagtgttttttctctgacttcagtataaaaaagattgaccttctcttttaatagttggtgtctttcactttatagacaaggggaatctttataactggttagctatcccatttttctttggcttcaaggaagttcctctgtgacttgattctaccatatttccctgcaagttctcattgtttcttttttttttttttttttttttttaaatcagaaatgaggtctcactatgttgcccagactgatctcaaactgctgggctcaagcaattttcccacctcggcctcccaaagtgctgggatcataggtgtgagccaccacacctagcctagttttcactatttcttcttccttatttatttttataatttgtttatgatggcaaagaggtttgcatgttgaagtttgcagagtaaaatgttacttctccatcattcctaaccctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcaggtacagggaacttttaggctgccaggtgtagaaggcttcattttaaacaggattgtttcatacagttaatccttagttgatgagagagagagagagagagagagagagagtgtgtgtgtgtgtgtgtgtgtgtgtgtacatacacacacccgtgcacgtaaaccctgcatggtttcccttggcctcaggatactcaggtttagaatagaaatgctcagattcacgttcacacctcaagggctggcccttggttttgactagtccttttagagccctgaaataaggaagaggaaggaagagagagttgctagctggttggctgtcttacagcttctggggcagatgatgtgcttaattcctgctgtcacttctcccctcagagactcaccgcactgtgttaaaccagatcctacggcagtccacgacccaccttgctgatgggccttttgctgtcctggtagactacattcgtgtcctcgactttgatgtcaagcgcaagtatgtgtcctggatattggggggtagaggggtggtgagaactccccaaatggtaactcgcctctgaagttactcttgaggccacaaatttcctttggtgacagcacttggaatggtggtggtgaggagggaagagacagctgtagcattgatggccatcatacctaaatactcctgggcttctccaccccatctgcatttttcatcagcaaaacagagtcacatgatttttgaaccacacagtttctaaagttctgttccatccgttgggggtagtacaggaggcacaggtggccatagaacacacacagcagggttccaggggcttccacaacactcctggagtcatccctatgcctctccttctcctcgtgcatgtatacatgcttacctgcttgtggcagaaatcacatgtcacaatctttgtgggcccttactcagtggaggtaagaaaaatttagagttggtaatgagtgatctacctctcccaactactgggcatttcccaaacaggtgtggagcagagatcaaagtgtttggaggatagaaggagcatcattgtgggtcttcttcctaatcacacaaacaaatttgttctgccacccttaatcctatcttccttccttttctacctcccaagatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtaagggcccaggaacggagaaaagatggcgggtgggaggtggggcctcctgcacagtagcgatggcttgctctagcctcaaatttagggaggtgctgccctccctaataggaattccccataggaatctggttttagataatcttactgagttgtctcctatcttctgggcctgccctgctggctggccctttagctaagctacccaacaattcccagacagacaggaaagtctttggtgtttataaggatatacctgctggctttgcaatgagagctttaatattgctatactaggaatgaccatgtatgagtggcctccaccaaactggtaactgctcactggtgattctgaagccacctagaggagatcagcagtttgtaatactgagcgtaggagctgatgagatgaaagacctattggagttgtttaatgattcctccccatctcttgtggtgtgggctctccaactgtgtaatcacaagaagtcagggagtctccctagacagactgtatgccatgttcttccaccaccaaatacctttagagaatttggactctgggcttatccctctctaataccacttttctcccctccccacttcacctaagcaaggcctcatttatttctctgatacctttcctattggtgttttctggaatatctgttaaccttgactattttgggacatctcctctgtcagtggtgcttttgtttgctcccagatctccaccccatttctgggctgtcctggcactctctgtttacctcttcatctgacactgcactccccagacactgcttcacagtctctcactcacacaaatgactggatgtatcctgggttttctgcacagctcttttctgcttctgctttcttatgcaggtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcaggtgaggatgaggcatagtcctgggactgtcttcagtcctgggggtctggtctttttgtgtcccatccttgtgctccttcttcccccccactcgcaaaccatgaccctgtataattgtgtttttctagatatacagatatggagagtgaagattaccacttctaccaaggtctggtttatctgctggaaaatgatgtctccacactaggctatgacctcaccttcagcactgaggtaggtcaggaaatcctaatcacagcacatcccagccaatctggaagatccattccaggttcaccttagaactagcactgcgtgaccttctcatagttctaaggaagcatcttgacttcttaaagctgtagcaggtgtttgtgagtgacatcacaaacaggaaaaccagaatttgcaggccatttcctagtttcacctttattaaaaaaaaaaaaaaaaaaaaactccagtacataattcctcattcccaagggtaggtctttgtagaaaaatcgtacaaatgtaagtggggggaaaatgaaggcagttaaggttactcttctcctaaattcttttcctaagagattacattccgttacatatgttagccattcccttttcccttttaccactgatagttgccttactctcttctgccttttttgtaggtcttagagccaaagagtattttcctctttcctacccaaagcctttccctataaggggagttgcgagctatgagtagtagaaaaagtcactgttttgtatggacttgcctcatctctctgcctaggacatggcaaggggtttagggtgtgttcctaggtatctaatcccatcctagatgaagtctgatatgtatgattggtgttttggttgttctaggtccaagagtttggagtttgtgaagttcgtgacctcaaacccaatggggccaacatcttggtaacagaggagaataagaaggagtatgtacacctggtatgccagatgagaatgacaggtaggggaaatgttcctagacctctagttgctcaatatgagaagaggtcggacttgattcatttgataggcatgttttgttttcctctgctatgacagagccacaaatgccttgcacaaaagacaaaacacttgatcaaaaatacttaactttgggcacggtggctcacacctataatcccagcactttgggaggccaaggtgggcggatcagttgaggtgaggagtttgagaccagcctggccaacatggtgaaaccccgtctctactaaaataaaaaattagccaagtgtggcagcgtgcgcctgtagtcccagctactcgggagactgagacagaagaattgcttgaacccgggaggtggagtttgcagtgagctgagatcgcaccactcttctccagcctgggcaacagagtgagactccatctcaaaaaaaaaaaacaaacccagcttaacttcactggacacagtggctcacatttgtaatcctagcactttgggaggctgaggcaggaggatagcttgagcccagggggttgagactagcctgggcagaattaaccagttgtggtggtgcatgcctgtagtcccagctaacagtggtagatgggagccagatgggggatctctgacctctacggttgtgtgagtttagaagtcatttggctttttggttatctcaccaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcaggtgagctgctgctggcatccctcctcatatggtcctcttaccctaggcaacgctagtttgtgtgataccaaataaaccagtagtactcttagaggaagttgcatgtagaagacagtctacctatatctaactctttgttctcctgaagcatagcagacttctcttggccgtcttatgaatgaaaggagctaaagctcatcccacagaagggacttgcctcagataccaagtccagtcctgtttcctagattccatcccccccaccctgcttctaggagctttctacctaacactggcttcatgggtcccttcctacagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatggtaaaaggaagggtttgtttctccttttcagtgcttaggttgagcttgcatacttgatgttttcaggaccctacccaagattgggaacacaaatgtggctgagtcctggaccttgggtaactcacaatttggtgtttctatggaggtgatgtttgagatgagatgtgctagacacagtgggggctggggagacactgtcaggtaaacagcaccacaagagagcatggtgtattccagggccagcgtgactggagcaaggaggagttgcagggagcaaaagtctaaagagctcagcagaggtccgattaccagtgactctgaaaaccaccttcaagtttgcactttagcctatgggcgagtgaggccagggtgtttaaggaggagtgacagggtcagatttttggttttggtgcctgatggccagtttgggagccagataaagggggacatactgggctgagacaagattgggagtcatcaagaagcagggagttggtttcttcagggaggggaggggctggtgggcaccatgggaacacacagatttggttatctgtcatccctcaccacaaactgatctttcttctttccttagttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactc

SEQ ID NO: 37004 - DNA, 81069 bp, Homo sapiens
actacccgctgcggagtgaacggtgtggagcggaggccgcggaggctcctcggtccttcagcacccctcggcccgacgcacccacgcccctcaccccccgagagccggtgagaggggcagccggggagctccgggagggagcggggccccgggcagccgacccccgggtgggagctgggcagctcttcaggcggggcggggccggcgcgcggacaggtgagccgggcgggccgcggggctgcctccattcggctgagtgggggaagccgctgccgctgcttttgtggcgcgtgggctgcggaggagcagccgggccgaggctcggcgccgccgctggaatgtcactgacggggggagggggcgcgaggccgccgggtccctcccaaccacccccaagcctggctgcggcgcggccctgccctgccccatccggctgcggcaggtgggtgggggctccctcgtcgggatcttcgccagccgcctccctgcagaacgctccccgcaccgcccccggtcccttccctcggccgggagcgacttctgcagctcgttcttccgaatcgcaccagcaatgccggccagccgtagagggaggaagagcccggggagcccgagcatagcgtaaacggctctctgaccttaatttcatcctgcatggcgaatctctgccgtctctctgaacgcagaagggtctgagactggccgtctccttttctttccttgtaataaacatttttctttcttcctagttgtgatttgcttgtaaataataggtaaatgcagtgcttgcatggtatgtggctcaaatcaaataacttaatagcttagcgttcttgtttgtgtgtgtgtttcctgggactgggtctttcgagtcgagatacagtgtcaaaaattctaccataccactgttgaatgatagaacagtcttttgtttgaaagctgtccctgagaatttgattagacgcttcccctagaacatcgctttcaaaagtctctgatgtactagagtaaaatatattttaaataagcgccttgttaaaagttgaatatgttttaaatgaaaagcctaaatagctcagaaagctgggttgagatgatgcttgaactgttccaacatctaatcagatctcttttatataatagatcctaaaatatttaagccctttgttctgtcttcatcatgttattttagaaaaacttaccatcatggctgttcgggaagaacaggagagaggccatatgaagtattttcataatgtgttgagaaattgcgtcgtcatagcaattggccttaagtaaaacagaatgtatcaaagatggaagggtgggggtgtcttggagccaggaaacagaaaatcttggaaatagcaggaggaacactcagctatatgaagccattgagtcaaggttccgactccttaactagtcgtttattttccctttcattgcagctaactaatgtcttagattttgaaaggtcaaattgaatgtgctgcggaggaaaaaaaaagtgctgcagtaaaggcctctgtgcaggaaattaacaataagccttttttagtaactgggccaataattactcaaagggaccctcaaagtgtgttaactgttatccagggaccttgatggagagactggaaaggaggatttttgcttcatcctggacaagtgtgaagcagttcttatggcaaaccatcagcctagtaactgattctctgatatgctttggtcttggcagtgtgttttgtagtcatctaataattggagaaatctggtatgtcacaggctgcagtgtaagcctgtcaagcaatatgatgaagaggtgcacatggggagagctgttttaagtatgtcttttggttccctgggttagaattttttctgctttttcttacctgccttcatccaaagttgggggtcaactgcagatcctgaaaagtggatctcaggaatagtcccccatgtcctgtcactgctgaatctacactaagaatggacaagtgtgttcaaggctggcctgcctttgtaatcagtcctccgtgggctatgcagggatcccactagttacgcactcatctgttgcagcatatcagctgcggctgtactgtagaagaatgcaacgccctagtggcaaatgctgactccaggaatgcggaggaggaggaggactgcatagctcatcactgggggccacttgactggagcagctgtgctgcaaaccatcacctctcttccaccttttttgcatattcctcttgtaccaattttgaacaggaaatagtattttgtaaagtaagtgtactggcaaactaggcccaagtcagatctttgtggcttgagttctactttgtggcaatttcatgaagtcatgctcttttattgctgaatggaaggggatttaggaatcatcttgtcctgggatcctcaggaggaaggcatgtttagtttgaaaaagtatattcggtattattactttaacaagtggggaaattgaggccccaaggagaatgagacttgaccagggcagcatatctagaaagtaactgccaagacctgggaaccttggttctccttccacattttaaatcccttgtgggatttagacgctatacagaatgtcagagagaagacactgaaaaaatatctgaaattggatttttaatctgtattcatattttttaaataatctgttttcttcatgattttgttccgtttgcccttagaagcttgttatcttgctcttccccctccctctttagactccacattcctccatcatgttgtcatcgtttcgtaaacgcagagtccaggtatttgacgagcatgcagaaaacgggttgcctttttggttttgcctggcttgcagtgaaggcatattcgtgtcaaagaggttgaatgatccaaagaaagggggaaaaaaaccctgcctgcatgacgtttctgttaaacaaattggttaggatttgtttggggttttttggtgttaaattatcagaagtattagtaaatttacttgaaaatttgcaaagcctttttttttttttttttttttttaacctccctctctttctctttaaggcatgaatatattaatttcttaccaccattctggtgtttgcatgtagtgtttgctgactttttattggtggctacttggtttttaagaaccaagggactaaacatattatcctagatatttggagaaaataatctgaaaatacatagtaaaaattgtgtttttaaaatttgacaaatattgtaaacttgggtttgtttcctgttgcattgacttcttccaccacaatttctataatagagcttaccttttcatgtttaaaaaatagctctcgggctgggtgcggtggctcatgcctgtaatcccagcgctttgggaggctaaggtgggtggatcacttggtcaggagttcaagaccagcctggccaacatagtgaaaccccatctctactaaaaatacaaaaaattagccgggtgttgtggtgggcccctgtaatcccagctacttgggaagctgaggcaggagaatcgctttaaccgaggagttggaggttgcaatgagccgagattgcaccattgcactccagcccaggtgacagtgcgagactctgtctcaaaaaaaaaaattaaaaaacagctctctttatatgttttctttgtgtacagtctttgttttctaagtcggacctttttcacaaaaaaaaaatttagtatcttgatatcccaaaataaaaaatataaacattggaaatttctagtgtttataggtgataaatccaaggcaggcctttttataaatcagatgagttatttacttaaatgaggtttataaaaatgggccacattataaccatttcctgttttgagtcatagtaacaataaggaacttaaatacctctcatctgaattttgcaggttaaaaggtaagtagcagcaagatagtatttgggaagcaatcagaagtaagttttctcaatattgctctgcatttctggattttgatgcaatgcagtatgaatcttttgctttcttaaagctaagtccctgctcacctctgcaaaattgcgctaacaagttgaaatgaattaatcagtttgaaggctgacatgctgatccacaatcctgattggaatgtggtttaagcaaaaatatttgttgtttttatttatggtgttcagtcatcctttatgtattattgacctctctgcttaccatcaaatctgccactaaaatctgcagctaagctggttttgagttaattttgtttgatctgagaatcaactggtatacaattttatgagtgctaatcaattctttggtggtttgttcttagggaagcccttccacatccatggatatagttctcttgctttgcaaatctgaaatttggtaataggctggcatcctaagccacggaaaaaagacattgttggttctgcacatttgggttctgactaagcaacaaaagcaactgatgaatggtttctatgatcttttgctttgggtgatgtttatgaatttttccataaccaaatgaccaaacgacccgttcatcctgttagtccctaaaaatccctttcttgcaaaactgtatgtctagtggtgtcctgcctgagaatcagaattcattttgtagtattccaaatgtctcttacatccagtgcattcaacttgctgaaagaatggcaatcccaatgctttgtttttaatagagactcctttcagcttcactataatttttttctctcttttgggattccatagagaaactgactgcactcactgcaggtgccaggtttacagagtccagagcatttgacctttggttcgaaaatgtttgtatctgcagtcttttgtgttgcttaacgcagtgggattcccacccactgcctctgcctgtacaagaagatagagctatatatcccataaataccccccaattttttttatttttatactcccaaattttatgcccccaaatacccccaaatttttatttggggaatgaaaattccccaaataccaagaactgcctcaaacagctgtctcttggcgttcatcaataagacaaagatattcatgtctaatctattttgtaggaatccattttcagttgatactgtgtataagtttgtgtttgatatcctggatcattctgaagcatgctgtatctttggattaaattagaaatttcttttttttttttttttttttttgagacggagtctcgctctgtcgcccaggctggagtgcagtggcgcgatctcggctcactgcaagctccgcctcccaggttcacgccattctcctgcctcagcctcccgaatagctgggactacaggtgcccgccaccacgcccggctaattttttgtatttttagtagagacggggtttcaccgtgttagccaggatggtctcaatctcctgacctcgtgatccatctgcctcagcctcccaaagtgctgggattacaggcgtgagccaccgcgcccagctgtatattagaaatttctagccaagattcatatattcagaccccactcttcttccgagatctggtagtattgtaagaatgctgacaagttcattttattcattttatttattacaatagaggacatagttgtaattcctgctttatccccctgagattcgcattacttgctgaatgatgcagctaacgtttgactgctgcgttgcagcatttataaatagcctacgtcttcagtctcctctaataatattttgcaaatatatacctttttttttaagttaccttaaatgggaagttgtccttaaacatatagagaatatacttagcacttcatttcccctccttcagtctctatgtgaacagacttgattggcaaaatcagagacagttggctcctttgagataagcagtcagttgattgcattcctaggaagtcgtctctgttgtggtttttaggcagttagtggaactgatagataggctggtaagattggagtttgttttttaatggcacgtttcccagatttttcctttctggtgctctcaaaaggcgttaatcccatatggctgggaacagcctggaacgttctctgtgaagtcggccttatcagtctgctgcatatgccagggaaggggtggggtgcttgcagcatgcagcctcggttgtggaaggaatgtggcacgcccaggccgagctgagctgacatttcagtaactgacagtttcgggtgagaggctgtagcacctttggatggcaggaattcttaatgatatttatgagaattttcctgtgtttaatgtagtctgcagaaatgacccttttaggagcaaaaagaaactggaactcgtgtagataaacaagagacagctccctgtcaggttaagaggggggaaactctcactaacccataatgttttttggtgtctcctgtaattgcacaaatgaaaattctgaatgctgactgcagtgggagcacattggtgactttcagatacccagctccccagagacagcctgttgtggcttggcagacctcccacctactgacgtcagctgatctactgcaggaaagaaaagtccattattgcctgaccaaagcacttggtatagaattgactcgttctacttcactggggtgacaaagagggccttttaggttggttaatttcagcagggccttgctgaactgtctctctggattggcaggatcaaatcagcaagctgggcccaagcagggggacttgctcagatggaacctttgcgatattatgatggagattttcttatcataaagggctgttcccaaatgtgatttaatttctgtagcaggtaaaggattttagaaatgcagtgactcctgtgataggaggcagaacagcaccatacactcgaatcctggagactgccatctctttcaggagctcgtgtgcagtgtcgttattgttccatgtgtaactatgccttccttggaaaatttctttacaagaaaattttggaagcaaacaaattagatgcataatttctcaatgtttttccatcttaactgtttcctgagggttgagaacaaaggaaatatataaataaataagtctaaccctaattgtttaccaagactcaatcttaaataattttgattttttttttttttgagacggactcttgctttttcgtcgcccaggctagagtgcagtggtgcgatcttggctcactgcaacctctgcctcccgggttcaagcgattctcctgtctcagcctcccaggtagctgggactacaggcgtgcgccactatgcttggctactttttgtattgttagtagagatggggtttcaccatgttggccaggctggtttcaaactcctgacctcaggtgatccacccgccttggcctcccaaagtgctgggattacaggtgtgagccaccctgcctggccgataattttgatttttaagaaatgattaatacatccacatccacctcacctttttttttttttttaagagacagagtctcgctctgtcgcccaggctggagtgcaaaggcgtgatcttggctcactgcaacctcagcctcccgggttctggcaattctcctgcctcagcctcccaagtagctgggattacaggcgcacgccgccacacctggctaattttttgtattttaatagagacgaggttccaccgtgttgcccaggcttgtctcgaactcctgagctaaggcaatccacccccttcagccttccaaaatgctaggattacaggtgtaagccaccgtgcccgccttttttttttttttttgacacggagtctagctctgtcacccaggctggagtgcaggggcttgatctcagctcactgcaaactccgcctcccaggctcaagggattctccagccccagcctcctgagtagatgggactacaggcatgtgccaccacacccagctaattttggtatttttagtagagacagaattttatcacgttggccaggctgttctcaaactcctgacctcaggtgatctgcccgcctcgcctcccaaagtattgggattacaggtgtgagccactgtgtctgcctcactgttttttcactccaaagtgcagatgtgaaaaggaactaataaagagggagtgaaggccgggtgctgtggctcacgtctgtaatcccagcactttgggaggctgaggtgggtggatcacctgaggtcagttcgagaccagtctggccaatatggtgaaacccaatctctacaaaagtacaaaaattagtcgcgtgtggtggcgggtgcctgtaatcccagctactggggaggctgaggcaggagagtcacttgaacctgggaggcggatgttgctgtgaacccagatagcatcactgcactccagcctgggcaacagagcaagaccccatctcaaaaaaaaaaaaaaaaaaaagaagtgaaaggaactaataaataaccaaacagccatcaataaataatatgtcggccaggcacggtggttcacgcctgtaatcccagcactttgggaggccgaggcgggcggaccacaaggtcgagatcaagatcatcctggccaacatagtgaaagcctgtctcttaaaaagaagagaaatacaaaaattagctgggcgtggtggtttgtgattgtagtcccagctactcgggaggctgaggcaggagaattgcttgaccctggaggcggaggttgcagtgagtcaagatcgcaccactgcaatccagcctggcgacagagcaagactccatctcaaaaaaaaaaaggccaggcgcggtggctcacgcctgtaatcccagctcttttggaggccgaggcaggcagatcacgaggtcaagagatcgagaccatcctggctaatatggtgaaaccccatctctgctaaaaatacaaaaaattagccgggcgaggtggtggatgcttgtagtcccagctagtcgggaggctgaggcaggagaatggcatgaaccggggaggcggagcttgcagtgagccgaaattgcaccactgcactccagcctgggcaacagagcgagactccgtctcaaaaaaaaaaaaaaaaaaaaaaaaaagaatatgtcaatatgtcaactctaatcatgttaagaatcactgtgtctattgtgccatattctgggaaccggaggatcccaggtcatcctggcctttgcaacttgcttactaaattacctgtctcccaactacttaattataaaacgatggcagtttctttatttccaagctctgaatataattggatctataatatgtgccaagtcctgagttctgtgcccagagagtaagagtaaaatatggtcttctttagagttccttaaaggacttatgaatgtggtagggagaacacaataatttcatggcagaatgtggcagtgttataagatgaatgatagaggtgggtggtcagggagtggagacttctgattcagaaagacttcatagaggacgaggcatttgctttggactcagagatctgtatgatttgttttttatattttttatttttttgacaggctggagtgcagtgacgcgatctgggctcatcacaacctccgcctctcaggttcaagcgattcttctgcctcagcctcccgagtagctggggctacaggcgcgtgccaccacacccggctaatttttgtatttttagtagagatgtggtttcaccatgttggccaggctggtctggagctcatgaccttgtgatccacctgcctcggcttcccaaagtgctgggattacaggcgtgagccaccgcgcccagccgagatctgtatgatattagatggtagggttgggagtgggagaggagagtgcactcctgggaaagggaactttttgagctttcaaatggaccctgtccaggacctgtaattggtgttggtgagggagcttgacatgagatacggctggaggagacaactggaaggtgactgagtgaagtcttgtttaccttgtagtaaatgtgattatagtgatccttgtcagggtcctcatcagaaatcagccttctccaaaataggctgacagacttagggcagcagtgtaaactatgactgcctgttatcattaaatattacaaaactttgggaggccaaggtgggcggatcacgaggtcaggagatcgagaccatcctggctagcacggtgaaacgccatctctactaaaaaatagaaaatattagccgggcgtgatggcaggcgcctgtggtcccagctactcaggaggctgaggcaggagaatggcgtgaacccaggaggtggagcttgcagtgagccgagatcacgccactgcactccagcctgggcgacagagtgagactccgtctaaaaaaaaatatatatatacatgtatgtgtatatatatatatatatatatatatatatatatatgtatatattttattacaaaaactgctctgagcagacattaagcttttcaaggtcactcccagtttttggttttaaggacttgacgtctgttttaagaatagaaaataggccagtgcagtggctcatgcttgtaatcccagcactttgggagactgaggcatgtgtatcacttgagtccaggagttcgagactagcctgggcaacatggtgaaaccacacctgtacaaaaaatataaaaattatccaggtgtgctggcacctgcctgtactcctagctactcaggaggctgaggcgggaggatcgctggagcccaggaggcaaggttgcagtgagttgagatcgtatcactgcactctagcctgggcaacagagtgagaccctgccaaaaaacaaaaaacaaaaaaacgccactttctcagagtatactgccatgtggtcaatccaagattggtaattcagatttagtcattaggttgacacctagttgtgtagctttagtcagcacattctttatttgccattcttgtcatcagtctagcacttaactggatagaattccaattttacaatatgcaaactgaaagattcgttatggagctctctccctaccccttacaaatgaattcaggtctgctgcacagcatctgcaacattcagcatggacttgatcatttattcaaccatttcttttttttttttttttttgagacagggtctcattgtgtcacccaggctggagtacagtagtgtgactacgggcgcatgccaccatgcctggataattttttttttagagccagggtttagccatattacctaggctgttctcgaacttctgggctcaagcaatccgcccacctcagcctcccaaagtgctgggattgcagatgtgagccatggcgcccggcctattcaaccaacatttcttgatgacctctgtatgctagaaatcagggatacaggaccggacatggtggcttacacctgtaatcttagcactttggaagaccggaggtgggaggatcatttgagcccaggagttcaagaccagcctaggcaacctatcaaaaccctgtctctacaaaaaaaatttaaaaattagccagtcatggctgtgcgtggtggctcacgcctgtaatcttagcactttgggaggccaaggcgggtggatcacgaggtcaggagttcgagaccagcctggccaacatggtgaaaccccgtctctactaaaaatacaaaaattagctaggcaccatgatgggcgcctgtaatcccagctacttgggaggctgaggcaggagaattgcttgaacccgggatgcagaggtttcaatgagccaagatcatgccactgcactctagcctgggtgacagagcaagagtccttctcagaaaaaaaaaaaaaattagccagtcatggtggtgtgcacccatagtcacagcaagtgggaggctgaggtggaagcatcacttgaaccagggaggtcgaggttgcagtgagccgtgactgcactccagcctgggcagcaaaataaggtcctgtctcaaaaacaaataaataaataaataaaaatctggtatacaaatattaggttgctcggtgtaatcataccttaggatgtatgtacaattgctttgcaaatctatagagaagtgtgattacgtctgagaaggagggaaggaaggaacattgggtacagtttagtaaagagtcaggatcctgcagtttacccatttcagctgggtgttgagatataaataaataagcgctatctaggcaaagaagagtcataggacattctaaacaaaggaagcatgtgcacatggcttggagttttaaagggaattacacattttagagcagaaagaatacttctatccgccacaagggtaggggtcacgggtgagagataataccaggcaggcatgttgggccagattgtgaaggtcctgctcaagaggtgggttctttcttctgtctgaaggaagccataggtcgggggcagtggctcacacctgtaattccagccctttgggaggctgaggcaggcagatcacgaggtcaagagatcgagaccatcctggccaacatggtgaaaccccatctctacgaaaaatacaaaaattagctgggcgtggtggtgcaggcctgtagtccccgctactcgggaggctgaggcaggagaatcacttgaaccctgaaggcagagggcagtgagctgagatcatgccattgcactccagcctggtgactgagcgagactccgtctcaaacaaaaaacaaaaaaaagccataaaagatttgggagtggcatggcgaagaatgtttccttttatagtataaaacattttggactgtggaaaaacaataatacaacaaaaatacatggttgatatgtggagaataatttaaaggaatggtgatatgactaaaatcagctcatctacacttctccaggaaggtggtctcttagaaaggcaatcttcagatctgatcaggcacagacagtgccttcctaccaccaatgagaactgcttgaatccctacagagctggggcactagctagaaactctgacatcagccatctccttctgtttacctgctaggtggatgtggggcagcactcttgacaggtttcattcctaactcttagcctactcacccttttctttctgtcttgggatagacgacaggataaaggaaagaactcccagatgtttccagggtaacacaattttataccttttattatacattgtagaacaatagctggaagggaccagcaggcttatctgttctgcttccttagtgaactcaaaaacctctctataggctgtaattttgaagttcgaagagacttgagagcacgtcgtttttcctgacatttttagtcactttaggaaattgaggcatggagagggaaggtggctagtgtgaggtcacatgttgctgacaaattcagaagctttttggcgttaatctgtatctgtttccttctgtgttccttaattagttagaggataaaatggcatattctttgttttcggtttttgttttgttttgtcacccagggcggagcgcagtggtgcaatgatggctcactgcagtcttgaactcctgggctcaggtgatcctcctgccttagcctcctgagtagctggtaccataggcacacaccaccatgcccagctatttttttgtatttttagtagagacggtgtttcaccttgttgcccagctgctctcgaactcctggagtcaagcagtctgccactttggcctcccaaagtgttgggattacaagtgtgcgccaccgcaccccctgcttgaaaggacttctgaatggacttagcagtgattatttgaataccacagttgctgtttcctctgaatccttgaagcctttgtagaattgacagtacaaaccatagttctcccattcacagttttcatttggtttccttgccgtgtgtgggttaggcatcttctgagggccctatgtaggtaggtgttgcaggggaatggatggccgtttttaataaagaaataggatctgggcttcattgttcctaagaaggggctgtcttctcaattcatttgtctcctgggtttatctgataattatttctttccttcagagaggctaattacttttcatctattttggtgcctattggtacttatctcagcgcattttgtcatttcagaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcaggtacgtctgatctcctgggattcctgccaaaattcaagagcccaaatgttcttacccaaaaatcagacgaggaaagttacttaattatgaccttgagagattggacaagaagaatataataaggaaggacaaactcattgttttcctgtattagtgagggtgaatgtggaatcttagaggtattaattgtcttttctggatgctttaaactgatggttctcaaacctctgccttgatactactggtgagctttaaacatttttcagggaagttctgggttaatctcttggaatgaggttttttgttttgttttgttttgtttttgttttttgaggcagagttgcgctcatgtcgcccaggctggagtgcaatggtgtgatcttggcttactgcaacctccacctcccaggttcgagtgattctccagcctcagcctcccaggttgctgggattacaggcgcctgccactgtgcccagctaatttttgtatttttagtagagatagggttttgccatgttggccaggctggtcttgaactgacctcaggtgatccacccaccttggcctcccaaagtgctgggattacaggcgtgagccaccacacctggcctggaatgagtttttgaggaaggcataatagtgatgttgctggcaaaaatttatagttattctggagtcagatatcaaagaataagtacttaaagttatgagtccctttcagagacttggtaaatcttatcaaaagcaaagcctgaatcttatggtacgtaaattatatatttaaaacttttttttttttgagacggagttttgctcttattgcccaagttggagtgcaatggtgcaatctcagctcactgcaacctctgcctcccagattcaagtgattctcctgcctcagcctcccgagtagctgggaatgtaggcacgcgacaccacgcccagctaattttttgtatctttagtagaaacaggatttcatcatgtttgccaggctggtttcgaactcctgacctcaggtgatctgcctgcctcagcctcccaaagtgctgggattacaggcgtgagccaatgcactcggccaaaactttttttataaaaagggaaagcctttcttctcacttatttcagtgaaagatttttaaagaaaattgtttcggtagcaagtggaacagtagttgggcccatggattttttaactataaaaaattgattacagtaacctaagaagagaatgaagaacactgctttaggtacaatccctgcctggcaggccccttcccatcttagtatttgatgaaaaagaggtattgagaaatggagtgtaggcagggtcaaagagtctggcctctaaagcaagtgaaagaaagtctcatgtgtgagtgaatatggatggatttttcaagagtaagcactgaatgttgagaaaactgttggtatggttctgtatttctagaagggactggatgttcacataaaggctaattttctgatagcaaaaacaaaaaattattaataggatattttgtagcatcttccattgacaatgttagttctcaatggtgagtgaggaccattgatggccctcgctggccaggctttcagaggaccaggagaaatgcagtcagagtatttgaggaattgagcaggtaagagaatgggcaaggtgccaaatgatgtatccctaactagagggagcaggattgaggaggggaggaacacggggaacagcggggacaaaatgctgatgctgtgtggttgcgtctgaggctcacttcaaggtccgccaacagggaaagcttcagaagcatcaagcatttgaagctgaagtgcaggccaactcaggagccattgttaagctggatgaaactggaaacctgatgatctcagaagggcattttgcatctgaaaccatacgggtgagtatgagtagctcgtggagtggatggcttcatctgggtggagcattgtagattcatgcatacatgtcagtttgggttcccaaaaagatagacttttccagcttttaaaagaatttatgaagtctccttaagaagttacccgaatcctgcctttgtaatatgacagcatgaatgcaagcgtttgtatactcagtgaggaaattaatattccttttgcagagcaaattagaatgtgattatactttaaagaaaactgtgaatttaacatttataagtggcagtgagatggcagagcatattagtgaaattggcaaatttaaggactcagatgcaaagataaatagaaacaagcacagacactataaagaaggttatctgtgggaaagcttgctgtcttgaatcttggcttgccctgggaggggtttacgtctaggcagcaagcctgttaaagctccagctctaaggaatgatgtgtggcacctattggtcaatgaccatggtgatgggactgactttgaggcaggagtcctggaactctttggtctggctgattttagtgcgagtttattggagctgaggtagtaattgatctttctctgcttcgtttcacatatctagtatgaagatattaagggaaaacaaacctcttgacagtgaggtgtgcacgttgagtttcttataactggatgtacttatctatctttgatatacatcatgtctagctgtgtgttctctttggttctttgtcatccaaagccacattgcattgaggcccagccttttctagtcttttacctgtcaaagcagtcctgaagatttaaatgaaagctgcacccttaagccccagctagaactgttttgtctcctactcttccttgataactgtgtggaggtttcgttcactgaggatccagtctactcattttcaacaataaatgtttgttgtctcacgtttgcttggcaatactctacagtctcatattaaggacttacaattagccctaagatgtatgatgaataattattaactattactaataatgatgattgtaaataggaaataaaagtgaattccaaatgtcatatgactaataacatttaacccatttgggcaatgtaatatgtgtttgcaattaaatacagatatttatcttcccatcttcacactattttatatacagtcttagagtaaatgaaatcagtctgcgttattatttccttgatagaagttgttttcccagagtgaatgaggcacctctgtagtagaatatgtaaccagcttacagatggggaacattggacagagatcaagtgtttggcttcagtaattaaggcggaagggaggaggacctaaagctgactttattcatgtctattagtaccctctgccctgtttagacagcttatatatatatatatatatatatatattttttttttttttttttttttttgagacgaagttttgctcttgttgcccaagctggagcagaatggcaagatctcagctcactgcaacctccacctcctgggttcaagcaattctcctgcctcagcctcctaactagctgggattacaggcgcccaccaccatgcccggctaatttttgtatatttagtagagatggggtttcatcatgttgaccaggctggtcttgaacttctgacctcaggtgatccacctgcctcagcctcccgaagtgctgggattacaggcttgagccaccgtgcccagcccagatggcttatttatttatttatttatttatttttgagatggagttttgctcttgttgccccggctggagtggaatggcacgatcccggctcactgcaacctccacctcccagtttcaagtgattctcctgcctcagcctcccgagtagctaggattacaggcatgcgctgtgccaccacagccagctaattttgtatttttagtagagacagggtttctccatgttagtcaagctggtctcaaactcccaacctcaggtgatctgcccgccttggcctcccaaagtgctgcgattacaggcatgagccgccgctcctggcctagatagcttattaaagcaacattaacaatactgttaactggccgggcatggggctcacacttgtaatcccagaactttgggaggccaaggctgaggcaagaggatcacttgagctcaggagttcaaaaccagcctgggcaacatagtgagacctcgtctctacaaaaaaaatttaaaaattagtggggcgtggtggtgcacacctgtagccccagctactggggaggctgaggtgggaggattgcttgatcctgggaggtcaaggctgcagtgagccatgattgcacccctggagtctagcctaggcaacagagcaagactgggaaaaagaaaaaaaaaaaggccaggcacagtggctcatgcctgtaatcctagcactttgggaggctgagatgggcggatcatctgaggtcaggagttcaagaccagcctggctaacatggtaaaaccccgtttctaccaaaatacaaaaaattagccaagcgtggtgttgcgtgcctgtaatcccagctagttgggaggctgaagcaggagaattgcttgaactcaggaggcggaggttgaagtgagccgagatcctgccattgcactctggcttgggcaacaagagcgaaattctgtctgaaaaaagtaaaaaaataaaataaaatttaaaaaacctattaaatatagtttgttgagtaggtattaggagctatttatgtacagttactttgctaacctctgatcttcacagtaagtgtgcaaggtggccattatttccctattatgtgagagtagaaactgagtctcagagaatttgagtaacttgcccaaagtcacacagttgatagatgactgaactggaatttcctctatccccttctttgtccagtcaccactatttgttttattttaatttattattatttttgagacagggtcttgctgtgtcacccatgctggagtgcagtggcacaatctcagctaactgcaacctccttccaccaggctcaagtggttcacccacctcagcctcccgagtagccggcaccacaggaacgcacaagcacactgagctattttttttgtatttttagtagagatagggatcttgccatgttgcccaggctggtcttgaactccggagctcaagcaatccgcctgcctcggcctcccaaagtgctgggattacaggcgtgagccactgcacccagcctgtgtgctttatttttccaacctgtacttcattcctgtcttctttgcttaatgtttccaccatctgcttctctgaaggctcctgttgcttgcttatgtccctactgagaaatccacctgagtcagaaccaggcttgcttgtccaccccgtcagctttccacatgtttatgaagtgcacctgcctccctgcccactcacgctctcaaataatagtaagcctgtgaagccagactctctctaacctgcagtatttacaagatcagacacatcagcaatgggacaatggttccagtactgggacaggccttgccctagttctttcttgagggtgtaaaaatgaaatatgtgagatggacaattgacttgaatgtgagaggattttctctagtcttctgtggcctcatttttaatttgagcaggagctctcatttaatcttttactttcatgctcacagttactatggtgatcttggcttggtcatttatttggtcccctaactcagtaccttagtttggcagaaagtggtagcagaggaaggtgggtggcatgtgagggcatgtctgtgtcctggataacctgtctgtcactggtttagactttcacaccataccggacagcgtggcgccccatagtcaccgccacccacatcgggtcccacatccgagtaggtggagtattgacttggttgccttttcccccttgctttggagtgcctttcacttctttctcagtggtggggtcacagttttgccaacagtggtggaagtgaattgtgtgagcatgtattcctctgctgctttctcctttcaagtaaaacatccacacttgtttctaagagaatccacccatgttgactgtcacatggttttcaggttttcattttgctaggagtgacatctcaatcatgggtggatcccagacttcttttctgttagtgtttaaaccgctttgtttgttttacttatgtctgtcagtgttgtacagaaactcccagtatcttgggtaggcataatcaaggcattgaggttggattggaataccagaatgcatcatctaagcttgaattgattactaatttcctccaattcttgataagtccttactgggcctgtgttatgagaacccaaagatgctgggaagtgaatacgtttgaccctgtggctgccacttgggtgaagtttggaataaacctcacttgagatgtaccacaaactgtcttttcacagaaggtccaaagttttttctatcagggatcctttttgatagctgatgacttttcaggaccccatcttttctacttttttatttttcccgagatggattcttgttctgttgcccaaagctggagttcaatggcacaatcttggctcactgcaacctccacctcccaggttcaagcaattctcctgcctcagcctcccgagtagctgggattacaggtgtgtgccaccatgcccggctaatttatgtatttttagtagagacgggtttcaccatgttggccaggctggtctcgaactcccgacctcctgatctgcccacctcagccttccaaagtgctgggattacaggagtgagccactgcgcccagcccttttctactttttttttgagacggagtctcgctctgtcgcccagactgaagcacagtggcacaatcatggctcactgcaagctccaactccctggggtcaagtgattctcctgcctcagccttctgagtagctgggattacaggtgtgcgcccccatacccggctcatttttgtacttttagtagagatggggtttcaccatgctggccagactggtcttgaactcctgacctcgtgctctgcccgcctcggcctcccaaagtgctggaattacaggcatgagccgctgcacccagcctcccctttactacttttccaccaagattttcctgttgtgcctcatagtttttacattgatgatgcctataagacctcttcttttgtttttttccctttatctccatgaatttggaatacatccttcagtaatttcagctcagtttacacattaattcctcatttttcctttcccagtagtcttctggattaggaattccactctaataatttaataataattaatagtatcaattgtgtacctattattatataatactaaaatatataactatacaatataaatatatcataaatataattataaatgaaatataaagatattattaataatataaatgataatgattttcctgatgtaaactagagtaaatctacctgtgaaagaactagagtagatctacctacttgtaacttgaagaccaccaaaaaaccactgtgaactgtggacttttccctactgccagttaaatttactatttcctctcagtttagggattatcttttaaaaatatttttattcagcgctccataaggtctctaacttgtctaaactctatggaagagccagatcccacagagccagttgtgatctgattaaaactctgatttgaaactttcagacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggcacgttttgggaagaagggtttgctaagctttactcaaagaaaagggaagagactcctctgtgatctgtagtgagacccagtgttagcacagatacggccattttaagtaaaagggtggaagtggggttgctgtctctccagctgctctctaggtgtatgtgctattctgtaactctgaagcctggagtcgctgagacagaaatgccgtgaactcaacctcttaactttctgtgggaggaactaaaatcacaaaccacagacaaaactgtatccattaaagctaacatggctccgtccctaatgtgtctgtttgatgtttctggaagccattgttaacaaatgttggttggtgactctggctctcttatggtccctgaataggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggtaaatagcaaagtgctgtatgcttctcacaacattattatgttaactttttagtatattcaggataaaattttgatgattggtcccctaatttctgagtgagcaagtttttgtaagcatgtctgagagttttgtttagatgtgaggcacaatactgattactcctaaattggaaaatgcttttcaatgtgttgccttgggcaggaagggcagagttcatttgatctgtttcctctacccacttttgggtagggctgggtgaagcttttattggactgctgaagctaggtctcagggtttctcagacgagggtgtggtggtgaatgctaagttagtattggcagatgtccaccaatgcattagggctcttgccttccttttttatttgaagcttccctgggctctcttgggagcctgggagaaccttgtcgtgaataggctctccactctggcgctggagcccattaagagggaatgacaacccttccccagtgcccacgtgtacaatcctgtaagctgcttccactacgagtccaaagggttccaaagacatcaagtactcggaaccagagagtttttacttttagggaaatttgatttggggggtacaaattttaagtgtataaatctgcttataggctggtacttgtttccattttctggccagtgattaagagaaagatacccggcattcctcagaaatatctcacccttccacagtgacagatgtgttgcttttccaaaccctaagctttcctgcggttgagcttgagaaaagtagtcaggccaaacccatggtatcccagatggattcaagaaccctgaaatgcttcattttattactttgtatcatattttttaaaacaccaaaatgtggttggtagggaaggatacttttaaagaaatgtctctaagcttgatgcagtggcacctgcctatagacccagctactctactcagactcaggctgacaagacaggatcacttgagaccagcctgggtaacatagcaagaccctgtctcaaaaaagaaaaaaagaaatgtcgtcagtctaaagccagggacaaactcttgagccccgaaaattatgtttatgtgcaagaatgcttaacagcctcatgaacatctgaaataccaaattttcaagcagttagggtagatgagtacattgataaagttaccacacagttgttgccaaactatttattaacataaaggtttttggcacttttgcacataaccaccttatagactaaccacactactccaaaagatagagaatggctctcccctttttacataagaaatagaaactctttggagttgtagttcactttgtatcatgttgaccattatttcttgtgattctcttcagagtggtgatttgctgagatgcttcaaggaaccaaccccagggtaactagttggaggagccagaagttgtgtacaaatccagtctcttctcttccttgtttaggagcagcaccctgaggaggaactgatcaagactaagcaggatgaagtcaatgcagcctggcagcggctgaagggcctggctctgcagaggcaggggaagctctttggggcagcagaagttcagcgctttaacaggtgtcaagccagagtgggctttggggaatgggtctcaacctggaggggagttgtgaagcacagggcatgtgctggtgagctgtcgaggctgactaggccttggtcccatggggtgttcctagttctagggagtcatcattgctgtggattaactggtgcctttgttctgtagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtgggttttacaagcagctgattctgtaaataagttaccaagggtcaggagaatagttctgacggagttcatttctaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggtgcaaataatgctccaggtcttaaccagtatcatttggcttcttttttggaagcaggaatagcagagttaagggtctgttctgtgttctgtgaaagtgtcaggtatcacctacaaatgcaaatcacttcttacctatgttctctctgtttggagactggcaactgtatcatgtgtagtatacgtatggtatttacaacttcataaattcttctattctgcatcactgcattatgattgatagaatgggaatgtccctttaagtatctgagtatcacatgaaatatcttattaaaaccaggattagaaaggaaaagaatccttgctagccaagggttgaacctgggaataacaaggaagttgaaaatgtgggacaggattggggcattatagtgatggagagaacctaagttttaaagggttgatttcagccttctcttgctttccttcacagtctagattgggaaattttcatatttcccagaattagaatttatatagtttgttagacatttgagaacatagaattcagagctttagggaggccattttccaccctggaacctccgctggaaacataatgtcttcctttggttttccctaggcttcaacgcttccttgctgacttccgtgacctcaccagctgggtgactgagatgaaagccctcatcaatgcagatgagcttgccagtgatgtggctggggctgaagccctgctagatagacaccaagagcacaaggtaatggtatctctagaatcttccagaagtgaagattttagcttataatgcaccagtttatcagtgttgggtgaggcctatagtcggcgttggtaccatgttattcacaggtgtttctcatcatgaggattatggttggttttgcctttggagacctggtctacctgcttctgatagaggcttaactgggttcagtgtcaagaggttcactgtggtccataaaagcaaacagacaagctctggcgagatagaagtgctactacttggcacattgatcctttgtgatgtaaaaagtatttgttgggccaggcacggtggcttatgtctgtaatcccagcactttggaaggctgaggcgggtggatcatgaggtcaagagatcaagaccatccatgccaacatggtgaaaccccatctctactaaaaatgcaacagttagctggtcatggtggcacgcgcctgtagtcccagctattcaggagtctgaggcaggagaatcgcttgaacccgggaggcagaggttgcagtgagccaagatcacaccattccactcccgtccggacaacaagagtgtttcactctgtctcaaagaaaaaaaaaaaaaaaaaaaccttctgagaggttttaatgtgctagatacaaaatcaatatactgaaagtcaaacatgtttctctacactagcaacagaaacataatttttaaaaatactacttattagagcagaaaatataaagtacttaggaataagtctaacaaaagagtgtaagacacttctggagaaaactataaaactttgttaaaaggcattaaataaaaactgaatagatagaatgatttatctagtacacagatggaacgatcttctgtgaaggtgtaaattcccaccaggatatataccgttaatgcagttccagtcaagtgctcagcaggtatatgtgtgtgtttctttttgcaatgagataagctgattccaaaactgatttggaagaaaaaaattcaaaaaaagctgagacaatgttgaagatcataatggggccagggagggactcgccctaccaggttctataaaatcatagtaaacaagtccatttggcacaaagaagacagagccctggaatgaaagagagctcagacccatgtgaatgtgtggaaccttgacaaatgacaggtgacctgaaaagccatttggaaaggatttcatcagtgagtgatactctcacatttgatgacctagactgattatgtattaggaaatctggcctaatctttcattttgtttctcattttagatgtcatagtctggcttataatgcttatgtaaaattcagcaccttgtttttattttgtaagatgctgggcacaaatcatggctttgtttttttctcctgtagggtgaaattgatgcccatgaagacagcttcaaatctgcagatgaatctggacaggcactgcttgctgctggtcactatgcctcagatgaagtgagggagaaggtaagagaagagaaatggagcttttgaggagcaaattacacctttcactaagtctctgaaagctattattcatccttaaatatccagagaacgcattcaccatgatatgtgagaaactttcctttctctgcagaggtttaaaaagaaggtatatgtatagtgtgctgatttcctgagagacagtcctccttatctggggcatgtgtggcatgtttcctacttacagggactttctgtagggagctgagtcttgcattaggagttggagcaaagaggaaacaaatttttataaaatgatacataggccaggtgtggtgtgaccccagcactttcagaggccaaggcaggaggattgcttgaggccaggaatgggagaccatcctgaacaacatagtgagacccccatctggacaaaaaattaataaattagccagacatggtggcacattcctatagtccgagctacttgagttcaaggttataatgagttatgatttgcaccactgcactctggcttgagtgacagagtgagaccctgtctctaaaaaaaaataaataaataaaaataaaatatgtatatatatacatattttattttactttttttatatgtgtatatatatacacatatgtatataagttttgaagtatcttcgagtataaaattgcctaggaacattagataaataatgatttatatgatttatatgttttttagtattacatagagtaaagacatttcaaagacttgtcattagtagcttcggagcctaaagtctagggagtttctgaatttattttccatatgttatggagcacccactcagttgacatttcttagtggagagtccctactccatttatactccattaaactccatttatactgcctcacttttaaatggatgccctatttcttctacctgggagtttacttactgtttttacctaaagtcatttgtgatcatttggcaataaattaattctagattaattaaaacaggccatcccttttatattgaacatgcacatacaagtgaatgttgtttttccccttttgcaaatcggaaaaaaggcctgaagattagcactaggattaggaattccaggatagctgttctgtctgcctcggaggcattggggctgacctcatctccctgaccatgtctcctatgcccccaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggtaatctgtgagcaaagccttgccagtggtgggagaagaagggcctgtgttttgcctcctcgggtagtgtgcttgttttgttttaggacatcagtaccatgttagttctgaatccattgaagagggggaattgagcaagcttctctcagctctgccagcatctctccctgctgagattgcaaggccttcagaaaaggccccagcttttcagattagtgtgatgtaaaatgttttattaaagagatttttttcttagaacttagcattgctgggtgcagtggctccctgctgtaatcccagcactttgggaggctgagatgggagtatcccttgagcccaggagctcaaggctgcagcaagctatgatcgtaccaccgcactctagcctgtgcaacagaccgagatcctgtctcacaaaaaaaaaaaaaacaaacaaaaaaaacaaaccttagcattatgtaacatctgaatctaatagaagcaacaaaaactatgtaagagaagtttcaatagaatgtggaataggatttcatgatatggctggattgattttaagaaaatccaaaaggactttagacttcctagaagagatcttagaagtttagcagccataaaatctctttccttctttttatattttggccaaaataccctttgcttcacagtcttagaagatcaaaggaataggacattattctgaacactttgtttcctttggcaaggcgttcctgttgaatgaagacttgggagattccttggatagtgtggaagcgcttcttaagaagcacgaagactttgagaaatcccttagtgcccaggaggaaaagattacagtaagaccccttcttgtcagtgctttcaaatgacccttatagtaagccagagtctttttccctggaaggattccaaacagatttgatgaaagattcatatgcagagtactcctgtgggtgcttaaactttcacaaggatgacatgctatctcgttgaagacataatacaactttatggaaaaatgatttacttaatggaaacctccaaacttctttaagtttgtacccttcattaaaagtaggtcagggttaatattaagaggtactcttcccattgaaaatacatcttagaaataagaatttggaaagctgttaacctgtgtttgacccctgccaggagatcgtgccacaactaatgtctccagtcttgaatggaggtagtgcagtcttatgatatctgactggtgacatcaagcaaaatctcaaaagttatgagaaaaaatgtcatcaccaacctttgggtgaaaaccttgacctatgttaaagtttggtgtgttttatgatctgttcagcagttacttttctccagaggccaagcttgggactagtgtgcttaccaatgaagaactcttatcttccttcctaggcattagatgaatttgcaaccaagctaattcagaacaaccactatgcaatggaagatgtggccactcgccgagatgctgtaagtttgtaggttcttcatgctcctcctttttggtacatgaatgtctcttctaagatgttccagttaagtctcttcaactggatatccctttgggagtgaacactagagactcacaggggatccttgtctttcagctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagtaatgtactgttagtgttgccatgtagcactcgattagtaagctaaacacagctctcacaaataaattgtagctaaaggacgaaataagggattccagaaaccccactacttaatgtaagccaactgttttatacattcctccataaagataagtatgaaggtagtgcaagggaacttgacgttctcaggttcaagatagaaagaacccccttcttttattcacaggatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggtaagagatgttccattgaattgtgacatgcatgtttggggaactaaatacccctttctattaagtattttagggacatataccccccaagaaaggtgaggtggatgactttggcgttagggataatttcctgtgtaggaattacttggcttaagttcttgataataatttggtaaatgtggtcgagcatactggttggtgagggagtctgagtgagaaggaactgaattgggcctcattgctgaaaatcaaagttcagctgagagccaagggcatttactaattctccagtgtccttatatctcaagggggttagaatgcttccagttcaaccttgagaaggtagagcagaggctgcaattgatattttctttctctttgtgacataagtgaaggaataaaattctgacctgtatagtccttcactaagatactactgttcatgggcagtgttggcagaagggtaatgctaagcagtacaaaattaaacttgttttcttccataggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggtagtgtgaactgggggctgtggttgggcaagtgaatgcagaaactataggagggaggaaaagccagtaatttgagactaaatgaattttgggagggatgaaatgtgttgattttcttagatcgctctgtgctgcatgtgcttctgctcaaattaaatatcatcccttagagctttctaggagccccagatgaaggaaggagatagcagaaagaatcctctcaggaatggaaaaaagaccttatcaatttttctctgtatacgataaaaccacacccaaagtaaagtctgctctgtccttttgcattcccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtcagtctgcttccctcaggtaggaatcaacttgggaaaggctgtgctattgtagcataaaggggatgcatgtcaggatgggcagggtcgaatttaaattattgaactggaaccatggtggtagctaagaatgacaaatcagtgctgacttttctcttcatggttggataactggggactggtgtctgctttcaggtaaggatttaattggggtccagaatctgctaaagaaacatcaagccttacaagcagaaattgctggacatgaaccacgcatcaaagcagttacacagaaggggaatgccatggtggaggaaggtgagtgattggtatcagtgacatggcttggtgctgctcctcgtgtctccccttcttgccgagggcatggccacgtgggcatcacaaaccaggctctggggctgaataccatccccattctttcctaactgtatgacctgaccagaccttaccctttctgagcctgaatttctttttttttttttttttgagacggggtctcactctgtcacccagggtggagtgcagtggcgcggtctcagctcagtggaacctctgcttccctagttcaagcagttctcctgtctcagcctcccaagtagctgggactacagggacacaccaccatacccagctaatttttgtatttttatttttgtatttttaatagagacagggtttcaccatattggtcaggctggtcttgaactcctgacctcaggtgatccacctacctcggcctcccaaagtgctgggattacagccatgagccaccgcgcctggctccgagcctgaatttcttatctgtgaaacggggatgacagcacctctcctgacactgtagtggggagtaagtgaaaccaagtaggaaaagagctgatagagtgcctgcacgtgccagtctcagtaactgagcgctacagtggtactgttactagtctttatgatactatcactaatgccaacttgcgatatctgcttcttagagtctagatagaggtcatggtttgaggaggcaaaaaatgaaacagtccattagagggttagaacctgagcctctcaaaaaaaatggaattatgaaagggcacagctcaccaaaacatagtaatgaaagtgccgtgaacacacagagaaaacttatttttgtccttctgtgatgtgtcaacgtagtttttgttatcctctttccctacccatcttccaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggtaaccaggcgtgggaagcgtctcacctgccagggaagtggaacagggcttgtactgagaaggaagttaggagaagtagtgatgcgcgggaggtgtgcattacagtgattgttttttaaaatgttttggaatccatttttcacttggtttttttttttttttttttttttttggagacagagtctcactcttgcccaggctggactgcaatgttacaattgtggctcactgcagcctcaaactcctgggctcaagcgatcctcctgcctcagcctcccaagtagttggaactataggcaggtaccactacctgcctagctacgctttttaattttaattttatttttagtagagacagggtctcgctatgttgtcccatctggtttcaaactcctggcctcaaacaatcctcctgccaaagcctcccaaaatgctaggatgataggaatgaaccaccccttctggcccatttttcactttttattatgaaaatgtaatcatacctaaaggagagagaagatgacttctcactcaccttcaaccgttaacatttgtcactcttgtttcatctatgtgaaaccatatgtgtgcttacatacatactaacataccaacatgcacacatacatatatacatacctacaaacataccagcatacacatgtacataccagtgcgcacatatacccacataccaacatgcacacatacatacatagatgtacttggttttttactggttatctgttttttgactaaaattctcaaattttattcataaaggtctaggtatagttcctgtacctagctcttaccactcttcacaaaaactagaatgagttgaatttttccttttctttttttttttctgagacagagtctcactctgtcatccaggttggagtgcagtggcatgatctcggataactgcaacctccacctcctgggttcaagcgattcttctgccttggcctcctaagtagctgggattacaggcgcccgccaccacgcccagctaactttttttgtatttttaggagagatggggtttcaccacattggccagtttggtcttgaactcctgacctcaagtgatctgcctgcctcagcctcgcaaagtcctgggattacaggcgtgaggcaccgcgctcgttctgtcgctagggctggagtacagtgatgcaatcacgactccctacagctttgacctcctgtgctcagcagtcttcctgcctcagtcccctgagtagcttggactacaggcacgcaccatcacatctggctaatttttgtattttctgtagagatgaggtttcagtatgttgcccaggctggtcttgaactcctgggctcaagctgtctgcctgcctcagcctcccaaagtgctgggattacaggcataagcctctgtgcctagaccaggatgagtaagctataatcataatatatatgattgtcccaaaagatgagaatcctgaaaaactttgaaaatgatattagcactgtaagaagggcaggaggtgattacgtcattgtgcaactgagaaaggctgttgaggcaggatggcaggttggcgaggcagtggaggatgggaggcttcagcccctgcacagtgctccatgtgtggttttggtttcaggctctactgaagaaacacgaagctttgatgtcagatctcagtgcctacggcagcagcatccaggctttgcgagaacaagcacagtcctgccgggtaaacttgtaacagtttatgggttactggagggaggccttgaaggactcagatactgtcagcaggtgttcctatcataggccccatttgactctgctattaactcttgtgacacaaagatttacagagtttaaaataagatttatttatttatttatttatttagagacagagtctcactccgtcgcctaggctggagtgcagtggcacaacctcggctcactgcaacctccgcctcctgggttcaagcgattttcctgactcagcctcctgagtaggtgggattacaggtgttcaccaccatgcccagctaaattttttttttttttttgagatggagtcttgctagagtgcagtggcactatcttggctcactgcaacctctgcctcccaggttgaagcaattaccctgcctcagcctcctgagtagctgggattactggcgcccgccaccacgcccagctaatttttgtatttttagtagagatggggtttcactatgttggccgggctggtcttgaattcctgacctcatgatctgcccgccttggcctcccaaagtgctgggattataggtatgagcactgtgcccggccctactttaaaatgagattttttttttttttttttgagatggagtttcactcttgttgcccaggttgaagtgcattggcctgatcttggctcaccgcaacctccgcctcccaggttcaagtgattctcctgactcatcctcccgagtagctgggattacaggcacgcaccaccacgcctgtctagttttgtatttttagtagagatggggtttctccatgttggtcaggctggtctcgaacccccgacctcaggtgatctgcctgcctcagcctcccaaagtgctgagattacacgtatgagccaccgtgcccagacaaaatgagattttttttttaaagataccaaaaatttaaagttcttggatcagattttattggtagcttcagtgaagaattctcatgagtgtatatttggtacatttggtacagctggtggcatttgaatctgctctgtacttagatgactcagcgcggacgtgtttttaccatgtttgcccttcctttggatttttagcaacaagtggcccccacggatgatgagactgggaaggagctggtcttggctctctacgactatcaggagaagagtccccgagaggtcaccatgaagaagggagatatccttaccttactcaacagcaccaacaaggcaaggcacagagagtggctgtgtgtttgttccacgctggcacctccacgtatgctcagttgggtttctgtgggttgcatgtctccctgaaatgagaaggcttagaattcaaagacatgagtttcctcaccaatcccccacgtgacatacatttatgcagtactgtgtatgaccaagaagttaatctgtcttcttgaatacctgcaagaagcatagataatcacactcagaaggatagcttattttcaccattgagtgtctctaggtggaatttttgtcctgtcaagccaaagtttgctttctgtataacttggacctgttggttctttttttttctttttcttttcttttttttttttttttgagacagagtctcgctctgtcacccaggctagagtgcagtggcacgatttcagctcactgcaagctccgcctcctgcgttcaccccattctcctgcctcagcctcccgagtagctgggactacaggcgcccaccactgcacctggctaattttttgtatttttagtagagatggggtttcaccgtggtctctatctcctgacctcgtgatccacccacctcagcctcccaaagtgctgggattacaggcatgagccgccgtgcccggccttttttttttttttttttgagacaatgtcttgctctgtcgtccaggttgcagtgcagtggcatgatctcagctcactacaagctccacctcccaggttcacgccattctcctgcctcagcctcccgagcagctgggactacaggtgcctgccaccacgcccggctaattttttgtatttttagtagagacggggtttcaccgtgttagccaggatggtctcgatctcctgacctcgtgatccacccgcctcagcctcccaaagtgctgagattacaggcatgagccaccgcgcctggccgacctgttggttcttactccagactacaagctacatctcagcccagcagatcattgaagacagctgtgacctcaccccacaggctttgtcttctttaggctaaataatgacaataataaatccatcctggtccaccagcctttcttccctaacacactctgaattgacagtggtgttgaagcatgcacagattgactgatcctgaaagaggcctgccttctgttttagttaaggctggagaaatgtccttggccatttttaagagcaagtttattcccattcccacaccttatttatccttgtcatgataatttgaggaaacctgtgattcttatctttctattgagtctaatttaaacctaaaccaacttgtggtctaactttggtttattcaagagcagcattgcccagtagaactttctgtgatggtggaaatgtaagtgtctgtgctgcttctgcagtaactactagctacgtgtgatagtaagcccttaaaatatggctagtacaactgggtgttttatttaattaaattataactcgatgaagccgggcatggtggctcacgcctgtagtcccagcactttgggaggccgagacaggaggatcgcttgagcccaggagttcgagaccaacctggggcacatagcgagacctcatctctatttatattaaaaaagaaaaaaaaaaaaaagggccaggcgtggtggttcacgcctataatatcagcgctttgggaggctgaggtgggtggatcatgtggtcaggagattgagaccatcctggccaacatggtgaaaccccgtctctactaaaatacaaaaaaattagctgtgcgtggtggcgtgcacctgtagtcccagctacttgggaggctgaggcaggggaatcacttaaacccaggaggcagaggttgcaatgagccaagatcgtgccactgcactccagcctggcaacagagcaagactctgtctccaataaaaaagagttctaactcaatgaaagttaagtgggcacatgtgactggtggctacagtgttagcacagctctggagcatctaagcagagagaaggccagccttggtggcaggcggcattgctcttctgcctgtgaccctctgcaggtatggcaggtgaggaagggactgaattatcagaccttatagaaagtgattttaatatcattttggaccttttttttttatgagacagagtctcgctctgacgcccaggctggagtgcagtggcgcaatctcagctcactgcaagctctgcctcctgggttcatgccattctcctgcatcagcctcccgagtagctggggctacaggtgcccaccaccatgtccagctaattttttttgtatcttttttagtagagacggggtttcactgtgttggccaggatggtctccatctcctgacctcgtaatccacccgcctcggtctcccaaagtgctgggattataggtgtgagccactgtggccggccgttttggacctcttaaaacaacgctctcgtgtgtgtgtatacacgtgacctccttggattctccctctcagagaaggaatttactttcagttctccctcttttttccttaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagtaaggatgacactgggggccgcaagggctaggcgtcccataggcatactctgttccacatgggccgaagcttaggcgtgtcctgaggctcctggagcccacctgcacgcctcctgctgtctccaccccactttgagcccacagacctccctgtgtgggtctcagacccctgactgatgacttatattgctttgttttttttccaccagtgttcatgagtttttcctaaccagaatttttctaatcattgccatttgccttttggttcgagatgctttttgaaattggattttcagatactctacgcccctacagctctgtccactttgaaaagctgctttcagagcttctctgtctgccatagctttgagttctgagaatggaattttgtaatgaaatggctctgtcctctttcctctagctgagcccccatattgccctgtgtccctcctttagggtatttctgactccactagtggaatcagcagttttggacacttgggaaatatccaggaaatacattcccactagagtttgggtagaatagtgaaatttttgggctccagtgatcctcagtaagatcagagttatttgtccactttatagattctgttactatagagataagaatgggaggttttggtttgtgttctttttttttttttttgagacagattctcgctctgtcatccagactggagtgcagtggtgtgatcttggcttactgcaacctctgcctcctgggttcaagtgattctcctgcctcagcctcccaagtagctgggactgctggcacatgccaccatgcccagctaatttttgtatttttagtagagatggggtttcactgtgttggccaggctggtctcaaactcctgacctcgtgatccgcccgccttggcctcccagagtgctgggattacaggcgtgagccaccacgcctggccttggtttgtattcttaccagtagtctgggtcataaatataagaggaaaaagatcaaatacgtggctaaattgcctgttagcactcagtaaaatttctttctaagggtagtccagtctgttccctgaccttgctctgtgaagttaccagtgttttcagcacaggaaaatctgccttaagcatggcagacccgccaggaaaatgaaggtgaactaaccctctaattttcctgctatttctttactgtcatgtcactcatgacttagactgctccttagacctgttgaataactccatagtttcccaacattaagcatccaccatcatggcaccagtcggagctgctgcctttcatccctgtggattaaccccactaattcgtgcatgcttttgctgtgccccctctgtgcaggacacgcataactaaggaggccggcagtgtatctctgcgtatgaagcaggtggaagaactgtgagtaggctgagagtcttgcagagcaccaatgtccactgctaccctatccattctccctctgccgcttctcttgaaggcctttgtccatccagaaagatgaggtggtgggaggaactgcctgtccgtgcagcagctttggctcacaagggaagaggtcgcggtgcagctgtgtcggtcgatgactgcttatctcattggttgcttccatgtgcagctgtgtgttcagagtggtgttggttctccctcctgttggtttttgtggtggaccagccactatcagcagcaaacctgaaggcctgttctatagttttccttagtaggaaggaaatcatatgcttctcttaaagtgctctgattcttggtaactcattgcttttttattttactttgggacacttagatttgatgatgattctagttttttttaatttttagttttttattgtttgttgttttcgtgttcaaagataatatttcagccttttgtattttagttcccgagggttagaatattctttgattcttaagaaatctttcaagtaacagaatggcacagatactcagtactgtgcctgattttccttctgaacttgccaaaactttctgagagctgaatgtatcattttagaaatgtcctactaatatggagataaaacatcctatatgaggatattttaaagctcagtgtaccctcccccacctcaccccagcctgggggctcttcagagaattataaaagacagaaaaaccctctgtatacattctgcccagcaagttcatctcgtctctccactgtagttgcatgagccctgtgttactgtgctaagcgcttggtttcagtcccttgtggttgtgttgttctaagtgcagaatcggcctggggataagtgtgcctggctgttctagccacctggttgtgaacagtacagtgtgcgcatatctctcaggctgtggcgtgggtacttgggatcctcgtcttcatctgataactctgttactagggcatcatcattacaaactcgtagcctggaatccacatcttggagacacctcgtggtttgcctttatgttagcatctacagctaactgccttccttgtccctcttgtcaccctcttgaattccatcagatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggtatgggcagtcttcaggctcagctgaaaatttgtttaaagatttgagtctcttgatttttttttttttttttttttgagatggattctcactgtcatccaagctggagtgcagtggtatgacttcggctcactgcaacctctgcctcctgggttcaagtggttctcctgcctcagcatcctgagttgctgggattacagatgtgcgtcaccacgccctgctaatttttgtattttttggtagagacaggttttcaccatgttggccagactggtctcaaactcctgacctcaggtgatccacccgcctcaggctcccaaagtactgggattataggcatgagcttctgcgcctggccagagtctcttgatttctgactgcaaattactggaatgcaaattacatagattatattccatcatgtatgtagctttttttttttttttttttcaatttttttttttttccttttgagacagagtctctcttttgtcgcccaggctggagtgcaatggtgcgatctcggctcactgcaactcctcctcccaggttcaagcagttctgtctcagcctcccgagtagctcaccaccacgcctggctagtttttgtatttttagtagagatgaggtttcaccatattggtcaggctggtctcaaactgctgacctcaggtgatccgcctgcctcagcctcccaaagtactgggataacaggcgtaagccaccgtgcccggcctcagttttttttttgttcaagacagagtctcactctatcacccaggctagagtacagtggctcgatctcagctcactgcaacttctgcctcccaggctcaagtgattctcatgcctcagccacccgagtagctgggattacaggtacgcacgaccacatctggcaaatttttgtatttttagtacaaccgggattttgccatgttggccagcctggtcttgaactcctggcctcaagtgatctgcccacctcagcttcccaaggtgctgggattacaggcatgagctaccatgcctggcctgtgtagctatttttaaaagactttaattgaaacctttttggacaaatttagttttaaggaaagatatgctatgttctctacatgttgttataagaacttttctaagcctaaactacaatagatgtgaaagtactcttttttttttaattggggtaaattcacaaagctagccattttaaactgtacaattcagtggtatttagtacattcacagtgttgtgcaaccaccacctctagttccgaaacatttgtgtcacttcagaagaaaaccacatatccgtcaagcattcatttgccattctccctaaccccagtggcccacgcagccactcatctgctgcttgcctccagatttacctattctggacatttatataaatggaatcacgttatgtcactttttgtgactggcttcttttgtttaggttttctttcttttatttatttattttttgagacaaggtgttctgttgcccaggctggagtgcagtggcccagtctcggcttactgcagcctccgcttcctgggctcaagtgatcctcctgcctcagcctcctgagtagctgggattataggtatgcaccactatgctcagctaatttttgtattttttgtagagacaaggttttgccatgttgcccagtctggtctcaaactcctgagctcaggccgtctgcccagcttgccctcccaaagtgctgggattacaggtgtgagccaccgcacccggcccataatgttttccaggttcatcctttttgtagcacataccagtactccattcctttttattgctgaataatatttcactgtttgatacactacacattgtttttgggtttttttgttttgttcgttttttttgtttgtttgtttgtttttcgagacagagtctctctctgttgcccaggctggagtgcagtggcgcaatctcggctcactgcaacctccacctcccaggttcacgccattctcctgcctcagcctcccgagtagctgggactacaggcacccgccaccacgcccggctaattttttgtatttttagtagagatggggtttcaccgtgttagccaggatggtcttgatctcctgacctcgtgatccacccgcctcggtctcccaaagtgctgggattacaggcgtgagccaccacgcccggcctaatatactacacattgtttatccattccaccacttaaaaggattcttacaacaaattaaaatgaggagggagaacttatttctcctatagtaactgtgcattaaaattttatctcgtttttatttattttttagagatagggtctcactctctcacacagggtagagggcagtggatgatcatagctcactgtaacctcaaactcctgtgctcaagtgatcctcccacctcagccacccgagtggctgggactatgcacataggctaccacatccattattataattgaaaaaatttttctggccgggcccagtggcgcatgcctgtaatcccagcactttgggaggccgaggcaggcagatcacctaaggtcaggagttcgagactagcctggccaacatggcaaaaccccatctctgctgaaaatacaaaaattagctgggcgtggtagcgcctgcctgtagacccagctactcggtacactgaggcatgaagatcgcttgaacccgggaggcggaggttgcagtgagccatgatcacgccactgcactccagtctgggcaatagagtgagactgagtctcattagagaaaaaaaagaaaaaaaatttttctgtagagataggggtctggttatgttgccctaagctggtcttgaacttaagcaatcctcctgctttggcctcccatagtcctgggattaaaggtgtgagccaccacacctggcctcatcacatttttaaaacattattttaaaaccaaaaagaggttttaaaaaagtctctatttgataaaattatttgctgggcatagtggtgtgtgcctatagtccaagctactcagaagattgaggtaggaggattgcttgagcctgggaggtagagactgcagtgatccatgattgtaatactccactccagcgtgggtgacagtgagaccccgtctccaaaaaagacaaaaaactacagttaatgaagtaaatttgagtccaataattatctgaggactgggaaaaccaatccatagggatacctgttgaacagatccttatagctttttttgtttgttttgttttgtttttgttttgttttgagacagagtcttgctctgttgcccaggatggagtgcagtggcacgattttggctcactgtaacctctgccgcaccccggttcaagcgattctcctgcctcaacctcccgaacagctgggattacaggcgcctgccaccgcgcctagctaatttttgtatttttagtagagacggggtttcaccatattggcccggctggtcttggactcctgacctcgtgatccacccatctcggcctcccaaagtgctgggattacaggcgtgagccaccgcacccggcctgttttgttttgtttttgagatggagtttcgctcttgttgcacaggctggagtgcaatggcgcaatctcagctcaccgcaacctctgcctaccgggttcaagcgattctcctgcctcagcctcccgagtagctgggattacaggcatggacccccacacccagctaattttgtattttcagtagggacagggtttctccatgttggttaggttggtctcgaactcccgacctcaggtgatccgcccacttgggcctcccaaagtgctgggattacaggcgtgagccaccatgcccccagccatagcttatttttttaatcccccccttttttttttttggtaggcctctgtagaagaatccttatagtttcaagccatagtttgtgactatgtctcctttgactttggcttgctattttgggttttagttattatggcttttgctttaaaggacctgaaggccaatgagtcacggttgaaggacattaacaaggtagctgaagacctggagtctgaaggtctcatggcagaggaggtgcaggctgtgcaacaacaggtaggtgtctccatcttggagtgaggctctgttgctgtaaggatgcagctttgttcctcttgtgtctgtcatagcccaacaagcagtgtttcataacacagaactgtggcttggctgtaggtcaggtcctctatgtgaccaaaaccattttgattaacttctttatacccatatccctcactttcacttggtttggaggggggtgggggcttctgtcttctccgtaagctcattaaatatttaatgtttatatagccattaactaatggtaatttcataagttcctcaaagaaaaagtttatatataaatacttgaagctctgctggacatttggactggcatttccatttgtccttttggaattatctcctgtgtttccaggtttggccataataagtattcttgagagatgtgtatttcttctaataataaaactggtttctctctctccttgtaggaagtgtatggcatgatgcccagggtaagtttcgggtgctgtgtgtggatcttgaacatgagaaggacttaaatcttgggaagaatatcaagccaagaacttcttcatcagaattgctgttcctgaacctcagatgccttttgtgtgtaaagatttgtggaaaactccaaaaattgatttctttttttttgagacggagtctcactctgtcaaccaggctggagtgcagtggtgtgatcttggctcactgcaacctccacctcccaggttcaagcgattctcccatctcagcttcctgagtagctggaattccacgcatgtggcaccacacccagctaatttttgtatttttagtagagatggggtttcaccatgttgtccaggctggtctcgaactcccaacctcaggtgatctgcccacctcagcttcccagagtgctgggattacagacgtgagccaccatgcccagcccagaaattgatttctatttgccattctccaaaagacaaaaaaagttggtttttttttttttcggtcttttgtttgtttgtttgttttttaagagatagggtcttgctttgttgcccagactggaggtcagtggcttttcacagctgcagttatagcctactgcagcctcgaactcttggcctcaagcaatcctcccacctcagcctcccaggtatctaggacaacaggcatgcaacacaaagcacagctctaaaaaaaaaaaaaaaaaaaaagtcttctgtctcttcagttttctaaaactttttctatagctatctttaggttcatttattacccctttgcagacaatcttatgagtacaacataaaagttggtggttttcttattaaatttctttattctctccatttcttctactggataaaaaaattggaatttttctctcccctgtttgttggcttaatttttcttaaccagccttgtagtttgttaccagccaaactatggagggaaaatgctgttttggttaatgtattagtatctgggatctcccctgggggaaactagagtcattcgctggaaaggccaggtgctttgtttcatggtcaattgcttggctgcctaaattcctctttctttgaataggatgaaactgattccaagacagcctccccgtggaaggtaagaactcctttgcaaattattgttttcaagagttttgcgagatcatgaaatatgtccttttctggtgtgcctttctctgaatattcagcttaagtctttagtcatttctggacttgtttgggctggtttctttctgaatctgttaactctaaaatgtgatgcttaatatacaaaagcagagtgtctgtcaaatgctcagtacagttaggttgcattgattacccatgttggtgcaggatatgctgcagcagggagcactgttgttggcagggtcccaccagtaagaggcggtccaaagggaaatgatgtgaacacgagaacaactacacatgtaaaggagggcaggccttcattcaccatctgcctggcctctttatcctgtggcctaagaaaggcttcagagatgcccaatacagagatgtaaagggaggaatgagatgtttccccactacagtagacatttttctggacaaatctgggtgtgaatatggcttaaccagaatgggccatccctgaccaagaatacagggagaaggtgtgtttttttgttttgttttgttttgagatggagtattgccctgtcacccaggctggagtgcagtggcacaatctcggctcactgcaacctccgcctccccagttcgagcaattctcctgcctcagcctcccaagtagctgggactacaggcatgtgccaccatgcctggcaaatttttgtatttttagtagagacagggtttcgccatgttggccagggtggtctttaactcctgacctcaggtgatctgcctgcctcagccttccaaagtgttgggattacaggcctgagtcacagcacacagccagggagaaagtctttttttttttttttttttttttttttgagacggagtctcgctctgttgcccaggctggagtgcagtggcacgatctcagctcactgcaacctctgcttcccagattcaagcgatcctccttcctcagctcccctagtagctggggttacaggcatgcaccaccatgcctcctaatttttgtatgttcagaagagatagggtttccctgtgttagccaggctggtctcaaactcctgacctcgggtgatccacctgcctcggcctcccaaagtgttgggattactggcccggctgaggttttttatgtgatacatttataactgtgattgtgtaactggttgcctgtgtaactggttgcctgtgtctcagttctagcatcttccctcctgacccagctcttcaggaatacatcacttgagttacaggcaagttagacagcagattctgactttataaaagtagatcttttggctaggtgttgtggctcacacctgtaatcccagcattgtgggaggctgccacaggtggatgagcccaggaactggagaccagcctgggcaacatggcaaaaccccggctctacaaataaaaataaaaatgttttaaaaagaagaagaaaaaaagtaggccttctcctcattagtacagtggtgagtttgacaagcaaataaaaaacaaaaagtaaaaagaaattttaaaagtgtgtccccagaaatatgaagaaagcatgaaaagctaaaaacaaaaagcctcccctcaacaacctttccgtgtccacctttgaacccgctcagtcaccttgtctgacctctcctgaggacctaggctgagaggggtctgtgtcttgtggcctccttcccccactggctctgactattctcctcattaagtagatttctaactgggccaggcatgggtatacacctttccttctattcaactttctctccttttctcactcttcccttttcttacgtagcaaaacttggtcattgatgatatgaatgggcaacagccttaccccctcaacagaatgtttctgataacataagtattctttcagaaatttattttaggtacctttataaatcccagtacctcttattggagacagtgggtccaccttctgactcctataaacacacgggttgaaaatgtcacctagggatgccatgaggacatctgcatccaagctcagccctcctgccctcctgtttttttttttgttttttttgggttttttttgtttttttttttttgagacagagtcttgctctttcgcccaggctggagtgcagtaacgtgatctcagctcactgcaacctctgcctcctgggttcaagcaattctcccacctcagcctcccgtgtagctaggattacaggcacccgccaccatgcctggctaatttttatatttttagtagagacggggtttcgccaagttggccaggctggtattgatctcctaacctcacctgatccacccgccttggcctcccaaagtgctgggattacaggcgtgagccatcatgcccttcctcttgttctttactcaaagggttgtgagcattataacctaggccaattagagtttctttccaatgaattgggtgggctgaaagatcctaagggactttatttatttgtttttatttgtattttatttatttattttcgagtcggagtcttgctccgttgcccaggctggagtgcagtggcgcaatctcagctcactgcaacctctgcctcccaggttcaagcgattctcatgcctcagcctcccaagtagctaggattacaggctcacaccaccgtgcccagctaatttttgtatttttagtggagacggggtttcaccatgttggtcaggctggtctcaaactcctgacctcaggtgatccacccactttggtcccccaaagtgctgggattacaggcgtgagccagcatgcctagccctaagggactttaggtttttagaagtagctacgttgttgaaatgtacgttgttgaaatgtacgttgttgaaatgtacgttgttgaaagctaattcactgctttattttttccctctggtaaagccgttgcccttcaacggggatacggttaaaaagaacagcaacccagtaactataattggagatgaaagtgattattagagctcctggctgttaaacagtctcagctgccagcatttgttaaatttagggtttttttttttccggaatgttctcctgtagtatagacaagaaaatgacactaatcattagtcttttaggtatttttctgtccaactagctgctagaattgtggtttttaccattcttttttcactcttcatcagataaaattaattactcagttgagtctaattgtgcactttgggtattttcatgacattctagtacttgacacttgtactgatgtctctgttaagaatgttgacagtatccctttaaggtaatttgggttaatcacagggacctaatcaatgacacttgcagctcagatctctaattgccagacacttgattagttttgccttctgctttcctccctacctagtctgctcgtctgatggttcacaccgtggccacctttaattccatcaaggtaagaagcagtgaccagctcctctgatctcccctggttttctccactatcttccttccctgtctacagcagagctcttgttcttgtcaaccgggtgacctgtgacatatctcactctattgggtccaagcatgtcctaagtaaacatcagcacattcatggccgctgggtagcttggtggctttcctggtcaagagcctgccagttctcaacagtggagcaagccttccctctgatttccagtagggcagggagctggaaggagcacagtctcagtaatgcagtgagcggcttccttgccgcctgcagtgcgaggtcctgtggcgtgtcggctcttcccaggcctgctctggcctgagagtctgctgattgggtgttgggaggcagcagactcgctgggatttctccacgcagctgtgacttaggaagcagttgctacctgccaggccccaggctaggaggtgagagtaaggaaaagtcagctgtgtctctcctgctgcctcagagaggatgcctaggtcaggtgtttgtgggtgttgaagctgtcaagcacagctagttttggcttggctcttactggaatattgtatactaatttattcagcgaggaaggttggaaacaggaaattatatatgccctagcatctccttcaaacaaagtcattttcccaaagtctgactgggggcatgacaggagagggagtgcagtggagctgatgttttgctgtcctgcaggagctgaatgagcgctggcggtccctacagcagctggccgaggaacggagccagctcttgggcagcgcccatgaagtacagaggttccacaggtgaggggtcagccctgggctgggagagggagaaacaggtgactgctggtttcctgacagcccccaagcttgctgactgagatcctagagcaactgctggctcttactgatgtttatttgtgacatggggtgggtgctcagtaaatcctgctaagtgaattatttggctttttagagttattggtggtagccacagacaaatatacaaatgtcagctaaataaatttttttaggctgggcgtggtggctcatgcctgtaatcccagcactttgggaggccaaggcaggcagatcacctgaggtcaggagttcaagaccagcctggccaacatggggaaacccacctctactaaaaataaaaaaattagctgggcatggtggtgggcgcctgtaatcctagctacttgggaggttgaggcaggagaatcacttgaacccggtgggggcggaggttgcagtgagctgagattgtgcattgtgctccagcctgggtgacaagaatgaaactccatctcagtaaataaataaataaataaataaataaattttttttagtgtcctgtaatcaaggcagttgtacttggcatttcttaacctgaatgtgtctcgcctttagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtgagaggacccaaagtcatcttctgtctggcatttttgccccagaaagagcagagtcttctgttctgcagagcatacccccttactgcaagctcattcaccactttcttcccataggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccggtacggagccatgttcactcagacttctggaacatagagccttctttgtaggggtcatttttattgtgaaaatagtacatgctcagcagggtacaatggctcacacctataatccaagcactttggggggccaaggcaagcgaattgcttgaactcaggagccggagaccagcctgggctacatggcgaaaccctatttctattataaaattttaatttaaaaatcaaaaacggccaggcacagtggctcacgtctataaccccagcactttggtaggccaaggcgggcagatcacctgaggtcaagagttcaagaccagcctggccaacatggcgaaatgccgtctctaccaaaagtacaaaaattagccaggtgtggtggcaggcatctgtaatcccagctactcaggaggctgaggcaggagaatcgcttgaacctgggaggcggaggttgcagtgagccaagatcgtgccactgcactccagcccgggcaacaagagtgaaactccatctcaaaaaaaaaaaaaaattaaaaacagaaaaaagtagtacataatcaatgtaaaatagtcaaactactgaatgccatattgttaaaaataagtctctgcagccgggcacggtggctcacgcctgtaatcccagcactttgggaagtcaaagcaggtggatcacgaggtcaggaattcaggaccagcctggccaatatggtgaaaccccatctctactaaaaatacaaaccagccgggcgtggtggcacactggcacacacctgtaattccagctactcgggaggctgaggcaggagaatcatttgaacctggaggcggaggttgcagtgagccgagatcgcaccaccgtactctagcctgggcgatggagcaagactctgcctcaaaaaaaaaaaaaaaaaacaagtctctactttcctatccaagtatgggcatactccctctcatctccttgccatatgacattatatttttccctagacatatatatatatatattttttttttggggggggaagcgtttcgcttttgtgcccaggctggagtgcagtggtgcgatctcagctcaccgcaacctccgcctcctgggttcaagcgattctcctgcctcagcctcccaagtagctgggatcacaggcatgcaccaccaagcccggctaattttgtattttttttagtagaggcggggtttctccatgttggtcaggctggtctcgaactcctgacctcaggtgatccacccacctcggcctcccaaagtgctgggattacaggcgtgagccactgcgcctggttgtctttttcttctttttattgaggtaaaagccacgtaacatacaattaactactttaaaatgtgcaatccaatgacatttaatgtattcacggtgttgtgcagccacccctctctagttttggaacattttcattgccctagaataacattccttaactaatcaccccctcttctctcttccccacccactaggaatcctttatctgctttctatgtctatggatttgcctcttctggacatgtcatataaaaggaatcataccatatctgaccttacacactcagttttgtgcccttgtggttgtacagctgtgagaaactggatcaaatgtatgcccaggcctagggcttcaagggttaatcctaaagaaaggctttttcttttttttcttttttttttagagacagggttgcaccacattgcccaaactgatcttgaattcctgagctcaagcgatcctcctgcctcagcctcccaaagtgctgggattacaggcatgagccaccacgcctggccaacaaaagctttttcatttgaagctatcaaagacttaattgtagctagaacttgttattctggagggtgaaaagatcttaattataagcctactgacttttcctctgagaaattcggacttttaaaaaaataacaagaagttttttaacactttgcccaaagacctagcctcattcagtagatcagattaacccaagataactttctgaggcaagaattatgtcattctctgttttcctgggcagaagatctccttaccaggtaatataatagctatttttctggggtgctggtttccagggacctcatgtcttggatcaatggaatacgggggttggtgtcctcagatgagctagccaaggatgtcaccggagctgaggcattgctggagcgacaccaggtgggtggacctgcctgctgagtagcaaagacgtggctgctctgcagggccctagaggcctcattcccaccctttgtggtgagtcggtggttgacgtcagagtgggcatctgctgccagttacctaatcccttccctccttttggcaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcaggtgtgtgtgctcctggtttctgaccaagtgtttccttgctgaagggcctcattttctcacctgcctcttgccctctttagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggtgaggcctctggaccatggagttggagtctggatttttcctgattgacatctgtttcttggcttatatagtcactgttatatctccaaggaatacctgcgttgtctaagaaaaatatgtacataaataatctttaaaactttatagattctggtatttctgagattttaataatgggggtgccacaggaaaaaaaaatattatcaaagggatggaaaacaaatgtgtgggtaggtaagggaataatgaacaaacaacaaggaagatgtaaaactgtttgatttatacgtcactttgctgtaaatctgacagcattttcctattatcaggcttaattttgttctgttctgatattctaacacctgccccacctgagtgacctggagacttcttgagttaaactctactctagtaatgaatgaaatcaagctttcttttggcattttacactcttgcttctaaagtgtcagtgtattctgatcctgccaccagctagttctcagtcacccaaaataactatccttttctcaagactggcagtccaggcagggcccagccacaggcccaccttgatctcatgcctttgttttctgacaggaagagaagattgctgctctgcaggcctttgccgaccagctcatcgctgccggccattatgccaagggagacatttctagccggcgcaatgaggtcttggacaggtgggtgtcctgtggcactgacatagtcaccagccctgagaggatgcatcccctcatacgaaggcccaggcctgttctgtctccccacttccttctccacggtaagatatgctcatgttggatctcatggtttcactctttcaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggtaagctgaagtgactgggtgttggtcttgatgtagccttatgttattgagtagattttgttaaataaagcatttataaaacaatctccttgcacccatgggaagtcagtgagaaatatttcagtaagcccagccagtgggaaagccctagtcaagtttcagagccatttaaaagttgccttcctcatttgtctccattaaaactatttctgctgtaataaaagtctatagaatcccccttctattactgttcccaaatgctgagcttcctgggggaagtatgacaaaatgagtttctatttaatagctgatatgtgtgtccacatcagtgtactgaactcttgttcttttaatctgtttttgtagctttccaagctgctggtaagtttttaatttttttaagagttgtagttaaatgagctccagtatttgtgttactctgcgtagattattgttattattgtggtcacacggtttgctggtgtctcttcatccatccttttcatttctaatcatccattacactccattcaagtgtccctgtgggatgtggctttttctgttgtaattagcctgcaacgccttactcccccttctctcccccagtttatcacttaggcaaattctgtacagtgtttgatttgcggggcagtaattgaccattttctttcaaggagtgcttccttttgaagatggaacatcagcttcagctttttctgtgtagacattggctcagacttgctatgagctcatggtgttcggtggcctgggttggggaggccagtctggtgtgagggttttaatgcatacccactctggcatccagaggtgccagtcaggagaggaacagctagagaactgtagagagacggatggtctattaatacctccaaatcttcaaggaacacaaatgagaagttaagataaaagcagacatcactcaacaggtagtgaaaggagacttcagtcaacatgtagctcaaagttacttaagcgggtggaagaaatgaagatagagaagagagtaaatgggatttgaaccaaagggtgatcagaacaaggaacagaagaagagggtaatgggacttttgtcaggatatctgagtgtttgagacccttttccttcttggctttgggatcaggcggtgggagaacgtaacaaggacatttcatgttagtgctgaattgagccagatggctccatcctttgacagttgctgcctctgaaatgaaacatttgatgcagaattccccaacactactgccttttagttgttttttttttgccccccaaataacactcccctgagaccctgcatttcttacccagccaattgtttttcccagaattgtggcatagctgctatgtccttgcaattgtctcttgtagcatttcagtaccttctgtttctttatggattcataaaaaccatatcaggcgcccaggatcaggagcccatccttctcctagccctttcatttcccagtaaaataaattccttcctgcagtcaagcctgggttctgacagtatcccagtgttttgattaatgacagctacctaaagataaatcaacaaagccaatgtctgtagtagctgtagatttctcctctgtcaacagagggaaaagactgaccatcaaatattattttgctggttattacaatttatgttatgaattttgcttaatggtgatttctgctttagataatgaaatgtccatatgtatctcattcattacagcctgtctccaataaggagaaagccatggatggaaattgatgtacaagcagattcaaaactgaagttggccattgccatcttctggaaagtgttaggaagtgtgtaattctagggcttcactcccaaatagctagcatagctactgcaagaattgattttttggccaggcttggtggctcatgcttgtaatcccagaactttgggaggccaatgtggctcgattgcttgagctcgggagttcaagaccagcctgggcaacatggcgaaaccccatctctacaaaaaatagaaaaattagctgggtgtgatgtcatgcacccatggtcccagctattcgggaggctgaggtaggaggattgcttgagccgaagaggttgaggctgcagtgagctgagattacgccactgcactccagcctgggcaactgagcaagaccctgtctcaaaaaaaaggacttccagttcatctactcctgagctagtacatttccttcctcctttgctaactccccaagagatgaaccctaaaatatttcatacaaactccaattgccttctgttaaaaacgttggcatttaccccagttctttatgtttgctgccactccctgcctctgagaaccccttccccctgaaaagacataacctagcaggaactggtttggaaaaaatttttttggtatttttagagcaagcaccagaagcaccaggcttttgaagcagagctgcatgccaacgctgaccggatccgtggggttatcgacatgggcaactccctcattgaacgtggagcctgtgccggcagtgaggatgctgtcaaggtatggcccaccagctcccggtgcccagggaggaagatgaccaccgtcactgtcaacctgatataataacttggacatacagtcttaagacactaaatggattatagaagactttaggctgaattacagatggggaatgctagtgagaatggctcctatgagtgttttccattctcttctcttagaagttctcaaattgagctttaggagagggacgattcttcatagatttcatctctttttggctcccttctgttccccaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtaacactgagtggttcctcttcctaccagtgggggatttctagtcatttggcacagtgggtccatcagtgcccaaaaccacgaaaaggcagggctcaccagacaccccttttgacagaaacccttattatatatgagttgcatgctgtaagggatttatgagcaaagggagtgaatgttaagagagctgacttgtagtggcacttggactacaggtcactcacatccatagggaaggcaaataggaagagattatgggtagttatatggcatgcagctctaacaagcctatgccaggttagaaaccaagatagtagcatctgggaagccagagtcagtcatgtattctccatggagaatgtttggaaagcacagactataaaaacatagaggttttggccaggtgcagtggctcacgcctgtaatcccaacactttgggaggccgaggcaggcagatcacttgaggtcaggagttcgagaccagcctgaccaacatagtgaaatcctgtctctactaaaaatacaaaaattagccaggcgtggtggcacgctcctgtaatcccagctactcaggaggctgagcaggagaatcgcttgaacctgggaggtggaggttgcagtgagctgggatcacaccattgcactccagcctgggcaacagagcgagacttcatctcaaaaaaaaaaaatttttttttttaataattgcgtaagtttatcatagagccatgccataatgtaaccattcccatattgttggacattgaggtgttcccagccttttggtgtatatattttgctgtagtgaatatctttgaatattaatctttgtccacactgctgattctttcctaggggggtttccttgaactaggattgctgtgcattttgccttagctgtagtatttactatgaatagactctggagtctaggtttgactgaccgagtggagagagtgtctcaggccgggcaggctgattggggtggctaggaatcacagtaacacattgtgatggagaagtattcaactgtccaagcaaggccctggaatagccactgggcaacctgaattttccagaatgctgagtatacaccacacagtagcctttgctttttgtgttttcattgccaggtggaggccctgctggcatccgaagattatggcaaagacctagcttctgtgaacaacctgctgaaaaagcatcaactgctggaagcagatatatctgcccatgaggtaagcaaagggaggcgggccaggcccgagtgcctgggacacagctctgcctgactcctaaggaaaacaagcgtgtttgagaaaagagagtgacttctttcacttaaagcagccattctcaaaggttgtggcctcaggatcattatacacttggcagttattgagggctcttgagagatttttattatgtaggttttatcaatgctcaccattattaaaaattacataaattttaaggccaggtgcagtggcttacggctgtaatcccagcactttgggaggcccagacaggcagatctcctgaggtcaggagttcgagaccactccggccaacgtggtgagacctccgtctctactaaaaatacaaaaattagccgggcgtggtggtggctgcctgtaatcccaggtactcaggcgactgaggtaggagaatcacttgagcccaggaggcggaggttgcggtaagccaagatcgcgccacggcactccagcctaggcaacagagcaagactccatctcaaaaaaaaaaaaaaatgctgaattcaggttgtggtgttttgcattggatgaaaattcagttttacacaggtaggtaggtagaaaagggaggaatattttgattcgggtaagtgtgaataattttctttgatactataccaaagtcatagtttcttaaagcttagctgtggtcaggtacagtggctcacacctgtaatcccagcactttgggaggccgaggcaggcagatcatgtgagcccaggagttcaagaccagcctgggcaacatgatgagactctgtctgtacaaaaaaatacaaaaattaggctgggcatggtgagtcatgcctgtaatcgtagcactttgggaggccgaggcgggtggatcgcctgagctcaggagttcgagaccagcttgggtaacacagtgaaaccccgtttctactgaaatacaaaaaattagcagggcgtggcatgtgcctataaatcccggctacttgggaggctgaggcaggagaattgcttgagcccgggaggcagaggttgcagtgagccgagattgtgtaactgtattccagcctgggcgacagaatgagactacgtctcaaaaaaaaaacaaaaaaaaaacacaaaaattaattagccaaacgttggggtatgcacctatagtcccagttacttggaggccgaggcgggaggttcacttgagtccaggcaggaggttgaggctgcagtgtgtgtgtcatgatcacaccaccgcactcttggatgacagagcaaggaaaaaaaagttgttggggggttagttgcaaagtggcccctgaaaccttgtcagtaaactttttatactggattatattaaaacccactggtccatcttgggctttgaatgtagctcttacctgtgcatgattttgcaacatcatgcatggctcatttggtaaatattgcttcactgagttatgcctgttctatatgttgacacatgtgattatatgatatcaaaacattgcagttaataccaccaccaatttcattagaaaaatcttcacatattaggaagccttcaggctcctggtggtgggtgtaagttttctaaaattctaactttctcataaaagtttgaattttatcattagtaacaaactgtcagtattctttgaagtgacaggctcactttatttattctggaccgagtatctgtgagataccaagtctgaatgagcatagtttgttcggtggttgttctttcaagtacaaaagaatggctactcagtaaaattaactttcactgcctttttaaggacatttttaagtgaaacagcatttttttttcactgtgagtgggtggcagtgaagaatccacttctgctagtagtttgccactgccttgatttgagctaaagcaccagcatgtcccctcctccattgcttttgtactatcagtgcaaatgtccacacggtaaaaaataataatgtcttataatgttatgaaaatagtgtgagttgatagaatgccagaggtccacataacagactttgagaatatcaacactccacatctcagtaaggaattcctgagttcttatgttcaagcagatagctgtgggagacccagtttctgaccctcttatgtcccctgccccaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaagtatgtcttctcagccctctagaaggccccttacgcctgtaatagtgggcagcaggaaccacaggctgactgttgagtggtgaggctggaaaccctgctggactgggatcccagcttgggcacacagtcgtgggatgcctcagtgtcttctgctttccgggtttacagtgatgataattggcggtggtggtgatccatgctggctacataggccctgtctagaccctgccttttagattcccgtgaaagttagtgagtttgtttctgagcttctggagaagatcacttctccaaggaaggagttgctttttttcttattctctatctgtccccgaaaatgtcagtctactgattccagttgatgtggcaggtaaacaaacatttttttttctgagatggagtctcgctctgtcaccaggctagaatgccaccatgcctggctaatttttgtatttttagtagagacagggtttcactatgttggccaggctagtctcgagctgacctcacctgacctcaagtgatccacccacctgggcctcccaaagtgctgtgatcacaggcatgagccactgcgcctggtcggaaggctttaaggaagtaaggaattaagagagaggattttgttcttaaaagacgtttgtggccgggcgcagtggctcacgcctgtgatcacagtactttgggaggctgaggcgggcagatcacttgaggtcaggagttcgagaccagcctggccaacatggtgaaaccccgtctctactaaatacacaaaaattagccaggtgtggtagcaggcgcctgtggtcccagctgcttgtgaggctgaggcaggataatcgcttgaaccagggaggcggaggttgcaatgagccaagatcgcaccactgtactccagagcaagactccgtctcaaaaaaataaaaaataaaaatataaaaattagctgggcatggtggcacgtgcctgtaatcccagctactcaggaggctgaggcaggagaatgatttgaacctgggaagtggagatttcagtgagccaagatcgtgccactgcactccatcctaggcgacagagcaagactttgtctcaaaaaatatatatattacttatatagctgggtgtggtggctcacgcctataatcccaacactttgggagaccgaggtgggcagatcacttgaatccaagagtttgagaccagcctgggcaacatggtgaaaactcatctctaccaaaaatagaaaaaattagccaggcatagtggcgcacacctgtggtcccagctactccggaggctgaggtgggaggatcacttgaaccggagtggcggaggttgcagtaagcagagatcatgccattgcactttagcctgggcaacagaatgagactctgtctcaaaaaaaaaaaaagtgtgtatatatgtatatatataaatatctttgtatatttacagacatatattgatatattaatacatatttagtatacatgattgatatatattgatataatttgatagggctcctcagggcagcactagtgatgcctcccatcctccagtgcatccccaaccctccagaatccggacacacagcagggctcatagatgcatagatggacagaggttcttggtccctactcatttgggaagtagaggcttttgttgttcagaaaactggcaaggattttcccagaaagattagtagatgtctgtgaggtccacagttgacctgatgtccccacttgaaagcagggaggtgcagagactgactgtgctgtttcccatctctcattcagggagaagaagctgctggtgggctcagaggactacggccgggacctaaccggcgtgcagaacctgaggaagaagcacaagcggctggaagcagaactggctgcgcatgagccggctattcaggtaaggaggccgccttctggccaagagggcagaggtgtttgagtgggccccaggggacagacaaaccccttgcgcttatttcactgaggtccctaaagtgttcatgacccctcagtccaaacctggagaagtcccaaacttgatgttgaggccttttcctgggagcttcgagacagaagcaccagaagagctacctgctgttaacctcctcgtccttgcctgtcagggtgtcctggacactggcaagaagctgtccgatgacaacaccatcgggaaagaggagatccagcagcggctggcgcagtttgtggagcactggaaagagctgaagcagctggcagctgcccggtgagtagtcagaggcaggagctcccgggaacaagtggaaggccagcacccaagggcagactctgagctgtgggggtccagtgggccctcctactgtctcctggacctttggcctcacatgtgccatagtcggtttgctccagagccacctcctacaggccatgctgaggtggtctcattctgttcatctggacccactgtatgagtccagaatcatacatgtttctgtatgagtccagaatcacacatgaatcacacatgaatcacacatgattctccagaaatcaagacatgagagtctggaatcacagagtgggtgattcatgatgttccatggacggcctgactgactgtgagggctcaccttttttgtgaatgtttttgtttttgtttttgagacggggtcttgctgtcacccaggctggagtgcagtggcacaatctcggctcactgcaagctctgcctcccaggttcacgccattctcctgcctcagcctcccgagtagctgggactacaggcacccgccaccaagcccagctaattttttgtatttttagtagagacggggtttcaccgtcttagccaggatggtctcgatctcctgatctcgtgatctgcccgcctcggcctcccaaagtgctgggattgcaggcatgagccaccatgcccagcttttgtgactgtttttaagcatatgttaactatcacaatcaaagctggaggagattatggctgattttcttcctgtctcctgtaattaggggtcagcggctggaagagtccttggaatatcagcagtttgtagccaatgtggaagaggaagaagcctggatcaatgagaaaatgaccctggtggccagcgaagattatggcgacactcttgccgccatccaggtgagacagaaaccaaaggtgtcacctgctttctctcttggcaactgcctgctggtcatcatttccctgttggtttgttagagggccctgctcttactaggagagcacacagggccagcagccaaggcctcagtagttggttttagccctcaagatctcacactaggggacatcacccttcagtaaacaaaattggtatggctttgtcagtctcagttcacgggccctgtcattcaccaggcagcgctgtgggcttgagtcttcatatcagtttcctggggctgccataaataagtaccacaaacggagtggcacgaacggagtaccacagacagagtggcacagatggagtggctgaggacaacagagatttattgcttctcagttctggaggccagaagtctgaaatcaagaagcaggcaggaccatgttctgcaaacctgtaggggaggatctttccttgcctcttccagtttttgctggcaccaggcgcccttggcatgtggcagcatcactccagtctctgcctgtcttcacgtagccatcttccctctgagtctgtcttcacttggcatcactctgtgtgtctattcacatttctgtgttctgttgtagggacatcaggtctattggattagggtccacgctaatgacctcatcttacctttgcagaggacatttgcaaagatcttgtttccacattcatgggtaccagaagttaggacttcaccatctcttgagggggacacagttcagcccatcacatactccctaaattggttaactgttgctacataacaacccgcctaaatgtagtggttgaaagcagcacccatttcttacttccaatggatctgtggatcagcggcatctgcagctgtcactggaggtccttcacgctcctgcattcaggcagagcgtggctgggctgagagatccatcacacactggcagctgagcctgattgtcatccagcctggacatctctgttcccctccacatggcctgttgtcctcaagctggctagaccaacctccttcagcagcattcagacaggcaaaggcaggagctgcaagatgtctgcggcctcacacatcatcctcactgccttctggccaaagcaagtcccaaggcagcccagaggcataggtggatagattcccctctggaaaggagatgctgcaaagtatcatggtcagatatgactaaattcctgcccccagatgtggaagcaggagtgtgcactcccaggaatcgagttagctttgagccaccttcctcaccatgggaagcatcctcccgctggtcagggtgattcaggtagaatttagatggtcagtcatttcccatcctctgcatagttgagttccctggaagcaaccaaaaaggcatggtctgcagtgcttaaattgtactaaggaaaagacctggggccaggtgcggtggctcacacctgtaatcccagcactttgggaggccaaggtgggcagatcacctgaggtcaggagtccgagaccaacctggccaacatggtgaaaccccgtctgtactaaaaactacaaaaattagctgggtgtggtggtgcacacctgtaatcccagctacttgggaggctgaggcaggagaatcgcttgaacctgggaggcagaggttgcagtgagccaagatcacgctgctgcactccagcctgggcaatagagcaagaactccgtctcaaaaagaaaaaaaaaagacatgacttggaaggccttttctgagatgtgttcaagttaaaccttaaaaatgtgtcgtttttgtttgggtgtatatcttcagcttgctttgtgtcattcttgtggtcctcttgggggagagaccataagtcactgttgatggatgacaaagggtttgacccttcccaaaggtccaaagactgtccctgctgaagcctgtcccaccactgctggttactctcactgcctcactgcctcctgttttccttccttttatgattctctatttattaatgttcctctttattatcctcttccccagctagactgtaatgtgtgcatggacagggaccatagcagttttgtcactctctgtccccggggcctagcccacaacacatagcaggctctcaatagtgtgccttggctgcttctactccagggcttactgaagaaacatgaagcttttgagacagacttcaccgtccacaaggatcgcgtgaatgatgtctgcaccaatggacaagacctcattaagaaggtgagtccagcccattggtaagacctccatcgcccactgggacacccacgtgttggtaccacagaggtcccccaaagttcacttcctgggatgttcaccaaaccaaggtctgcgtggagaccagcagcaattccattcctgtgtttcgtgacaagttggatatttccccctttttgaagccagtaaagttattctgcagtgcttattttttctgcattaagcaacagagacactggcactcccaaatgctgctcttagtttatttctcaagcaatacagtctctttatagggacagtagaaaatgcaaataagcaaaacataaaataaaaattacccataaagccccaccctgacaccacacattagatctttgtgtctgacctgccagacctttcttttctctccacaggtttagagctaccagctagatcaaacagccgcagactcccgtttaataggatcatatcactccataaattatcaaaaacctcgaggctgtacagggcattttagaaatgaatctacttcattcgcagcccttttgggagaaaaaataaaggggcttggtgctttctcagcagcagcgaagccacatccctcccacacagaagctctagactgaaggcagtgtgtccgtgggtcgggaattcaccagcaatcactcaggtgcagtgacgcacctggagtgcctcaggacagaggttttaacagctatggtttcctgtcacacacacatcatgagtaagatttctcatcacagaggttgcactcagcagtcatggccttcagactagggtttgatccataggcagcaacaatgtagctaaaatccacttcactggagagcttttcttccttgctctgatctgcaaataaacttgcgtgaaactaatttcagctacagccatgtatagatgtagacgtggctcctgcacacttaaccccctgacacacacccagacaacattctctgttcttcaagccaggagatcaccagtgtgagtgtccttcagcctcctggcaacgagccagctgctttttttttttttttttttttttgcgacggagtttcgctcttgttgcccaggctggagtgcaggggtgtgatctgggctcaccgcaacctccacctcccaggttgaaacgatgcttctgcctcagcctccctagtagctgggattacaggcatgtgccactatgcccggctaattttgtattgttagtagagatggggtttctccatgttggtcaggctggtctcgaactcctgacctcaggtgatccgccctcctcggcctcccaaagtgctgggattacaggcatgagccaccacccccggccagcgagccggctgctttgtcctcagcgacagcctgtttcctctttgaatttatctttcaattcttttttctttttattttccccctttccacaggtgttaaagaatttctctttaaattcaatgtgacttgtagtatggtttatttatttatttatttatttatttattttttagacggagtctcactctgtggcccaggctggagtgcactggcgcaatctcacctcactgccaccgccacctcctgggttcaagtgactctcctgcctcagcctcctgagtagctggggttacaggcgcctgccaccacgcccagctaatttttgtatttttattagagatggggtttcaccatgttggttaggctggtctcaaactcctgacctcatgatccgcctgcctcggcctcccaaagtgctgggattacaggcgtgagctactgtacccagccaatttttttatttttattttttgagatggagtcttgctcttgtcgcccaggctggagtgtagtggcacgatctcggctcactgtagcctctgcctcccgggtttcagcagttctcccacctgagcttccctagctagctgggaccacaggtgggtgtcaacacacctggctaatttctttctttttttcttttttttttttaagagatggggtctcactatgttatgttgcccaggctggtctccaactcctgggctcaagtgattctctcgccttgtgctgaaattacaggagtgagccactgcacccagccctgtatgtgtagtattttaagtgatatgattcagtttttttctatcaaaaataatactaatgaatatatcatcttaacttcaaatttcagcccattcgttttttttgtttgagacagagtcttgctgtgttgcccaggctggggtgcagtggcatgatctcggctcactgcagcctccacctcccaggttcaagcagttctcatccctcagcctcctgggtcactgggattacagatgagtgccaccaaacctggctaattttttttttttttttttttttgtattttttagaagagacagggtttcaccatattagccaagctggtcttgaacccctggcctcaaatgatctgcccacctcagcctcccagagtgctaggattacaggcgttagccactgcgcctggcccatatttctttagaattaattccttggaccggctgggcactatggctcacacctgtaatcccagcactttgggaagccgaggtgggcaaatcacctgaggtcaggagttcgagaccagcctgaccaacatggtgaaacccccatctctactaaaaataattagctgtgcatggtggtgttcgcctattagtcccagctactcgggaggctgaggcaggagaatctcttgaacccgggaggcggaggttgcagtgagccgagatcacgccactgcattccagcctgggcgacggagtgaaattcactccgtctcaaaaaaaaaaaaaaaaaaaaaaaaaagaattcctaaaagtagaattgtcagtacgtgtatttgtgtgaagcctttgaccgcattgctcttacaaaagccttaccctatcattgtttacccagcagtggacaggggagcaagtggcccattttatagaagtttagagcctttccagggagggcatagtcaggtaaccacagcaggtaaggctgaccagtgtgtgcctctctccatggcctagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgagcactgtcagcaaggcccggaagagccttcccagagctgctctttgtctccttccgtgtcattggttttcttctgcagagaagaaactgatcaattgtgggcatggcagagaacctactaccagggcagaccactgactgccagctaggaggagacagtgtcctgaggccagaactgccacccggaactgggctggcaccagggtcaataaacaaaagcctgtaaacgctgctgcacgcagagatggcataatgtgacgtcatggcatgaacaaagttggcacagcaaaggcaccactagctgccctggtcaggggcgccacccagctcctgggtgagggaaaactgggtccggatatcggggtccacgtgtcctgggtagtagtaatagcaactgaactagaagacgggctgcagggagctcgtcatggcacagatggaggccaggcctgggtgcagggaggggcctgctaatgtgggttctgaggctgtagttaggaagattgggatttatctgtacacaaaaaatggtttgtctgggttttgatgtttttcctttctaatccatctccactgaggagggcagtatattttccacacttcgttttctaggtgaaaaggagaacagcttgaagacagatgattatggccgagacctgtcttctgtgcagacgctcctcaccaaacaggtctgccctggccccttcactggttgaaatgtatgcagatagcatctgtgagatgactggtggcgtctttcactgaggcatttatcttctgttagcccctggggatcagcaggaaaaagatcctgtcctggtcctcagggagcttccagactaactggggaagcagacacagaaccaggcatctctgcagcagcctgctgggtgctgacgggactgggcactgcaggagcactcactcagttttcagcaggcgagggttgaaggggcaagttctcctaagcgaaatcatgaggggtgaatgaaaacggtcagggagagaggcagggcgagtgttctgggcagagctggcagggatccctggggcgggagagcggaaggctggggtcagggaggtgggaggaggctgccgcagtgatctgcggtctgaaggagagcaggaaagggggcatgtgtgactgagtctcagcagtgtccaggtggacagtttggcttgggcatctgggggacatgctggtgccatctgagcctaggaagagcaagttccagtcctgtggagtcaccacaaattggcttgtcactccttgttcaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtgaggatggggccacgtgaagcttagctggcccacagctcaaggaaggacgcccaccttctgtctgcccagctctgccactcccccttgaggaagctgtgagctcagtgcagagctttcaaacatgggtgtggctggcatcaattaaaaccagggcaaatgagagggccctgtgagatcgccattcagaagcacgcaggacagactagagacaagggcaaagggtaggaaggggaaaaaaggctggtgaagacttgaagggggagcaggagacaggagcagaggggagctaagctcccagcaggctgtgtgcgcctctgattcccaggaaccaccccgcaccccacctcctgcactgcgtcggcacgtccagccctggcgactccgccaactcagtctcttctgcttccaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggtacacctcccgctgccctcaggagctgctcggcctcccagagccctctctgggccctgctcagagcccacacttaactgagtcacgacaagacgagcaggatggaggagcatggtttcatcagaagtttcatttctttttgtgttcttgaggcagggtctctgtcacccaggcttcagtgcagtggtgctaccatggctccctgtagcctcaacctcccaggctcaggtgatcctcttgcctgagcctcttgaataactgggactacaagcacgtgccaccacgcctggctaattattttaatttttgtagacagggtgttgctatgttgcccaggctggtcttcaactcctggcctcaagcagtcctcctgcccaggcctcccaaagtgctgggattacaggtgtgagccactgtacccagccagaagtttccatttctgacagtccagcaactccctgcttgactgaccagtcgcttccctccaggtccgcctcttccttgaagcccctggggggtgggaacagagaaagaactaccaagtgctctgagccggcctcatgtctcccagcctcctcctctcatctttggggaggttccttgtggggaggccaccaccaccctgagcccatctgtgaaggaggggctggtgtcactgccacagcagcgcacagcatctgcccccctttggccctcaggagagggagctggagctgcagaaggaacagcggcggcaggaggagaacgacaagctgcgccaggagtttgcccagcacgccaacgccttccaccagtggatccaagagaccaggtgccagcccgctggggccggggagcagcagcatgtccctgctgtacttaagccctggggagcttccagccccaaggaggtggtggtgctttgtgtaaaaccagaggcagcctgggaataaagctgggctggcaacgcctggtcgggctctggagccgggagtgggggcataggtggagcagcctctcagtgctgcatgtcccagacatcaagttgttagagatcccggattgagtgggaccatgcagggcgcgtggtcagccccagccatgacttggtgacagacgatgcagggtctgtgcgttgggtactgatgttcttgcttttgttttcctttctttcttgtgtcttctctctgtccccccgattgctgctgttgtccggacaccaccttgtctcccggctgcttggatctgctctccacaggacatacctcctcgatgggttaatattgttttcttccttctctgggcttgtcatgtgggggtctcgtgcgcttgcccctcgtggcctggcttgtggaggatcccgggatgggccttcctgcccagggcgggctgcacttcccctcccacccttctcgtcacctgatgaggagtgtgtgccttgccccatagcccatggtccctggtccccgatagagccttcaagccagggggagccgtccttgcctcactgggcgattccaagggctcactttgggtagggaaggtgatgaagcacgaaggccagagctggagtccagaggccctaagaacccccgtgcctgtccagccaccgggctctgttgggctctcacctctgcttccccagcgagtccaacagtggtcagtgggcatgaagcagatggcagtgctgggggctcaggcagggtacagtaagtccacagctgagaagggctgggcactgacaccccctaagtagctgaggctgccactttactttcctggggtcagggagggtaacaagactgtccgccctaatagaaggcaaaaatgcacccgttatgtgatagacaggacgtgggaggagccccagggaggagcagggctgggctgtcccgcccagtcccggcagggacttctctgcttggcctggggcctctgcctggccgggtcacctttgtaatctgccaagcctgctgtgaaagccagggctgctgggactggagtggcttggcctgcactcctgaggctctgcacccaggcacatcaagcctgtataggcggccaggggagaaatagacccatccagccgggccacacattctgatggcagagcagctggggacgtagggatcgcagtttccggcctgtgcccgtaggacaccctggccacctgactcccctccctgccccatgcctgtgtctgctggtcttgctcttgtctccgtgaggtgccacgctcccctcaccttatggctcctcccaagccctgcccatcttgcccattcctagtgtgagctgcctggggtgaaccactgggcctgctgcctccaggtacccgccgggcaccaggttgcccttgcctgcgccctgccagcttgggctttgtgtgtgtctgttgcagtgtgctcttgcctcccctccctttggtgtattcatttggtttcttttctttgaatagcatagcatatcgtcgggtcattcgtgtctatcagtatgaagttggggatgatctgtctggaaggtttttctccttatttctcttcttacctcactgtggctttactgatgcactcttgacatccccaggcggctccaccctgactaacctgccgccctcggctgcttgggaaggaggggtctgtcctcccactgcaccggcacccagcctcctgcccccaggtcctggggggcattttccccggggggacatggcgtgactgtgagtctgacctgctggggtaggaggaagcctggtgccttgccttgctagagcactttgaacctggggagattgcagagctaaccctggctcgccgggttttaaaagggtaggttggggtgaatgtgggtacaggggagcctgggctaaaaccccaccaaggccacacgcaccgtgtgattcgtccctgcacgtaaccctaactcgtttgttgtctttgtttactggtagcctctgtgacctggcactgtgttctcttgggaaggaggctccccagagcccatctgctctcagaacttggtcctagagaggaggctccctccctggctgtgtctagaggatggaaccgggatctggggtttagtcacagccatctctctccttttggcacagttggtcgtgatctcccagcactccacttgtgtcctttgtctgcagggtcgtgctctcattccccctagaatggggctccctccctcaggaaccttgccgggacactccagggtttctgtggggaggctgtcaggttctcagcctcccctctgccctgaggtctcctgtctgtcaggtgtcagggtgtgccatcccccacatggctgcagagaggatgctcagacaggcctgcagccaccctgcacccatgggggaatttaaactccattcctgagtcatcctggccttgggagcaagacgagtgggctcagccctggcccacaccaaggcagcagcttcccatctctaaaacgggagaaatgctccctgccatccctcgatccctggggcccattaggtaaagatggccagttgcagttaggtttggtttccttaaaaggaatgtgaggttgccaggcattgctctctctgagagaaggttcattctgagctctcggccagctgggagcaggcccctttcctcactgtccttccacgtttaggtcctgtatggtggaagagtcggggaccctcgaatcccagcttgaagctaccaaagtaagtgcccgtggggctctggcccagcagagacccttcacccagccaccccccagggtaccccttcccttcctggcttaaagtcaggaaccagatgtgctattattgtacccttttcccttggcctaaagcagtctagggctcttcactatctctctctcttttctttctttcttcatggaatctctctctcgcccaggctggagtgcagtggtgcgatattggctcactgcaacctccacctcccaggtcaagcaattctcctgcctcagcctcccaaatagctgtactacagatgtgtgccaccacatttggctaatttttgtttatttttaattatcttttgagatggagtttcactcttgttgcccaggctggagtgcaatggacgtggtcttggctcactgcaacctccacctcctgggttcaagtgatcctcctgcctcaacctcccaagtagctgggattacaggcgcccaccaccacacctgggtaatttttgtatttttagtagagacagggtttcaccatgttggccaggcaggctggtctcgaactcctgacctcggctgatctgcccgcctcggcctcccaaagtgctgggattacaagcgtgagccaccacatctggcctagtttttatatttttagtagagacagtgttttgccttgttggccaggccggtctggaactcctgatctccagtgatctgtccacctcagcctcccaaagtgctgggattacaagcatgagccaccactcccggccgagggctcttcactttaaagaaagtctttggggctgggtgtggtgacttacacctgtaatcccagcactttgggaagccgaggcgggtggattgcttgaagtcaggagttcgagaccagcctggccaacatggggaaaccccatctctactaaaaatacaaaatattagctgggtgtggtggcaggcacctgtaatcccagctactcaggaggctgaggcaggagaatcacttgattctgggatgcggaggttgcagtgacccgagatcaggccattgcactccagcctgggtgacaagagcaaaactccctctgaaaaaaattacttgggcatggtggcctacacctgctcaaagtccagcatgggcaatatatagcaagaccttgtcttaaaaataaggctgggtgcagtggctcatgcctataatcccagaactttgggaggccaagacaggcagatcacttgagcctaggaattcaagaccagcctggtcaatgcagtgaaacatcgcctctactaaaaatacaaaaattaggcaggtgtggtgatgggcacctgttagttccagctactcaggagattgaggcaggagaatcacttgaacccgggaggttgcagtgagcgtgattgcgccactgcactctagcctaggcgacagtgagactccatctcaaaaaaatttataaaaatctttggccactgcttcctggagtcctcgccgtacttgtccttggcgtgcactgccctctggcaggtctaccagctgctttggaaccctcacattgaaagtctctccctctattgaggtggttgggatttcttcagcttcaccccatcccactattcctattctagaatgttcttgttttacgaggtctcaggccaggcctggagcaggaaccagagggcagtaagtggctcctgggctggtgactgagctgagggcccccgtctgagcatctgtgctccccacccctgcagcgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggtacccgggagggctgtgggccaggctcagcccagagcagggggaggaaaagacacagtcacctgctgtgtggagggtctgttccctaatttctgtttttcttccaggaacacaacaggtgtgactgaggaggccctcaaagaattcagcatgatgtttaagtgagttcagccttactcgccctggctgggtggggggtgttcggcagcagggctgcctgctgagccgccctcggctttgtgctgcagacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacaggtaaattaattaaggccaggtgctgtgagcctctgcccggggcacccacctgccctccctgctcaggctcttgcttcccccgctcctagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccaggtatgggcctcaggaggtgggtgaagaggtgtcctttggaaaactaaagccaaatttgtggcagagctgagtctggggtaacaggccctgcgctgggtattctccccatttacaaatcaaactcagtatggacagaagtcccggatctgcttgtagaagcagctccgagcccccagcatcctgagacctgggaggtcgggtttgaagtgggtgcagctggctcaggcaccaggtgccatctcttaccccacagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccc

SEQ ID NO: 37005 - DNA, 163849 bp, Homo sapiens
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcggtgagttctctggccgggcccaggcgcccactgtggtgccgacccgcccccgcgcgtgcacccctgcggagggcgaggatttcccgcagcgcgcccccacctcggagataagggggagtcgtccccaggggtgggttatagggggcctagaccccctccccggtgtcttcccctgggatgggacctgttgtgatcgctccccgccatccgccccagcagtgcacctttggctggctaagggttgagggtttgggctggggtcacaggaggagaggtggagttgttgcatttctctacacctggggcgcccctatgggagctaggggactagaaaccctcgttcgctgtccccgggggcgggccctagggtcagatgctccgcggagtgctctccctgctgcgcccaggttggtgctctcagaggcagctgaatgggcgttggctcggaggccgggccgtgagacctgaggaggaaccgttctctgcgcctggggcctccctgcccaggtggagacagagacctggtaccttcccctgccgtcgctggaatgggtgtgggccccgaggttgcaagggtaggcgcgggtgtgtgtcctcgctctctctgctcccagctcagctctggccgcgcgccgcaggttgaacccactccttgctgccgaagttataatttagagatggtggtggtaacagtaattgctgtcttgtagggagcccaactagcgtccactgtgtaccgtcagccttctaagttatctccgtccctacgcatcctgccatctggggtgaggctagacccattttacagataagggggtccggagggttaattgacctgtccaaggtcagcaagtagggcccagctgagaactgaaggaagtgggcaacagttagaaggaggctttgttttcctctcctctcccaaacctacaccagggtcttcctgaaaggagggagggaattggtgtctcttgctggactgggccttctggtctggggaggaagaataaggatgaagtctcccttgtggtctgagatagttggaggcttcccagagggccacaaggctactgatagtgtgggctgtgatggtaggggctgtgatgtgtgtgtgcatgtgggcgtttgtgcagagaacgtgtgtacacacatagcatgtgtgtatagcatgtgcatatgcaaagagtttgcatgtacacggaatgtatgcagagaatgtgtatccacctacacgtgtgtatgggtgtgtgtatgtgtgtgtgtgtatgtgggtgggtgggtgtgggttggggcagaggagggttctgggtctggatctcttcctaaggagaaccagggactggccctggcctgtgatttgggtctcttcctgaggaaaccaggtcactatagtgaccctagtgacaggaagaaagggagatgggtgtggctgccaggactttctccagtggaaaagggattccctctaggctgagcctcccctgggccttagggcctcacccttcccttcccccacacctgtcctggcaggtaaggctgcttcctgcttcctgggcccagatggcagccgcaccacccagctgatctccagcagccctccccctccccaagggtggcttccctgcagaagaatctgcatggcacgctgttgtcttctttctggggtccatctcctgtactggggagggagaacctcagaatctcctggaattctttaccattcagaaaccagcctcccctctgaagaatcccaaggcccagctgggctcaatttggatctgttctttgttttaaaaatgtgtatttatttaattaactgaataaagaaacttaaagtaaaccagaagtatccaaatacgacatgaaatctctaaaacaacaacaaaaccaaaccaaaccgcagcactagcaaatcacagactgcctgatctacccactgtttacagaggcagcagctacttccagcactgtctctcatcagtgcccggggctgtgggtctcattctagattttgtctacatttttttacatggttctcctgattccctgctccccctccccaccaccgccccgcctggagatggagccttgctctgtctccaggctggagtacaatggtgccatctctgctcactgcaacctccacctcccgggttcaagcgattcttctgcctcagcctcctgagtagctagaattacaggcacatgccaccacgcccggctaatttttgtattcttagtagagatggggtttcaccatgttggccaggctggtctcgaactcttgacctcatgatatgcccgcctcggcctcccaagtgcgggggttacagccctgagccaccgcgcccagcccggtcctccttttattttcgaatccactcaggccctagctactcccattgtcccgacgttccagggttagttagcttcccttcctctgtgctgggcctgtgggctgttggcagcttcttcctgttcctaccacaacttgcattctatttttttcctttttaatgatttcttggatcatattccccagagtgacattcctgggttaaagggtgtgaccacatttatgacttgtatcattggctgcctaattgctctcccgagagatcttgcaacaaacaggttttccagcctctggagaccacagagagccctggcaagtgccaggactgctgtggggataaagcaggaggcttcttccctaagctcttgaggctgttgtgggtaatggtccttcatccttcaaggcaaagttacctccagcttggactaaggttcatatattcactgcttaggttgtgttacattgtgctgacaatgacactagcttcaatttgggggcacctactgggtgttaagtgtgttctgttgatcaccccattgaattttcatgctaatcattgattgacagcaactactgccctatctctaatgatctgcttctgcaagtcacttagagagttcagggcttaacactgtcctgggcatgtgttgcttagaaaatggcgcctgttaattaaataaggtgctgtctaataattatctcaaaagtaatgccagggctggatgccgtggctcacgcctgtaatcccagcactttaggaggccaaggtgggtggatcacctgaggtcaggagttcgagaccagcctggacaacatggtgaaaccctagctctactaaaaatacaaaaattagctgggcatggtggtgcacacctgtagtcccagctactcgggaggctgaggcaggagaattgcttgaacccgggaggtggaggttgcagtgagccgaggtctttgtgtaactgcactccagcctgggagagcgagactctgactcaaaaaaaaaaaaaaaaaaaaaagtcatgcccgaatggtttgcacaccgaagggacgttcaaaattaggggagaacagcctggttgtttgtttctgtttggttgatcatactcttgccatggttagtattattatctttatttaaagatgggaaacaggagtgaagccacttgtggaggtgacccagctagctagtaaatggtgtctgaaacccaggtctgcccagctgttgaattggagccttaactgacttgccttccagtttcagagatgagtaaaatacagcttttctctccacatcagagggtccctgcaacactaggtttgcaagtcttaggtgttagggtggtggctggatacccacactctgaacctctgaccttggacaaaatagggatgtcagggccttccatgattggcaggatgaatcctctgggctgtgatgaaggtctcacaagttgagagtcagccgggaattaagtgggatcagtttgcctcttgtgttttcctcattgtgttttggttggttggttgagatttcctactacccaatggatgatgttttattccatcgtcagggaaggtatcattgaatgaatacagggttttgtatgctttggataagaccagacagttgtggagtcattagaattgtgtacatgcctccagctctgagataggtggtgtttcaacagctgccagaggactctggcttttctgcctagaattcactgaaagacaaccctggctattgattcacatttgtggttcattgtaaggtaggcccctaggcgccatccaaaagttgaaaatttccttacgtttcttgttatgtgatgggcagttcatagtgaggactcagtgtctttaattccagctgtttgccaggagttggcagttttatttacttgtttttccaaaaacctttctgacatggggcagtccagccagctgggaggaaaaggggtctctcagcccaagaatgatgatcaaggcctagaagtttgggtggtgtgttttgttttgggcctttagagaaaggaattgtttccttttcagaggatgtggtctaaccctaaagtttacttgactgacttaaaccaggccagcgccagagcaggcagggtgcgtgttcccaagacttcgggtcactaggcagcttccagggtggtgggtcactggtccagtcagctccttttccttcctctcccttttgtgctactactaccaaaataatttccaaataaccttaagttctgctctttcttgcatgtctagcagatgccagcatgtcttttgggtagtacagagagtgcttaaaaagtagcaaagttggccggacgtggtggctcatgcctgtaatcccagcaccctgggaggccaaggtgggtggatcacctgaggtctggagtttgagaccagcctgaccaacatggagaaaccccatctctactaaaaatacaaaattagatggccgtggtggtgcatgcctgtaatcccagctacgtgggaggctgaggcaggacaatagcttgaatccaagggcagaggctgtgttgagctgagatcatgccattgcactccagcttgggcaacaggagcaaaactccatctcaaaaaaaagtagcaaagtagcatgctttgtcagaattattaataacaagttgtgggccatgtacaaggtggcacattagcattcaatgtcacttgtgtagtagttaagagcaaggattcttggttcaaatcccacttgccactaagtagctattagaaacttctgtgccttggtttccttatcactaaaatggggataataactaccttcttaaaaggctgttataaagattaaacaagttaataatttttaaagtgcttggcacagtttatggtacatagtaagtgctctgtgaatgcctgttaattaaataaggcactgtttaataatctcaaaagtcatgccggaaaggtttgcacactgaaagggcatttgaaatcagcgcgctctggggagaacagcttggttggctaaggttgatcctacttgctaaaatacggctatggactgcctagagggtgtcacctccttgaaaggggctgccccctgctatgttatggctgcctccagggcccattcacaccagctttgtttccaagctggacagggagctccaggcgtctggtcattccagcctcccacccctttcaggaatctctgggccaaatcacttccagatggtggttgggcctctgtggagttctcccagcaacggcggagccagcatgccagtcggcagccgccttcgttcttggagagtctgagctaaaggagggctttgatttggagccaaattgtgtctcttgggtcctggttttgtgctgtgaggcaggtaccatggagtgggctgctggcttagttgaggatggctgccctgctccttaggggagcagatacccagggcctggagcctttaggccctgcctccagtagctccatggtcagggtgccagtcaccttgcgttttctttttctttttttttgagatggagtcttgctctgtcgcccaggttggagtgcagtggcgtgatctcggctcactgcaacctctgtctcccggggtcaagcaattctcctgcctcagcctcctgagtagctgggattacaggcgtgcgccactatgtctggctaatttttgtatttttagtagagatggggtttcaccttgttggtcaggctggtctcgaactcccaacctcgtgatccacctgcctcggcctcccaaagtgctgggattacaggcgtgagccaccggacccagccaactttgctacatcagtttccaggtagcatatcctaggcaaaactggatgtagcctagtgattcagggcctcggtctgaagctagactgtctggattctaatccgcactctgcctgataccagctgtgcaactctagtccactgctttaacctttctgtgcctgcttccctgtctataaaatgcaagagcaaaatagttgctatcttagagttgctgggagcattatatttgatgaggttaagttatagcacagtgttgtcattatcactatgaatattgtgcttttggacccaagtccaggactttgtcttgtcttctgtctattctctggccagtccagatatttttggaatcctattgctgtcatctggtgtgttagctgttccctttctccaagttcagaacgtctgatgaagatgtctcccaagatcctttcttcctttcctcattcaacaaatatatgaaagcccatctctgaaccaggccctgtgctgggtgctaggacaacaggaatgagaggatcatgtcctttgcttgcctcagatactgctcagaggagaagagacaagcaagcagggagagccatgcagaggagagctgctcaaaccttcaggcccatgctcatcacctggggactttgttaaaaatgcaggtctgattgagtaggtgctggggtgtaggctgggattctgcgtttccagtcagcttcagatcctgctgtctgtgcaccgtgctgtaagtagcaaggatctaggtgccaagccctctgaaaaggaggagcacctgcccctaggctgggtatgggtaatctagaaggttccctggaggaagggacctttcagctaagacctaaagcgtgactagaattaggcaggcaaacagacatttacacaggagcagacgagtgtgtcagtttagaggtcttgatgctcaggtcagaggggcagtggaggggtgggcagggctggtttaccaagggctttctgaaactggaggctgcctatggggtatgctccttgagtttgtttgtttgtttttttttttgagttggagtttcaatcttgtttcctaggctggagtgcagtacagtggcatgatctcggctcactgcagcctccatctcccgggttcaagagattctcctgcctgagcctcccaagtagctggaattataggcatgtgcacacctggctaattttgtatttttagtagatatggtgtttcaccatgttggtcaggctggcctcgaactcctgacctcaggtgatccacccacctagcctcccaaagtgctgggattacaggcgtgagccacggcatccagccccttgtttagtgtagggtagtaaacccagccaaaaggggtcgtttatctcaggggtctcacctgttgctccagtcattcctattagcagaaagttttgtatgtgccccttcctcatatatatatatatttatatatgtatttatatatatttataagttataaacatactctactgtcaatttgtatattaaatattagtaaatcttagtttctttttagatgacaaatccaaatataaaatctgtttttttcctggctctaacggattatcttatgtccccttggggtggacatacctcttttggaggctcccgtgaaggtttgtgtttctacatttagtttttttcttttttccatattcttgttattctgcttttaattttcatctttgagtattctaaattaaggagctggatctgtaattgtaacaccttcccccaacaataagtttaactaatgaaaatattcaatggaatgagccattttaatctaaatggggctatttcctgcttttataatgattacagttgcttttcatgacattctactagaagccatcttacattactgttgtaaatctagttattcattaaacgggcacagtaatccctaaattggctcaggttattgtataataaacaacaatactttcttcttcaggagcttgagaagtgatcttgtatttttaaggtgcctaactaacttttcatgggaaactgagtccatgtactgggaagaaagctttttggggaaaatgattagaaaaccaaatgggtctctttatgactgaagtgatgaaccagcaggtgagagtaggtatagatggtacagaggacggaattactgggtattttaatcaggcccacttagtatcacaatttattattctattctatttttattattattttttgagatggagtttcgctcttgtcatccaggctggagtgcagtggcgctatctcagctcactgcaacctccgcctcccgggttcaagagattctcctgcctcagcctcccaagtagctgggattacaggcatgcgccatcacacctggataatttttttgcatttttagtagagatgaggtttctccatgttggtcaggctggtctcgaactcccgatctcaggtgatccgcccgctttggcctctcaaagtgctgggattgcaggtgtgagccatcgcgcctggccagtgtcaggatttattctgtgggaggggaggaggacaaagaaaaatactgagctatgtttgaagctcctgccctctaagagccttagagcagctgacttaaatgtgttcctttgataaactgtagatggttgttgtaactcttctgcaaactgtttatttttaaaaacaatttgatgagattttacttatgcccattgtttgagtacagcatttaccaaagaacaattttggccagatcccatgcagtagaatgcccttggccaaaattttcttgtactataagcaaagaagcagtttggtttttcacttaggcaagactgcctatcagactgagttattgtgacagagccgctgactctctccctttccccattatcaaaatctggcttttctaagcagcgcatgtaaaaagcttggcaaggaggacccttgtcctcctacatattattctttggctcttcttggtaccaagaatacatacaaataatgctggctgtgtactgaatgttgaggtgtgcactgttgaggatattcatcctctaatataacatctagtatttctcacaccttccgtctgctgagcattggtctatcttacttatactacttctaatcctcgtgaactctgcaaaactagtggctttacatctatgagaaaagaaaagaacttttatcggaagaaggtgagtccttttaaagtatcaggcctggaaagacattaaatgagacagcgaacacatcctgctaccctctttgagctatgtattcattgacttttttttttttttttttttttttttgaggcagagttttgctttgtcaccaggctggagtgtagtggtgcaatcttggctcactgcaacctctgcctccggggttcaagtgattctcatgccacagcctcctgagtagctgggattacaggcgcctgccaccttgcctggctagttttggtatttttatttttatttatttattttaagacagggtctcactctgtcacccaggctggagtacagtggcgcgatcttggctcactgcaacctctgcctcccgggttccagcgattctcctgcctcaacctctccagtagctgggattacaggcgccttggcaccacagccagttaattttttgtatttttagtagaaacggggtttcagcatgttggccaggctggtctcgaactcccaacctcaggtaatccgcctgctttggcctcccaaagtgctgggattacgagtgtgagccattgtgccccgcctatgtattcatttcttaaaattggttgctggctaggtgtggtggtacatgcctgtcctataatcacagcactttggaaggccggtgctggaggatctattgaggccaggagtttaagaccagcctgggtgagatcacatctctacaaaaaaaaaaaaaaaaaaaaaaattatctggatgcagtggcacaagcctacatagttgtagctgcttgggaggctgagttgggaggatagcttgagcccaggagtttgagtctgcagtgagctatgattgcgtcactgcactctagcctgggcgacagagtgagacccgtttctaaaacaaagaaattgctattgtcacaattagttataaattaatctaataatgctgcacgcagtaccataatccacaccctatagcttaacgatggatggccaaccactaatcaatgctatttctgtacgccaatgagaattcctgacaaaaaactttgtatcagccccactccctgtctgtcccctcttttgcttttaaaaacctgcttgtaacaaaggccaaacagagctcatatccaaggttacttgggcctgagtctttcaggcagctgtcttcactttggctcaagtaaactctttaatagtttaaattttaagcctctgcctctttcttttaggttgacatctgtttccattttacagatgagaaaactgaggctcagctctgcctcactttacaggtcaggcttaatccctaatccctgcctgcatcatgctgtaaaggacttttgtgtcaaaactgagtttcacactctgtaaagtaaaatagatatattgtagtgagagggtgtagaagagactgttttctgcttctgtggattttttttcttcctgttttgctttgctccaaactttactcatttgcgcttgattcatgtgaaactgaaatttccttctacagaacaaaactttttgggggctacttaccatatcttttcccacaccgtggagctctgactgggaccttttccagtttttggagacattgctccagttctttccctgcctttggtttccagggggcagtaatgtcaccgcaggtgtggacagtagggaccagctaaaggttgctttggaggaggtgggcagggcttttgtttgtgaggtctagaaaccagaggtgaggaaggaggtgtccctggaactccccctggctgcagggctcacagcacacaccatgacaccacaggggtgtgtgtgtgtgtgtgtgtgtgtgtgtgtgtgtgtgtgtgtgtgtgttgaggggagtgttgttgagagccaactatgccaggagatccttggtgacagcggacataggcacagctatgctctgtcaggaatgagttcacccacacccttttcttctgctaccttgtttaactggtgggagggtgtgctgggttgtgtttgctggtgagcccagcaactgcacccttctttccaggcctagcacccagcctttatcagtctcatggccctggcacaagtgggcagcctgcttccaatccaagcaggcagctttccgctcatctgcaggtagcctcgtgctgtggcagcacaaagttgtgtgagccagagctgaacttgtgatccccacgggcatctcctgaggcgcacctctcctgagagagaaagctggtccgtccagcccattcagggctcagcctccccagccgtcgcagggctggcttgctgaaaggtctgggtgttaacacagcactcctgttctctctctctgaaggccctttatgctggcatgaattccttttctcatagagatctgaaagctcttttgactaaatgggtcacctttctgagtattttcataaggctgtcagcctttaccatgccagacaagttttctggaatttcctttccagaaaaaaaaaaaaaaaaggctactaaagaggttggagttatttggaacacagggtggaattctggcattcgaactatagggaaacgggtggggatttgtggcaggcactatgtaaatttgccgcaagcccataaattcagactttaagatgaaagatggcaagcagcagtcagctttccttcaacaggcaggaacggtgctaccttccgcctgtgctgagtgtgactgagggagaggcaggcctcctagggaggccggggcaggaaaggtttcttggtggctaaaataggatttctcagtttcccccgtgtcccaagaaaataagttcttatcatgcttgtaccacacttcttgtgcgtatcaccctggtttccctgcacctccttgaagtggtttatcagattccagggacacaagaatggtttggcatctacagcctattgtgggagcaggggcccggcctggtgcttcttgcccaggaacaaactgattgttcccttggtgtggggtaaagcaggccagagtatgggaccaggccctgcctcccaggggacctgaggtgcaaggtctttgagctgagaccctaaaaggcctttgtgagtctgtagtgctatcagttgagcagagttcagggttctgtttacaagattccctctcagcagaggcagggaggggtacctgctggaagaccaggaatgtgctgctgctgggatgggggccctcggtggagcttctagccatctggaggcagaacccagaatgtgttctgagtgaggcgccttggcagagttggcttgaaagcacctaggcagtggcttgtcacattccttatctccaccaaaggaggcaagctagcacctgggggatggctctcccatcagggagtcctttacaggatgtgatccaggtgtcacattacacttcctgcaggtgtgcacctcttacctaattgtctctcctatccctttttctcagcactattgtctgacatccatggggagtcacacccaaagttgggcatgaggtcctctcctgggcacccaacaccttgtttttttgtttttgttttttttggagatagagtcttgctctgtcacccaggctagagtgcagtggtgccatcacagctcgctgcagcctcgacctccttggctcaagcgatcctcccacctcagcctcccacgtagtcagaattacaggcacacacaccaacactgctggctaattttgtattttttgtagattcggtttgctatgttgcccaggctggtcttgaactcctgggctcaagcgatctgcctgcctcagcctcccaaagtgtggggattacaggcatgagccacctcacttggccacactgccctcttactgagccgtattggtgttctaaatggccttcttactctcccacgggtcatcagtgctccaggggcaggcgctgtgtctcttgtttacctctgtggctctgaccttggcacttaataggaatttaataaataacttgttaaataaacagtctctagtataatagcttgagtattaagactggtacattgacttatttgcaattcagaaaatgcaaaacagtggttctttgctgcctttagtgaagtgggaattatatgtagtagacaactgggtctggggtcccagtggaacacttcgtttttggactgtgatgctgaacttaaagaactcagcagttcatgttcattctctggacatctgtgatttgcttcaacaactgttagagaacaaggccttttccaggtgaagctcagaaaatgaatttaataggaaattactgaaagtcacaatcatagtaacagtttcattagttacagtgaatatagagagagcccatacaaagtaccaggcattgtgataaacgcttcttactaatagctatacaaaacatcattgcaattctgagaagtagttattgttgtaattcccgttatgcagatgagaaaactgaggcacacccagattggccagtgagtgtgtggttattactcagattcttgtctgagattttaatcttcatattttactgctttcccaaggaaagccatcagctcagcaagtctttgaaatttgcttctttttttttttttgagacagagtcttgctgtgtctcccaggctggagtacagtggcgcaatcttggctcactgcaacctccgcctcctgggttcaagcgattctcttgcctcagcctcccgagtagctgggaatatagttgcatgccaccacacctggctattttgtatttttagtagagacggggtttcaccatgttggccagcctggtcctgaactcctgatctcgagatccacctgcctcggcctcctaaagtgctgggatcaggcttgagccaccgaactcggccttttttttttttttttttgaaatgatgtctccttttgttgcccaaactgcagtcttggctcactgcaacttctgcctcctgggttcaagtgattctcctgcctcagcctcccgagtagctgggactacaggcacgtgccaccatgcccagctaatttttgtatttttatagagacaggctaagcttgtcttgaactcctgacctcaagtgatccacctacctggccctcccaaagtgctgggattacaggagtgagcccctgtgcccagcctgaaattcaattctaataaatttttattggagcattaaaaagttacatctgtagttgttactctttgcaaaaaattgcaagaacacagaaaaatataaagaaaaaaatcacctgtgaagaattttaatgaatctttttctacttttaggggattttgcttacagctgccttttaatcagaatagggaagaaagagattcctttctcaggaaaaaagtgactgtggactggaaatgctttgtgaaataattttggtcatactgatggttataacaagattcgtcttcaattgagttattgctgagctttgtccaacattaaaatgaaaggtctcatttgagtctcattgtggtttgcaagtctcccttggtctagaaatatgtttggtcaaccacggcatggaggtgttccagccactttctgtctcttaaaagtttttaggacctacttttattgggactgccagggtctcttaataatagttattatacttggtaactattgtgaccttgtctcataggcagcccagcatagaaactcatttagcttttagttgctcagctccattagctgtttaaacatgtttcagatgtgagcctgacaatgtacttgggcagcttggttcacccttgactgcctgggaactttgagaagtctgaaaattatatgtagccctaaggtcttcatggtattgtttttttggaggcaccatttcccaatagccctgaggacaccaggcccatgaagccatcctgtctcagccaggaggcagaggagatggaatggaaaccacttctggatacagatccagccacttccggagtgcttcagagcatgggtcagatagaccttgctgctttctagctggcagacttggggaaggttgtttgacctctctgagtttgtgtcccagactatagcagtacccccttactggcgttatcgaagataaaatgatataatcctgataaatcacttgacccagtccttggaggtggtggtgggggctggggtaagtgccccatgaatggtggtcatcatgctccccaccaacctcctttctctcttctcctttcccgtctttcacacccctaattcctggacctgggggtggtctctccagactagatgaagaagcaatctaattatctaggaaggtgaaaggtggttgggaatactcccagaaataggccaaagataccgcctcctacctaacagactctttttagaagaagaggcaacctgggtttttggataactgttgagtaggaaccatcatgagtggcatttctgcatttctggtcttctggccaagcctcctttttttttttttttttttttttttttaaccttgagacagtcttgctttgttgccaggctggattgcaatggtgcagtcttggctcactgcaacctccatctcccaggttcaagcgattctcctgcctcagcctcctgagtagctggtactacaggtgccgccactatgcccagctaatttttgtatttttagtagggacggggtttcatcatattggccaggatggtctcaatctcttgacctcatactctgcccgcctcggcctcccaaagtgccagaattacaagcgtgagccactgagcccagccttccttttttttttttttttttaagtagctccattgccctccctcaccctttcttttgtctcctgtaatgtccttcccttccatttcttttttttcttttttcttttcttctttctttctttcttttttttttttttgagataggatctcattctgtggcaaaggctggagtgtagtggcacattcacggctcattgcagcctcgacctccaggactcaggtgatcctcacatctcagcctcccgagtagctgggaccacaggcacacaccaccacacccggctaatttttgcattttttgtagaggtagtgttttgccatgtttcccaggctggtcttgagctcctgggctcaagtgatactccctcctcagcctcccaaattgctgagattacaggcataagcctctgcacctggccttccctctcatttttttttctttcctggttttgcctgtcccagaccaccctcttggaaagatgctctcccagcagcggcagtaaggtcctggtcttgtgtttgctcctgggcctgagtcttggctttgctgctttgtagctagctggctgacaccagggagctgcttccctccaggagcctgtcgtccatatgctgaatgtgatccttaaatgctctgtcttacaggggccagacattgtggctcatgcacttcagggggctgaggcgtgcagatcacttgaggccaggagtttgagaccagcctggccaacatggcgaaaccctgtctctactaaaaatacaaaaattagccggaggtggtagtgtgtgcctttaattccagctacttggaaggctgaggcaggaaaatcgctagaacctgggaggcggaggttgcagtgagccgagatcatgccactgcactccagcctgatcaacagagcgagattgtctcaaacaaacaaacaaaaaatgttctgccttacagagttcttaggtataaaagagaaggtgcctctaaagctcttggcaccgtgcctggcttatagtaagtgcttggtaaacgtcagctgctgctgttgtggtgttagtatcagcattgttgctgtgagaccctgcacttcccacttagccttggaaaaataagtcttcacgttaatgccatgggctaccgcttctcttttcagggcttcttggaggagggtggagatggagagacaggtgggggactgccagggttacatcctccatgaggctgaggctgtgctgactgccttgtgtgctttcaacctggagtaaagggtggctgtgccagctgctcccatcccccaggagtctgactcgtccctgccttggccctgggcagcactttccctcctagctctttggcatctggggtcatggtggggctgcctgccatctgtcaaaatttttgctgccctgggtgtggtggtaaacccccgcactatccaacttggtgtcatggagctggcgacaatatttttacagtggttagtgcttggaaactggacttctgggttatgccctgtacaaacagcatcaaagtcgctgggctagggtgacagaggaggctgccaacagggaattctgtggctcctgggacaggaatggatatgggaggttgggggccagtattttcggttctcttgaggagttggcgagtattagtctttgccctgatggatagaaggaatctgtctgtgtcttgcatgaaccgtgtacttcccccagttactccttggacaccagctgcctgctgttcataattgggccagatttctaatactgcagcgctaccaaatgtcagttttaggccatctctggtgtagccagggaacgcccaacacctttcccaaaggtagaatttgtgtgggttttacttcactgagtgactaatgcagatctttatgttttaatgatgggaagaaattcgtcagcctgggtactttttccatgtgatggggcaaaaatttaaaacacttgcacaacggcttttgtttctccagctactaaaggtgactgtcatttaggcattatcagtatgatcagctgatgttaacccactccccttctggagacccgtttctgtttctgggaaaggtgtaggacatgctggatttggcaagattgcaggtcccaggcagatgtccggacttagactctggctcttttttttttttccagacagggtctccctctgtcacccagtctggagtgcagtggcgcgatctcggctcaccacaacctccgcctcccaggttcaagggattctcctgcctcagccccctgagtagctgggattacaggcgtgcaccactatgcccagctaattctttttttttttttgagatagaggctcactgtcacccaggttggagtgcggtggcccggtccgcctgcctcagcctcccaaagtgttaggattacaggtgtgagccaccgtgcctggcctcagctaacttttgtatttttagtatcaacgaggtttcaccatgttggccaggctggctttgaattcctggcctcaattgatctgcccacctcggcctcccaaagtgctgggattacaggcatgagccaccgcgcctggcccagaccctggctcttactcctaggtctacctctaccatcactggggccctcgcctgaaccttttgccccatctataaaatgggagaactagactaggtctgtgtcccccaagcttcaatcatttgtaaaggaaccacctttactattttgccatatcccacggctgtctctatttcatttttcacttaatattattttcccctgcagttgactcacttgtaaaacaaatgtatttgaaaaggagactttgtgtcactataataacggaaaaacagcgtcactaggtaaatggaaggtaaccataaataaaccccaaacagttattaaattccagccagcactgttgcctgttcacaacatgaggcatactctcttttggttaaaaagggaaattagcaagagatggagaggtgttgaaggtaacctagcactacattgagccttttccttgacctgctcaggaggattgagaaagaactaggagaactgggaagagaataacgtctttttgtgatgcaaagtgcctgagtgtgaccaagagctcagagtagtaatgtatagatgctttgtttggatacttatgcagccattaccatgtgccaggggtgtagaggggctaggagtatagaggggattgggacttgttcactgacttctggttgcttgtggtctagtagtggggaggtggtcatagaatattgaatacaaacgaagatcgaacaggctgcaggggtttaataggaaaatcacaggactaaattctgtcatgtgtacatggggtctacaaataagagttgtttagaattttttttaatttaaatttcccatgaaatataaatctatttcattccagaatgattctagagaagctctaaatacattaaagttgtgttggctgggtgcagtggctcatgcctgtaatcccagcactttgggaggctgaggctggagaatcacttgtggccaggagtttgagaccagcctgggcaacatgggagaccttatctctaccaaaaaaaatttttttttcttttcttttttttttttttgagacaaagtttcgctcttgttgcccaggctagagtgcaatggcatgatctcagctcactgcaacctccgcctccctggttcaagcaattctcctgcctcagcctcccaagtagctgggattacaggcatgtaccaccacacccagctaattttgtattttttttagtggaggtgggatttcaccatgtcgatcaggctggtcttgaactcctgacctcaggtgatccacccatctcagtctcacaaagtgttgggattacaggcgatagccactgcacctggccaaaaacattttaataaattagctgggtatggtggtatgtgcctgtaatcctagctacttgggaggctggggcaggaggatcccttgagcccaggaattccaagctgcagtgaactataatcaggtcactgcactgaagccggagtgacagagtgagaccttgtctcttaaaataaatttgtgtcattgtttgttgtttttatggtgttatgacaatgatccatcttaaccctttatgtagtggtaactaactttctcttttcctaaaagctgatttgagttttaggttctcttggagtctgtgacaattgtaaatagataagatataacaaaatggcctgaaatactcttgcaacactcatatttcccccctcagattagcatgttctatactctctgcaaagcaagatatacaccagaattaggcctctaaaaagcctcatactgctaatctctgggaatgaatggtgttctttgggataatgggatatgaagctcagtctgatttttctgttctgctggtagcttagggccccctttcttctgttgggttttttgggagaagggaagttgtgattaagaatgagaattctttttttttttttttgtctcaagagtcttgctctgtcgcccaggctggagtgcaatggctcgatctcggctcactgcagtcttcacctcctggtgtcaagcgattctcctgccttagcctccaagtagctgggaatacaggcacctgccaccatgcctggctaattttttgtatttttagtaaagatggggtttcaccatgttggccaggctggtctcgaactactgaccccatgatcccaacccccccgacctccccggcctcccaaagtgctgggattataggggggagccactgcgtccagccaagaatgagaatttgggagtcaggcacctctgggattgaatctggaattgactgagtgtacatgctttctctgaggcctccgtcctcactgctctcatctataaactgggaataatcatagtttctatctgaaacagtgggtgtgaagatttaacgagctaaattgtaaagtgcctgagacatgggaagaagtcaggatgtgctaatgggtaatcttacacttccccaatggaaagggccaggtttatattactctaggctggtagtaagcgaggcaaaggagatatcaggtttcagctttgttagaacatgctaatggcaccaggacactcagaagagatacagagtttgagacaaatggcaccatgagccctgagacattgtgtatggggtgaatcggatagcaagaatagacttcaaggagggaagtagggcagttagaatcctttcagctgcaaggaactgaaaactggctcacatagaaggaaaatgattggctcatgtcagcaagcctagatgcagagcaagttatgggtttcagggatccagcatctaaatgatgtcatcaagaacccaagttttttgggtctctgctctgttggtttctttcatcctaaagctggttctcctgtggtttaccatagtagagttcctgtgagaactccactctgaccaatcaggccttcccagagccagggatggatggagtcgcttcttttgaggcccatgggtcctatctggaggggatggatccagactcctatcaggaatctaggaggggccgggcacggtggctcatgcctgtaatcccagcacttcataatgccaaggtggacagatcacttgaggccaggagttccagatcagcctggccagtatggtgaaaccccatctctactaaaaatacaaaaattagctaggcgtggtagcaggcgcctgttgtcccagctactcgggtggctgaggtgggaggatcacttgagcctgggcacagaggttgcggtgaggttgtggtgagctgtggttgcgctgctgccctccagcctgggcaacagagtgagaccctgtctcaaaaacaacaacaacaaaatcttatgtaccccataaatatatacacctactgtgtatccacaaaagttaaaaattagaaaaggcaaattgcagagatttccatatgctatgataccgtttatatgaagttttacatatgtcataaaaatacagataacctttaggggaatgatcattaccaaacttttggataacggtttctggggatgggcagagagggctatacagtcatgaagaggtgtataggggctttcaactctttgtagtgttttatttcttcagtcccatggtggttatatgattcttcactcccctttttttgtgtggaatatttttcttataaaaagtgtgtcttttatttatttatttatctttttcacatggagtctcactctgtcgcccaggctggagtgcagtgttgcgatctcggctcactgcaagctccgcctcccgggttcgcgccattctcctgcctcagcctcccgagtagctgggactacaggcgcccgccaccacgcctggctaattttttgtatttttagcagagacggggtttcactgtgttagccaggatggtctcaatctgctgaccttgtgatctgcctgcctcggcctcccaaagtgctaggggattacagacgtgagccaccgtgccctgcctttttttttttttttttttttttttaaaggcagagtcttgccctgttggccaggctgcagtgcagtggcctgataatggctcactgcagcttccacctcccaggctcaagcaatcctcccacctcagcctcctgagtagctgggactacaggtatgtgccaccaagcctggctaatttttccatttttaaaggttttgccatgttgcccaggctggtctcgaacccctgggttcaagccatcctcccaccttggcctcccaaattgctgggactatagacgtgaaccactgcacccccatccaaaagtgtcattttaatgctgacatactgcattactaagcttgaccaggggaagagaaaaaaaaataccttgtgtttattattttgtttgtttgtttgtttgagacagggtcttgctctttctcccaggctagagtgcagtggcatgaacatggctcactgcagcctccacttcccagggtcaagccatcctcccacttcagcctcccaagtagctgggattacaggtgtgtgccaccacacctgactaatttttctttttttctttttttgtatttttggtagagacagggttgcccaggctggtcttgaactcctgagctcaagcaatcctctcttcagcctcccaaagtgctgggattacaagtatgagccactgtgcccggcctgtttgtttgttttaaagacaagtttgggcccagtttataagaaaagaaaacagaccatccttagggtgtcaggatgatattttgacaaaggcattcatgcttagcaggatttctctccccctacccccaccccaagtgttgaaacggctgagctaattaccttagaatgtaaggcttcctctgttgcttgtgaacgtggcagacttgggattctcagagacagagggcttcagaagcttgcctctgggagcgtccagtcaatagctttttgtctgagcagaaggagatattgctcaaggtaccatctcaagggactgctgaatcagttgcattgtctctaaaagtaggtaaaagtctagagtagggctggttcaacagtggaatgagtgttaagagagagttgcattctaagaacacctttacactgtggccaaattcaagcaggtccattttgtggtttggtggtccccatctagtgggatgtggtctggtatcccaggcacctgcatatatgagctcagatgggtttaatttttgaaaaactgctttattggctgggtgtggtagctcatgcctgtaatcccaacattttgggaggccaaggcaggaggatctcttgagcctgggaattcaggaccagcctgggcaacattgagagatccccatctctactcccttccccgccaaaaaaaagctaggtgtagtgacatgcacctgtggtcccagctactcaggaggctgaggtgggaggattgcttgagcccgggaagtcaagactgcagtgagctgagattgcatgactgcactccagcctgggcaaaagagtgagacattgtctcaatctccccacccctgccaagaaaacccaaaaaatattgaggtataattgttatacaatgaagaacacattttgattagcttatacacacactcctgtgtacacatgtacactcacacatcaggaaaccatcaccataatcaagacagcgaacctccctatccagccccagaagtttccttgtgcctctttgtaattcttgccttttatctctccatgtcttccacacccatgctcaagcattcactgatctgctttctgtcattatcagtcagttttcatcttttagccttttatataaatggaatcatatagtatgctgttttgtttttttttgagacaagagtctcactctgttacccaggctggagtgcagtggtgcgacctcggctcactacaacctccatctccccagatttaagtgattctcctgccctagcttcccgagtagcagggattacaggcacatgctatcatgcctagctaatttttgtatttttagtaaagatggggattcaccatgttggccaggctggtcccgaactcctgacctcaggtgatcacccgccttggcctcccaaagtgctaggatcacaggcatgagccactacgccctgccagtatgtactctttttgtctggcttcttctagcatagttattctgaaattcatccttgttgcatgtgtcaatagtcctattcctttttattgctgagtagtagtccattgtatggatatactacattttgtttatacatccttctgttgataacatttgggtggtttcttatttatttatttatttttgagacggagtctcactctgttgaacaggctggagtgcagtggtgtgatcttggctcactgcaacctccacctcccgggttcaagcaattctcctgcctcagccttctgagtagctgggattacaggcatttgccaccacacctggctaatttttgtatttttagtagagacggggtttcaccatgttggtcatgctggtctcgaactcctgaccttaggcgatccgctcacctctgcctcccaaagtgcagggattataggtgtgagccaccacgcctggccgggtggtttctaaataaagctatcatgaacatcttttactactctttgtatggatgtatatttctatttttctgagtggaatgttaggatcatacatcataggtgtacgtttaactgttcaagaaactgccaaactgtttcccaaagtggttgtattgttttacatttccacgagcagtgtttgagagctccagttcttgcacatcctagccacaaaaaggttctgttttttaaagacaatttttttttttttttgagagtttcgccctagtcgcccaggctggagtgcagtggtaagcgaatccctgctacaggccagagactgttctcagttggtttttacaccaagtatcgcacttcattctaacactccaccattttacaaatgaggaaaccgaggcactgagaggtttagtaacttgtggcacagccaggaagcagtagagaaagactttgaatataaatgtatccattaggatgtatatggttccaagtcatgggaaacctacctaatcctggtttatccaaaaagggagctcattggctctcgtaactgaaaagtcaaggggtaggcaggcagttggacctggaagtctccagggcatcagagagccttggctctgcttctctgattctgttgtctctccacagacgggtgggtgtagcagtcccaggcccgcagccacaccccacacctcccagaggaagaaggcgggccctgatcccagcagtcccaggaaagccctgaggttcactgtgattggaccagcctatgtcacctgctcacatctcagcccaccactggcaagggtgtttgactcttgggaatgactcttgggactggcttgtcctagatcacatgttctacctgaaattggggacattgcagaggattggtggagtggacctcaaggaggtgtttcacgtggcttcctgtgtcactaggttgccatttattctttagaaagcccctttgtttgatgaaaccctggtgtcacaggctgtgtgacttagggtaatccccttgtccacatctgtgaagtgagattacctcttcacctcacaggcagatcaaacaggaaaacaaaaacaaaaccaaacccaaaatacacgtaaattgcagagtgcttgaggtttcttttaagctgtctatgtaattaaaagctgttacttagacttggatatgaaataaaatctgacttcaaatttaagtggtgtaatttccatgcctcttaaaatatcaggtaacttcatttgtgagcctcagtctgtagacttgagggatttccatctgaagagggggcagaatggtggtttagggaacgcaacatgtaccccacccccaacttttttaagaggaagagttgaaagaaataatgaatgtgtgagaaataaggggtttgattgccttccagggtccatgttgaaggagaggaaaatgtagctcaaccacagtgactctccccaattaaaaactaaaaaaagatccgtggttatagggcttggacttcggacaagccagcagcctcagtcattgtgagtgtgattccagattggaaggttctgctaggaggaaagtggaagttttgagaattcctagttggacagaatgcctcttgatcacggccttagctaaaggagaccactctttgctggatggatcagtcagctacgtgtgaagtttggctcagtacaacattctcggcctggggcggcagcatgggaaagatttttattggaattaactttctacagagatgtactttcaaatgagaccatccttctctcactggtgagctcacccgggctcttattccacaaagcttaattgttttggacccatacatttaaactccttaattaattgactcaagacttaggacagatttgcttttctttataatgactccatggctgtaaatgctgctgattcagatgaaagaggaccctagagcacagaatgagaaggacgtggactcaggatacctgtttctttattctgactgtgctcttcgtcagctctggggctttggaccccagttttgtaaccacctaacgagttcaccttgcctgctgcctagacggagctgatttatcaagacagaggaattgcaatggagaaagagtaagtcacccagagccagctgtgtgggaggctagaattttattgttactgaaatcagtctcccgagcatttgggatcagagtttttaaagataattcggcaggtaggggctcaggaagtggggagtgctgattggtcaagttggagatggagtcacagggggtcgaagtgacgttttcttgctgtcttctgttcctgggtgggatggcagaactggttgagccagattaccgctctgggaggtgtcagctgatccatggagtgcagggtctgcaaactatctcaagcactgatgttaagttttacagtagtgatgttatctccagaagcaatttgtggaggttcagactcttgcagtttctgacccctaaaccttaatttctaatcttgtagctaatttgttagtcctacaaaggcagactgctcccaaggcaagaagagggtctttttgggaaagggctattagcagttttttttcagagtgaaaccataaactaaattcattcccaaggttagtttggcctatgcccaggaatgaacaaggacagcctaaaggttagaagcaagatggagtcggttaggtctgacctctttcactgtctataatttttgcaaaggcagtttcagtttctcacctgtaaacgttgaagactgagccagaatcagggtcatcaaatagcaccccggctatactttcttctcttcatgacaaacattgctggtcagttgatatgatgttctttcccactgggcccagacttgacattagagtcttttttttttttttttttttttttttgagacagtctcgctctatcaccctggctggagtgcagtggcaccatctcagctcactgcaacctccgtctccagagttcaagcaattctcctgcctcagcctctcaggtagctgggattacaggagtgcaccaccacacccagcagatttttgtatttttagtagagacggggtttcgccatgttggccaggcttgtctggaactcctgacctcaggccatccgctcgctttggcctcccaaagtgctaggattataggcgtaagccaccacgcctggccgacatcagagtcattttagcctgcaatgcaagttgtcctcagtgggctgctagcattggcttcaaccttcatatcagccagctaaagccccttgtaatgaatggggaggttccttcacccttgcctcccgctgcctcctcttgaccactcattttttttcttgtagttcaggaaccaattcagatgatttccctcgtgaagtcctctcgaaagcccccaggtagaattattcattttttcccttgcattcccacagcactgtgcacacaaattagaatccttgtaaaatggccatgattctgtttatgaccctggccctccaccagaccagcctctctgccctctggcttttttagatcactggcatggtttctgcctactccaggtgccagtattattttgtgaatgttttttttcttcatatctactcatctttatactactttactcgtaaaaggaaactagagaacatgatcttaaatgaaaaccacgatcacttgccagaaagaacaggtaactaggctttgaaaaaataagttagaggagatagcataagaaaaaattaaaaaataaataaaatcaatgaaaacaacgtgttactaaattcttgaaaagttttttgaagactttgagcctgaggcctgttcttattgtttgtttgtttgtttgtttgtttgtttttatgacagagtttcgctcttgttgcccaggctagagtgcaatggcatgatctcggctcattgcagcatttgcctcctgtgttcaagcgattctcctgcctcagcctcccgagtagctgggattacaggtgcccgccaccatgcccagctaatttttgtattttagtagagatgggtttttgccatgttggccaggctggtctcgaactcctgacctcaggtgatccacctgccttggcctcccaaagtgtggggattacaggcgtgagccaccatgctcggcctgttcttattgttaaaaagagagatttgtgtgaaagctgctgacgtctttttggcaccaagtcaagactgagttagttcttgtcagaatctgattgtttgtgaattgatggcttttttttttttcctgagttgggggtctcgctctgttgcccaggctggagtacgaccactataacctcaaattgctgggctcaagcaatccttccgcctcagctgcccaagtagctgggactactaggcatgctccaccatgcccagttaattaatttttttttttttttgagagacagggtctcactatgttccccaggctggtctcaaattcctggcctcaagtgatctcctgcctcagcctcccaaagctctgggattacaggagcgagccactgtgcctggccggattttaaagttctgcccatgcacctccttagctctggcagttactacttgcaggcatctcctttgtctgccctgccccttgttaggaaaggctgtgctgactgtcagctggcacccagtgcatagaagagatagttctctgtagatgatgttgaacaatgtggtactataatcccaacctgttgtatctttgtttactctcaaaagcaacaattgggctgggcatggtggctcatgcctgtaatcgcagcactttgggaggctaaggtgggagggttgcttgaagttagttcctttttttttttttttttaaaaaaaagacaagatctcgctctgtcaccccggctggaatgcagtggcatgatcatagctcactgcagccttgaccacgtgggctcaaggaatgaaccattgtgccaggagttcaacaccagcctggataacatagcgagaccctgtctctacaggaaaaaaaaaaaaaaagaagaattgcataagtatcatcagaactgttgaatggaaaatcagactttgtgggtttggtttgttaattacttctcgttggattagaatttgataggtaaaaaaaaaaaaaaaggtgtagaaaagtgattccagtcttgagcaaatttttaatggaaaacggtgtcttggttctctgttcactacaacttgtatctaagggaaagcctagtgatgcagacatttcatttcgtgatgggaaaactgatgcccagaggttcacagctgaccaggggctagtctgactggggggatctaggtcaccaccccccttgccttgttttcccagctagtgcatttcctactagacttgactctactgtaattcaagttgctgagtagcaaacaagaactacaatgactagaaggaacagaactagcttttttgtgctctgaaagtggaaacttattgagggttcttttcctcccagagaatgcagaagtgccctgatttgcttttggaaggacaccattcactttattgcctcttttcattgttgcccagaatatcaccatgatttattcatgggtggtggggagggtagcactagtgtatgctcccagcaaagaggaacatctcacgttgtgaagagatgcgcaaaactaagccagggcagggtgtggtggctcatgcctgtaatcccagcactttgggaagctgaggtgggcagatcacctgaggtcaagagttgaagaccaccctggccaacatggtgaaactctgtctgtactaaaaatacaaaaattagctgggtctgattgcaggtgcctctaattgcagctacttgggaggctgaggcaggagaatttcttgaacctgggaggcagaggttgcagtgagctgagactgtgccgttgtactctagcctgggcaacaagagccatctcaaaaaaagaagcaagccagatctttggggtgctgtgacggcaaatcccccagcgctggcctctcaggttctcttgcgggattagtgtttgttgaataataagcaatacaccctgacccagcgagccaaagcaaacaggacagtaactgaaactgcaggggagtgtgagtaaacagttaccttctaccctcatggagctggcctctggccagcaacatgatagctgtttgcatcttactcttatggagccattggccctctcattaaggtgggggcagcttctggtccatgcctgcaagtcctcatgggagtgggtacctgacagggtgtaaagggtaggtctgaggacatggtttcttttttttattgttgttgagatggaatcctgctcttgtcacacagtctggagtgcagtggcctgatctcggctcactgcaacctccgtctcactggttcaagcgattctcctgcctaagcctcctgagtagctgggactataggcgcatcctgccatgcctggctaagttttgtatttttagtagagacggggtttcaccacgttggccaggctggtctcgaactcctgacctcaggtgatccacccacctcagcctcccaaagtgctgggattacaggcgtgagccaccgtccccagccaacatggtttctttaaaatatactccccgctccatcccattcatgtgtgggagttgagctgcatctgggtttttcttttctctttttctgtaaatctttattgtattttttttggatcatagaatggatacatgtttcttaaagtttgatcattatagaaacttaattagactattatttgagtgctaaccatagtgagtgagtgcttactgtgtgctaggtggctttttatgcctcatgtcacttacatgaggtctgaggaacggtgttaatcccgttttgcagctgaggaaactgaggctacatttacggtcacctagctggcaagcaagtggctgagcctggagcagcagcagatctggggaactccacaaaccagatttctgtgtggtatccctgtggacacaaggatttaacttgattctttttgctttcagtatcactttatgatattacaatgagcttgcagtatttattttcagaagaaaagccagattattcccatttatgagagaagcagccaggtgggcagggatttccagcgctgaaccagccagtgtgtgcattgtctcttcccgctgagcggccctggtgtgctgggttagtctgtgagccacaggaaatgttgtcagggcctctgggcttttggatgtcagcaggccttcagtggtgaggaggttgtggctggactcagaggactccttgcttttgctgaacgaccctccccaccaaccaccaccaccaccaccagtgggactagcccatgagctgtaagccaaccttttccttcctaacttaattttccaaagaatagtaacttacccaccaccactgcagtcactgggccgggaagacaagcactcttgccttgaatccatgccttgagccagtagccttgacccagggtaaagcagttatgtgcttgggtcacctgggtcatgtttttgaaattgcctcaagcctaccttacaaatccttcctggaaccctgcttggcttttctttgtgggcttcccttaggagggaagcttcccgagcagcttgtcttgactgtagccagctgggtggtcccagccacagaatttaactgtcaaacagcaccagaagggttcctcatccagctgtcttgccccaagtgccctctttgctttctttttagagagttctgagactcattagagagtttagagattttagcattcttgaagttctttctgtggtcagtttggtgaaccacttcatttctaaagtttctcagttgaccccattcttccccagctttgcattctccatgaagccacctgtgtttggtgtgtatgggttttctgcaacctaggttgaacaagtcctctagaatcctgaacaattggtgattcatgctggcctggtttttctaattggcctggaaatgtggctgtagtggacacaagtggacttggcctcctctttgatgcgggtaaactttagatttgcattagctctgtttgattagaggatcttactggtttttgttgttatttatttaccttttaggagctttagtctctgtaggtttttttttttttttttttaaagtccgggtcttactctgtcacccaggctagggtgcagtggcatgatcacagctcactgcagcccccaccttcctgggctcaggtgatcctgccaccttagtttcctgagtagctgggactacaggcatgtgccaccatgcccagcaaatttatttctactttttgaaaacagggtctcactttgtcacccaggccagaatgcagtagcacgatcatggctcactgcagtctcaacctcccaggcttaagggattctcccacctcagcctcccaagtagctgggaggctacttggcatgcatcacaaggcccagctaatttgtgttttttcttgtagaggcggggttttgccatgttgcccaggctggtctcgaactcctggggtcaagttatactctctcctttgcctccagccatgagccgttcgttgcgcctgggctagtcattatagatttatcccttctttcatctcatgctacaaaagcagttcttgtatttttacccgacttgtgattttctactgggaatgtttgtttgtgatggttagcagggtgctgagagggaattaatcccaggaggcccaatattgggccatgtcgtgctgttgagcacagtcatttgacacctataacttctcatcaattcttctgatagactgaggaggaattgggaaatttcctagagttttgtctgcattattgggttgttttgagaacataaaccttaaactctagctatgtaaactggataagtcattttggtaatttggcattcctttttttttttttttttttttttgagacagagtttcactctgttgcccgggggaatgatctctgctcactgcaacctctgcctcccaggttcaagcaattcttctgcctcagcctcccaagtagttgggactacaggcacactccaccgtgtccggctaatttttgtatttttaatagagacaggatttcatcatgttgaccaggctggtaatttggcattcttttgagtacaagtgagagaaactcacttgagctggcttaagtgaaaaaattctttgtcaggagagttttgtgaatttctgtttagtggcaagttgtagaaaccacttgaaactgcttaaaggcaaaagagggagccacttgtcccagtaactgagacatcccagagccgactgcccccaagcattacttggtcccaagtttcaaacgggtcttcagggtttgatctctctcctcatctccagtctgcttcattcattttggctctatgtggtggcagaagggcttctggcatctctggacctttatgcctcccaggtccaaacccagccagaaaggagagtgagagtgctgagtgcaaaactctcctatagctcctatacaagtccaggatttgctattagactccttgaattatgtgcccagctctgagccaatggctgtgcttaggaggctcctgtctcatgcacccaccccagtactgggcatcagaaacaaccagtgatccctataatgaaccacgggttcacagacttaagtgtaatcctgcagcagggcctcaggaagacttgaaacccaaaatcagaaagccatggtttcttgtcttcctggtgtctgttttgtcccttccctctgtagaggagtcctgctatcactgcaggcaacggggctgccctgcagctcctgctgtttacatttcactcggtgtagccataggcagagacctcagggagaacctgattcggcttggattgagtcaggttccaccccagtccagtcagttgtggactgagaggtgatgaggctgggccctttaagacaaatctgggtgggtggagtctgtgcttaatgaagttgtgatgttagctgatggcccagaagggactggtaggtgcctctcattgtctggttgggaagcattctcttaagtccaagatgatgataaatagtattaggccaggtgccgtgtcatgcctctatacccagcactttgagaggccaaggtgggaggatcgcttgagcccagaagttcaaagccagagtgggcaacataaagagaccctgtctctacaaaaaacaaacaaacaaacaaaccaaaaaaaccccacaacaattagccaggcatgatggcgcacaccagtagtcccagctactcaggaggctgaggtgggaggattgcttgagcctggcgggtcgaggttgcagcaagctgtgatcacacctctgcgctccagcctgggtgacagagtgagaccctgtctcaaaaagtaaaaaattcaaataaataaacaaataatatcaagggcctctctcccaagctaggaagatatcagctgaagctctagcccagctacgtggatggctgcttcctgcctggaagcgatgcccagatcagcaccttgggacccccctgaacttgcctctgctccagtgtgggcccttccttcctgcagaggagacagcactgtctgagaggcatgaatgagaatttcctccttctaggcccaagtcagcatgactcgaggatggctttgactggaaaaactgaatcaaagagtgtgctacagccaaggatttccccaaacactaatcagtgctgattacttccagggtattgcctttggctctgtggagttttgtccactgtggctgcaatgtctggcttctgctgcccagaagatgagaaatgagtttgtagggatgagcctgggtgaagggatgtgccccctcaccatcctgacctctattaggtgtaaaagaccctgattgccaaattcataggtcatgggttggctctgcctccagcattaacacttgggggtggagttggggaatcatagtattacttgcataaatggaatcctaaaagtttgttgggacagtttcataaaaatcctcaccatgatcagtttgaaaatgacgttcccttcacatgtttgtcttctgaactgagttgcaatgctgagtatgagtttgagagtcccaagaccatctaaagcaagcctgtccaacccacagactgcaggctgtaggcagcccaggacagctctgaatgcgccccaacacaaattcgtaaactttcttaaaacattatgagatcctttcgcatttgttttttaaagctcatcagctatcattagtgttagtgtatcttatgtggccaagacaattcttcttcttccagtgtggcccagggaagccaagagattggacacccccgatttaaaggaagtaactcaattttgtgaacctgaaacttgatcttggatgaaccaaatgaaattttatgattctcttaagctcacgaaagttcaataactgtgctgtgtaaaatagaggtaaaagacttgagttggaccaggaatggttgctcatgcctgtaatcccagcactctgggaggctgaggcgggtgcatcacttgaagtcaggagttcaagaccagcccggccaacatggtgaaaccctgtttctactaaaaatataaaaattagccgggcgtggtagtgtacgcctgtagtcttagcttcttgggaggctgaggcaggataatcccttgaacccaggaggtggaggttgcagtgagcaagatcataccactgcactacagcctgggctacagagcgagactccgtctccaaaaaaaaaaaaaaaaaaaaaaaaagacttgagttggttctaatagaataccttggagaacctcaagatgccttctggtccagccaggtttacagattggaagatattctgttaatcagaatctcagagagggacaggccctgatcaaggtaacacagtgagttgtggtagctgggctgggctagaacctgggcctccttggttccaggtcacagggaccaagggatttggcttgtcttagtcctacttgtaactacaatactgccttctgctaggaagaataagagcttgcaggctagaggaatttataggaattttctttctttaaaaaaatccccccaaaaccagctttactgagatataactcacacaccataaaattcacccttttaaagtatgcaatttttagtatattcacagaattatgcaactatcatcactataattttagaattgtttttttttttttggagacggagtcttactcttgcccaggctggagtgcagtggtgcagtcttggctcactgcaacctccatctcccaggttcaagcgattctccttcctcagccttccgagtagctgggattataggtgcatgccaccacacccaactaatttttgtatttttagtagacatggggtttcaccattttggtcaggctggtctcaaactccgcctgccttggcctcccaaagtgttgggattacaggtgtgagccactgtgcctggccaattttagaatatttttattgcctcagaagaacccctgtatccattagcagtcactctccctttcccttccccaaccaggcccaataaaccactaatctactctgtctctatggatctgtccattcagaacatttcatatggtaaaatcatacacgtgttctggtgttactgacttctttcacttagcagaatgttttcaaggttcagccatgttatgtctgtactttattcttttttacggccaagtgttggaatgtgtaggatttgaattttcaaataaagctttaaagttttcagatttatttttactttgcctggtgtgttttttcctggaaagccaacttctacatttggagattaaaagacaaactttctcaaactccctgtacctaagtggttgctgcttttcttaaatgttttgacaccaaagagaaaaattggtttctggaagaaagtgtgttttcttttattgccaagaaaattagtgcatgttaattaatatagatgctcaggacccagagttgtaatgaacttttttcttatatttattttctagatgtttgacttattttaacagttttcattttagcaataatgtttccttcccactcccaaatttattggaaaccctcaatcaaccctatttatttatttattttagagatgggatctcactatgttgtccaggctggtctggaaaccctcactcttatagatagtatgaaagaagattatagccaactcttatataaccttccccagagcctccaattgttaatgttttgccatatttgcttgctctatcacttgctctaaagatgcatatcacacactttttttttttttaatttatttttgagacagagtctggctctgtcgcccaggctgtagtgcagtggcatgatcttggcttactgcatcctctgcctcctgggttcaagcgattctcctgccttagtctcctgagtagctgggattacaggcacgggccaccatgcccagctaatttttgtatttttagtagagatggggttggccaagctggtcgtgaactattgacctcaagtgatcctcctgcctcagcctcccaaagtgctaggattacaggagtgagccaccatgcctggccacatgcgtgttttttattgaatcatttgaaagtactcagctcgtatcatgacccttcacccccacatactccaacaagcatctctaagaaaaaggacattctcctaaccacagtgtctctgcattcccaggacattcttctaaccacagcgtcactgcatacccaagaggttagcaccgatacagtaataacatcttgtgtaaaacttcccaaaatgctcccaagtgtcctttatgacagtttaaaaaaaaatggcattttttgggatccaggaaccaattaacgattactcaattgaatttggtttcaaagtcacatacctcaacttttcctttaatcaagaacagcccccctgccttttacacatttttttgtctttcgtgaccgtgtcatttttgaagaaatcaggcccgttgtcttgtagaactggtgtttctcaagtgtgcttgggagggtcttggtaaaatgcacattctgattctggagaacagggtggagcctgggaatctgcatttccagccagcatcccggtgatgccagtgcagctggtcttcggctgtagaatgttccacattctaggtctgtctgtttccttgtgattaaattcaagttgaatatttttggctagggcacttcctgaggtcataggtacttcccactgcctcacagcacaggctcacaatctcagtttgtcctgttacttcgtggtgctaagtgtggtcacctgcttcaagtggtgtccgcctgctctctgttgaaacaatacctttctcctagtataatgattaggtaacctgtgattgtaattggtaagtaatctttgagactacatgaatatcctgttccccagcagttttcactcattggtgaactgttttgggaaaaataatagcatcttacagttataataccctgctggtaacacatggctcttacataatcagcagttaattgtttgtatgtgtgttaatttttatttttaaaatgtaactagtgactggtaactctcatttgtattttaaacattggcttttacagcttctcagtacatttcactctgtgtatgtttttggtagagcatttgttgtcctgtataatggtttaggaaatcctataggccaaatgaagggctggagactcacctgtgttcccaccactgtgtttcactgtgtattgccagagaaaatacagttaaatttgaatttcagatagacaatgaataactttttagtataagtatgttccaagtgtggcagacagctctcacaagttacaagtcgttgcgtaggacatacctatgctaaacgatttgatgtttatctaaattaatatgtaactgatatcttgtatttttatttgtacgatcttccaagcccacgtcccaccgccttctcggggatggccaccatttgtgtttgctgcctggtggtgtttgcagctgcgagaagggccttggaggaggagcaaagtgtagtggtatctccgtgctgtggccttgggcactggggtgggggttagatgagtaattagctgaatatgacctcacccatgaagaatgtgcccttgctaggtattagcagaggtttaggctccagggagccattgtcagaagcttgtcagtgatgtcatcagctggaagggccagctttcaggcctcaggaaaaagcttgaaagtcagggctccagttttggtaataaatgggaatggagtttcacaggtagggtgtggaggaatttattgtgacaggaagcctgatggagcctcttgcctgtgtgcagcccccagccaggtttctgagttctgatgaactaccagaaacttccaccacggcctgtgattacactgttggcccaatgccctggaaaaattggcttgctctcggggaacactccaggagctgcaaagggggtgtcaggactgttgtgcagctccccttaaattggggaggaggggtggctgatgtggaaactgttcattagactgctcagggtagtgtgagaaaacgtgtaatctgtgggcatctacccctagctgcccctctgatctcacccactactgtgggaggaccccgtggatgggggcagaggagggtcttctggatttagacactcacaaaacttccttttaccttgttcattggaagaaatagaaaatgcctttttttttttttttttctttttttttgagacagagtctcgctctgttgacaggctggagtgcagtggcatgatcttggctcaccgcaacctctgcctcccgggttctaacaattctcctgcctcagcctctggagtagctgggactacagccacgtgccaccacacccagctaatttttgtatttttagtacagacggggtttcaccatgttggccaggacggtcttgagctcttgacctcgttatccacccgcctcggcctcccaaagtgctgggattacaggcgtgagccaccatgcctggtctctttttcatttttaaagggtaatttgctgtgcaggagtgggctctcagaccagaagtggggacctgaatgaaatcaaggactgagtatggtaactacagccatttaattttatttgaagtctcccgtaaaatgttctggaaaaaacaggggttccagggctgggtgggcagtttcaatcatggactggattttgtggttcagatttctctgggcctgttggaggttccccttaagcaattacccaaggcagttctgcccagctgaagtactgattacctgcacactataccagtgaggactcatgggtgagcagatgggaggcactgagcttgattctgaaaccctggcctccatcccacctgacattcaatgtcagattagaatttggaagaccctaagtctccagattggtgcactgggtagctcctgaaatggggtggctgagacaggtcctctgtgcccccttccacagcttcctctggggcccttctgctcactggcatgtgcttctgggcaaataggcctctcccagcatttgttttggctctgtgaaatggggtaatatttgttcctattgcgggtgaagcgctgctgttgggatgctcaggtaactcactccgtgggtagctgatattgcctgggcaagtggcattttagaggaaatctgtgccatcaaaagagttggacctgatcacacttttgcttttgaatatgctttgtcccagcctggccattcgtcacttgggaccccctgagtctctctgaccccactgtaaaatggatatgccatggagttgtcccaggaatcaagggcaggtcctctccagtgagtgatgggcttgcctctcacttctctaacacccttctgcttccttgtgtaagatttcactattagtggctattctcttttacagaagaaaaagggagacgcatgcctcttccagttcactgttcaccattgcagcatatttattccaagggactggccgaatcatccctttctttgttagaatgtggttttgttgccttgagacaagtggcccgcatgtctgcactgaaggaggctttgcgcaatagccttgggcacctccggttctgcaagcatgtacagtacttgctctcctttccctttctttgtatactttttctggtctgctacgtgtccatctgcatgtggataaagggtcgtcgtcttgagtagtgattttgctgtgatgtgattcctgtgaggtctagttgcacacagtgattccgaaggtagacccagctggaaagcttttaaattgctgatactccagccccactccccaagagatgctgattttgttttgttttggggagggcagtttttttgggttttttttttaagctttttgatgtgtagccagggttgagactgaagtgatttttgtgagtaacggagaagtgttaaggcttgagaagttggaagagccatgcttgagataggaccaaggtcatatccccggcattagcacagagcaaccctgacctgttggagagttgggctggatggatgcggtcaggggagagactcgctttattttatttatttagagatacagtttcactcttgtcacccaggctggagtgtaatggcacgatctcggctcactgcaacctctgcctcctgggttcaagtgattctcgtgcctcagcctcctgagtggctgggactccaggcacgcgccgccacaccctgctagtttttgtgtttttactagagacagggtttcaccattgttggccaggctggtcttgaactcctgacctcaggtgatccgcccacctcggcctaccaaagtgctgggattatgggtgtgagccactgtgcccagcctcgactcgctttattatatccacacttggaatacaattcggattgattgtagtggggcattttataattaggaaaaattaatcaggaaaaatcactccatgtagattagtaccaccatatgaggggacaagaatttcttcagattaggaacttcttccaacaggactgacagggtccaaaactactcttggatccagctttaagatggacccagcccactgttgagtcccctctgaggtcttctctctgtggatggatttgattgttaacaatggctgagtcatgtggcacccagcccggtgagtaagacagctgagtaagaggggaaacagggcctttggtcagaaaaaccagactgacttcagtcttatctgtttagagaagccccagaagctgcaaaaattgcagcttccagactttagtgtgccgtggtcatgacatcggtgtggatggcaggttgtcatctgagcagtcagggtggcagcacacagcttgcgggctggctgatggccgaggtgtgtgaactgacctgccccaagtgacttcagtgctgggcacagcataggagcagtactaatgatatggacagtatgctcagaggacgttagggagcacagctttgtgtaaagggcatgccctgccctgtccggatttaaagcagctatagcactgaaaccccatggtcaccctcgcatttctacacttctgcctgtgccaagtctagtttgtgtgcctcctccattttgtgtgtacatgggggtatttttttctgctaggcaactgctatttatgcctctcagtactgtacttagtgtgtaccattcctgcaaggtatagacattgtcagcccattttacagatgaggaaaatggagtttttgagagggtgagatcattcagtggcagaatggaatgttaacccaggtagtctaacctctctgctgtagatctgatgtccatttgaactttagacttcccatctgtgtctacagtctagcccttaaaaaatgtgataaacaggtttttaggtaagtctgttaatttcagaaagacattattattattttttagaaagttagagcttatgttagggctcagtctatcctcctgcctcagctgcctgaatagctgggactgcaggcacatgccaccatgcctggttaatttctgtggtatacatcattgattactgagaagtcacagtccgttgttaaataactgagctattcatagccaaatcatttttaaaaacacaaatataagcaaaaacaaaacatttatttatttatttattgagacggagtctcgctgtcacccgggctggagtgcagtggcgctatctcagctcactgcaacctctgcctcctgggttcaagtgattcttctgcttcagcctccccagtagctgggactacagacacccactaccatgcccggctaattttttttttatttttagtagagacagggtttcactgtgttagtcaggatggtctttatctcctgaccttgtgatctgcccgcctcggcctcccaaagtgctgggattacagacgtgagccactgtacctggcccaaacatgtggtttttttaaatgaaagtgtgttcattttacaaacagtgcattcttactaattttacaggccctgtgctagggacatggcctcgtcttccgctatcttagagtgaagaagtaaagacagagaaagtgttcacaagttgctgcacaagtctcattgcagtgcctcccagaggcgcgaagagcaacacctttcacctgggctgtcctagaaggcccgtggcagggtggggttggtgaacactggggcttaagggggtgaattcagaagacaaaggaccttctgggcaaagaagggcccagtagtgggaagtgcaggagtgtgagagtgcctggaattgcccactcactggctctggagcttggtgctgagtgcttgggaagtgttgggaggatcagttatattgctggctgggttctaaagaacctccaaagtttacataaaagttacctttgatttgactgttctaccctccagtcacgtggctaaattaattaaatcaaatttaaaattaagctcagccataccaagtatatccagtgttcaataggtacatgtggcttgtggctgatgcactggacagtgtacatataaaacatttccatcgttgcagaaacttctattgaacagcagttgtattagtccgttctcaacactgctgtgaagaaatacctgagactgggtaatttataaaggaaagaggtttaattgattcccagttccacagggctggggaagtctcgggaaacttacaatcatggcagaaggggaagcaaacatgtccttcttcacatggaggccgcagcaaggagaagtgcagagagaagagggggaaaagccccttataaaaccatcagatcttgtgagaacagcagcatgggggtaaccattcccctgattcaattacctcccaccaggtccctccaatgacctgtggggattatgggaactacaatttaagatgagatttgggtggggacatagccaagccacatcagtgttgttacacaccacagtggtgctgtggtgtgtaggtgggaaaactatggcatgggggccatatctggtcctctgcctatttttataaagttttattggaacataggccacactcatttatttatgtactgtctatggatgctttcacactgcaacaatagatccaaatagttgcaaagagactgtgtggcccacaaaacctaaatatttactatccaggccaggcatggtggctcatgcctgtaattccagcactttgggaggttgaggtgggcagatcccttgaggtcaggagttcaagaccatcctagccaacatggtgaaatcctgtctctaccaaaaatacaaaaattagctaggcttggtggtgcttgcctgtaatcccagctacttgggtgtcgagacacgagaattgcttgaacccagaaggcagaggttgcagtgagctgggatcatgccactgtactccagcctgggtgacagagtgagattctgtctctcaaaaaaaaaaaacttactctttggccctttatggaaagtttgctgacctcttctgtagatggtagggtacggtagaaggtgttcaagccaggagtaacatgaatgattgtatttatggcctaagaggataactcgtggtggtgggcgggccatatttgtggagagacccattttcagtgacttccaagagtctgcgtgagagatgactgaggtcttgccctggcaggaatggttccattaatctgtgtctcatttgacaaatgaggaactacaaatgggaacagtttaagatgagatttgggtggggacacagccaaaccacatcagtggtgctaatagacagtggtgctgtggtgtgtagtagggaaaactatggcctgtgggccaaattttgaagtccttttactttttggttctaaaaattattaattgtagccagagttgttaacttaatatgtcttggaccccttgggctctctgaagactgtactctttctttccacttaataatatacatggaattgcaaaggaaaccaatgatattgaaatagatatcagaaataaaatttttagatatagcaataaatgcacatctgtattaaaatgtgtaataacaagatctaacagtgagtctaagaactactataattatcatgtagcaatggcataaaggatagtttgtgctatctaaaacagtcaatgacaggagaaaatctgatttctttggtgataaaacgacaggtgctgctaatacacctgtgttttatggtcttcgtttgtaatgaaaagaaatgccattaataaattttatttatttatttatttatttatttatttattttttttttttttgaggtggagtctcactctgtcgcccaggctgaagtgcagtggcatgatctcggctcactactacctcctcctcctgggttcaagggattcttctgcctcaggctcctgagtagctgggattacaggcgcccaccaccatgccaagctaatttttgtatttttaatagaggtgggggtttcaccatgttgaccaggctagtctcgaactcctgaccttgtgatctgcctacctcgggctcccaaagtcctgggattacaggtgtgagccaccgcacccggccagatgctgggatgttttttaagaccttagaccctaagcctatcatatcaaatacaatgaaacacacccacttttcacactttaaaaaaagtgtgttggtgtttattgctgtaaaatagtttgaaactttttaaaaaaagttttggtcttgctcatacttgtgttttaaaaaagtatttggctatgactaactcagttatgtatttatttatttatttttgagacggagtctcgctttgttgcccaggctggagtgcagtggcatgacctcggctcactgcagtcgccgcctcctgggttcaagcctcagcctctcgagtagctagaattacaggcgtgctccaccatacccagctaatttttgtatttttagtagagatggggttttaccatattggtcaggatagtcttgatctcctgacctcctgatctgcctgcctcggcctcccaaagtgctgggattacaggcgtgagccaccacgccctgtgactaactcagttatttaacaattgactgtaatttctcagcaatcagtgtatacttggaaattcttgggatgtgagaaaactaacctataactcattttcttttttctttgaggtgaggtctctctttgttacccaggctggcgtgcagtggcatgaacagggctcactgcagccttgacctcctgggctcaatcctcccacctcagtctcctgagtagctgggactactggcacgtgccaccatgcctggttaatttttgtattttctgtagaaatggggtctcactgtgttgcccaggctgatcctgaactcctgagctcaagcaatccacccactttggcctcccaacataccgggattacaggcatgaatgagccaccatgcctggcctgcaacttctataaatagcaaagttagtaattagtgaagatgatggtttgcaagcactgaattatacttctattaatttcatttcctttcaattttctaatgttttgtgcccaatctgtcctgtctgcctctacctagctttagaagtgttttgttggttcctgagatggagctgtgcctgaagggtatgaggttaccctctgggttcagcggggagatttgggaagagttttgatttgtaggccagtaaaggggcctgacattagatgatggctgctgggctagggaacaacttagaggcagctaacaggattcagggagagtggatttggtgggagagagtagtctaggatgaatccaattgggtttttatgagtagtttggtagttggttgactgggtgggtggtcccttggtaattatttgttgattagtggttgttgggttaggttggttacacttacattatagtcgatggaatctcagatttggatctaataccacatgtaagtcgagtggatttttttttgagacagagttttgctcttgttgctcaggctggagtgcagtggaacagtctcagctcaccacaacctccgcctcccaggttcaagcgattctcctacctcagcctcccgagtagctgggattacaggcatgcgccaccacgccgggctaattttgtatttttaagagttgggggtttcaccatattggtcaggctggtctcgaactcccgacctcaggtgatccgcctgccttggcctcctaaagtgctggcattacaggggtgagccactgtgcctggccagttgagtggatttttttagcactcaagcttcgtggctcattgctattattgtgcatgtgagcgttttatctttcagtagcattagggatgctacttggatgtgttttagttattacagaaatagtttttactaacttttactaagttatctttcctctcctgtgtaggaagtttagagtgaagcggcagttggctggaggttctgaaggtttccccctttcacataatttgatgttccagttgcccacatcaggacgactccctctctttctactgatgtaagcagtgggccaaattatggggctccatccctgcatcttcctacttgtctaaatcttcgtcacagacaacatattgctctaaaggaaacctagaaaggaggagaagctggttttcgcccaaattcctcaaaatcatcgcctgttgtttaagaattacagtttgcactggaacaataagatgttccttaatgtggtttttaagtgagttggttgtcgcctgaatttcataaacactggctaaggattgtgcaaaagggtgtgcttccctttagcatccttaattagggacagcgttttgaaaactgctttttattgtcctttatctgcaaaacttcttgaatccaaatagcgagattctcatttcttaatcactgccacagaaagttgtagattagagaaagctccaattccttatttcctgtcttcctttctttctgtgtgtttattgcctgtgtctcatcctcactcctgccagttttatagaatgtaacctcccagcctctgggaatgtttgggagacttgttcatagaggatctgaagagcagtttaaagtggacttacccaaactatcttctggagaacattagtctctttggagataaaatttttaaacatccgctagtccaatagtgttggcaaattccctgtgacactgtagccctctctttgagattgtcaatgtacgttggcatgttaaaggctctgagaagtcctgcagcagttaaaaaattgtttagtctagtgtgcccccagttgtttggccactgaaacccccttttctggaaaaaccagctaacatctggtagtcttttctaagaggtggtactgaagatgatactcatgttacacatttaaaaattctaacatgtgtttttcatgtgtttataaaatgcaactaatgtatcaaacctgtgatttccaggacataattacttaagctaaggaaaaaagaaaacatgagtgaaggaaaaactttagtaaataggccaggtggtaagaggagagagccttgtctgtgagtgtggtctagggggatgctggacctagcttttcagagctaggttcaggcagagctgctctgagatgtagacactgcagctggggttcttgttgagccgggaagcagcttctgactaaggtgcagactgtttagatgagctggtcataaagagccctgactgtggactgcgtctccagccacggcagcagctggtggatggggtgatgccttggatatttatcgtgtgtttcttgcctggcctgcccttggacagtgcgcctcaggaatgttagaatgtgttccccctttagcagcaaagccgatctgctgtgtacttgttctgtttatcttactgccacgaccgtttatcacgggccagagttcaggggcacactgataaatctcttttaggaggatgatgtaaccctcagcattttccccctacttggttctgagtttttaaagcttttgtaacaccatcatgtccttgtttgggcatcttcctgtgtactcccgtttgggtctccagggtgaaatagccaacagtggattctggagtcatggcctgggttcaaattcctgctctgctgcttatcaactctgactttgggtttaattgacctattcattatttttcttaatctggaaaatggagccaacagcagttcctcataaagcagctgtaaggattcaggggggtaactgcacagggccaagccctcaggtttcacctctcactgggaggtcggacctctgcataatggacaagctctcctagggtgcaagtgaacgggggcgcaagggagttaggaaggtgggtgttttttgtttttgttttttggtggcttgaaaaacatgcccaaggctgggtgtggtggctcatgcctgtaattccagcactttggaaggcagaggcgggagcattgtttgagcccgggagtttgagatcagcctgggcaacatggtgagaccctgtctctctttttttttttttttttttgagatggagtctcgctctgttgcccagactggagtgcagtggcgcaatctcagctcactgcaaccttcacccccaggttcaagtgattctcctgcctcagcctcccaagtagctgggattacaggcgtgtgccattgtgcccagctaatttttgtgcttttagtagagatggggttttgtcatgttggccaggctggtctcgaactcctgatcacaggtgacccatccaccttggcctcccaaagtgctaggattataggcgtgagctactgtgcctggctgacccaaaaaattagctgggcgtggtggcacacacccctgtagtcccagctacttgtgaggctggggcaggaggattgcttgaggccagcctgggcaacagagcaagaccttgtctcaaaaaaaaaaaaaaaaaaaaaaaaaaaaaagaaagaaagaaaagaaaagaaaagaaaagaaaaacatgcccaaaggcaaccaaatgactccatcttttgcaatgtaatcttcaacatcgactcctctggcaagctgtttggaaatggcaaagtccatctcctgaggctgggagattgcttgtccaggacgggtgtgtctggtgaggaatggaaggcatttggatggccactgagaaagctgagccaaggagcatcagaaagacaatcaggcaaacccacagagtctccaggtattcctttgctgataggtaacattgcactagcgatttaaacaaacaggtgaaaggccattgccctaccaccccacctcacctctattccttgctgctctttccagaagcaactgcatggtctgggaacagttttttgtcttgtcaagagacagtctgtacatagatgaattcaattatattacttctgtagtaccctgtactcaaatttgaacctgtcatacacattgcttttatcatttcataatacctgttgattttcccacgttagtacctatagatcctgacaagcaattttgttaagatgaagagttcttcatatgtattgtactatgtttctttttttgatgatgtatgtcaagatttattataaaagtaacagatgggtagggcatggtggctcattcctgtgatcccagcactttgggagaccgagatgggaggattgcttgagcccgggagtttaagacaagcctgggaaacctggcgaaatcctgtctctacaaaaattacgaaaattagccaggcatggtggtgactgtcccagctacttgggacccaaatgtcccagatactcaggaagctgagtcgggagcctgatcctcagaggtcgaggttgcagtgagccgtgattgcaccactgcactccagcctaggtgacagagtgagaccctgtctccccctggcctccaaaaaaaaaaaaaaaagtaacatatgtagtttaaattttaaaaattaaatttttgggggggctgggtgtggtggctcatgcctgtaatcccagcactttgggaggccaaggtgggcagatcacctgagatcaggagttcaagaccagcctggccaacatggtgaaaccctgtctctagaaaaacacaaaaattagctgggcatgatggggggcgcctgtaatcccagctacttgggaggctgaggtgggagaatcgcttgaacctgggaggcggaggttgcagtaagccgaaatcatgccactgcactccagcctgggtgacagagcgagactccattaaaaaataaaaataaaaaatcaagcaatgcagaataaataacaacaataaaatgaaagcccatcttccaccatcagcttcttagttttcttcctagaaggagccagtgaggacagtttggtgtttatgcttccagatctttctgttcagatgcagtcatgacttctgaaaaacaggattgtacaattcatacttttctacaaattatccccttcccttaatacatcatagaagcctattcatattggaacaaacaaacatttcttattcttttcacagcaccctgttttcctcttgcttgaatgtaaagtttatttaaccacttactgtcagggaggcatttgttttcagttctccctccctccccccaccagttgtcttgtaatgaactgctttaatggctaaagatcactttaatatcaaaacctcccccacctcccattagaaaaagaaatcatgttagggaacttcaaattgaatttacggaccttgtgtttaattttctatcagcagtggccccagcctggcccctgcagactgccccggaatctgtgggaggagttggggtggcctgcagactagagcacactgccagttcattcagcagctcaccgagcaagaaacatcttgattctatcagccttaatgctgtgtcccattagggacccagctcttgtggtcattagcagatggaatgctcatctgtgctagaaggcggaattctagggcattcggctctgagcagtcttgaaccagaattgaatggcttgaatccttttcacaatgccaacggggaggcacccttagctcccaaacttgtgtgtgttataatactatggtagtaataacagtggttgtagtagcccccgtgaatttgatgggacagtcgtcaggcagtgctgcttgcttgctttactccatcgtatcaccgcagcctgatgaggcgagggagttacgactctcattttgcaggtgaggacactgagcacagggaatcgacccactcatggtcacacagcttgccaagtcgctgtgcttgggaggtgaaccaggcttctctgacgccccagcaggacgtctgaacttctagctgccccatcactaactgacttaatgcccctgactcctgggtgacttggccaccagttacttcagccagcgacctgccctttctttgagtgggttccacccatccctgcaccatgccttttactttggatgttggtggcatggaattccacccgtaagaaggaggtcggtccctgggctgagagagtttgcagagagctctgttgggattgggtgggacgtgtgtttggaggcctcctcacataattgtgggctgaaaggtccagatttggggatataaagttgagccgtcagctgagctaaagacagggcacagggaggagccatccagaaagtgtcagtgtaggtaaagcaggcagagttccccctatctgtcctctgagggcctcctttcttgtggtttcctcccttttctgtggtgatggtcagagccagcggttataaattatttggaattttcctcagcttggttcctactcaagactttaaattaggagttttgttcccttttatgacttcacaatctttgggcaggctgccatctctacagcaggctaatatgagttgtaacttgaggtgagttacaggggaaaaatggaagctgatttctccccttttaaaccaaggaagccaccttgatctgactttgtaacaaagctcaacttttgtaagtttgcaattaaaggataaatacctatcctatttattattattattaactttttattataaaaggggaaaaaactcccaggaaacatagcctaatatgagggacaaaaagccaaaaggttttttttttcttcctttaaaaggtcctcaatgtcttgccctgtggagacaccagttttcattataataacgccattatctctttgtagagtcatttcaagccaatttaactttctcatttaaaagtataattggtattcagcacagagctgggagctcagtaggcagttagaaaatatgtgtatattttttgagacgaagtttcactcttgtcacctaggctggagtgcagtggtgcgatcttggcttactgcaacctccacctcccgggttcaagcaattctcctgcctcagcctcccaaatagctggaactacaggcactcaccaccacgcccaactaattttcgtatttttagtagagatggggtttcaccatggctggtctcaaactcctgagtttcgccaggctggtttcaaactcctgatttcaggtgatctacctgccttggcctcctaaagtgctggcattataggcatgagccacagcacctggctggcagttaggaaatatttattgaatatgagaaaagaaaaatagagcaaattgaatcttcaagtagtatgtgagtaactctaattcctgttttctggaaaacacacaggctgataggtttgggtaaataagagcagagctgcatcttctctcaagttccctgattccctcaaggagttacctgagaatagctctgtgccaagcagtgcggcatgcataggggacctcttgaatggagggacagtccattatcattagaatccccagttccagccaggtgcagtggctcatgcctgtaatcccagcactttgagaggccaatgtgggcagattgcttgagttcaggagttcaagactagcctgggcaacatggcaaaaccttgtctccccccgccacacacacaccacacagacacacagacacacacacactggctaggcgtggtggcaggtgtctgtagtcccagctacttagaaagctgaggtaggaggattgcttgagacttggaggtcgatactgcagtgagctgtgatcgtgccactgcactccagcttgggtgacagagcaagaccccggaccctgtctcaaaaaaaaaattccccagttctcagggtgtggtagaggccgagtcagtcatggctgagacaaggggactgtgctctgtgtgcttctgtgccctgtgtttatatggttcatacgctgcctgtccaccatgtttttcccgagagcctcggcagcgcaggcatcatgggaatgactgagtcaggtggaaattcagaggccctgccctggtgggcagagaagcctggcttacctcccaagcacagcatgtgtgtggatcacttctgtgcactgtctcctcatctccaaaatgggagtcataactgaactcacctcatcaagttgttatgagatgatgtagattcagcgaagtagcaagagtaggagtttgggctttgataacagagagaagtgagtttccatctagattctccccctgtgtcacttttggcagttggcttcacctctgtgggcctctgttatgtcatctgtaaaatgggattaaccctaaaagccaccctcacagggtcattgtgaggattgcacaaggtgatgcaagtggcacagggtctggcccaggagagggggctggaagagagcgagctgccattgtattttggttgctgtggatctaaggagaagagatgtttaggagtctttccctggcatggttcctcctgccttcacccatcactcttttcctcgagggattccctgtggggtgcacagccccagggtgggccagactgagctcacaggagcatgggctgtgtttcaggtgaggtggcctcaccacatgacaaactgagctggagtcaaagggtcacgaggacctccattcacagccagcatttattatttcagctggaaatgtttgccgagcagttgtagctggaagctgtgagcgagacacagactgccatcaggctgaggcctccagagctcatgctgggctttaacctgagcctcttgggggctgggctctgagctcctccacttctgctcatgcccaggcgtccttgggggccttgaactgtcagttgtccaggagaactgtgtggcagcaacagaatgagtttgtatagcaacctgttgctttgaggtttaaaacttagtttagaacgcaattgctttgaccattttggagtgtctatactttttttcttcttctttaagttttcttttttctttttttcttttttttttttttgagacagagttttgctcttgttgcccagtggcaacaagagtgcaatggcgaaatctcggctcaccacaacctctacctcctgggttcaagctattctcctgcctcggccttctgagtagctgggattacaggcgcccgccaccatgcctgaccaatttttgtatttttagtagagacgggtttcaccgtgttcaccaggctggtctcgaactcctgacctcaggtgattcatctgccttggcctcccaaaatgctgggattacaggcataagccatcaagccctgcttttttgtttcccttcttcgacctttctaacaagaggttggaatcctcgttttgacttttaaaggatttcccagtgctagaaagtggtaagatagttactgtatcctaggccctttagcagacctgtctcattgatcatttatttagtccagtgtggctttgttgttggatattaagtaattctcaaaattttaccttttcaaaagtggcattgaaaataaaggcattgggtgatgaaaatggaacttttaaatacagtgattcctgttaaccagaaatagggtgtttgggataatttatgaagcagtacaccatcatagatactatgagctgaaagttcaccaaactctctatcccaaaataacaataaggtatttatgaagtgattcgttccaactatttgaggcaaaaattgtccagcaagtgagagagaacagaaggaatagttggcaaaatagggaatttgaagtctgaggttatgcataaggaatgtgttatgggcctatagtagaaatctcaaatcagggattagggaatgtttactcagttctgttgcagagaaatcctggccacgactcccccatgccatgcccagggcaggcattgctaatcttcactgcctccattctccatgccctgttcacggaagacatttctaatgcattttagcagtcttttttttttttgctgaatccagatgtggcctcagaatccttctcaacacagtgtactagcaccacttggtgctcctgatctactgtatcatctcttgaaaaactactaacatgaaaagacctgccaagtcaactttatattaactgaacccttgacacagtgatggataaaaattaattcaaacagcttctttgtgatctttgagtagttcatgagcaagaaagagaattggaaatccagccaacttcggcccccttgtctacttgtattttactgtggtttatgttttctcttaccaattgagataggcccatgagacttctggtcttccaaagcccagaacatccccacattatagtttaaccactgtaacaaagaggttttttttgtttgtttttttgttttttttttgttttttttttgggacagaatctcgctctgtcgcccaggctggagtgcagtggcatgatcttggctcactgcaagctccgcctcccaggttcacgccattctcctgcctcagcctcctgagtagctggggttacaggcgcccaccatcacgcccggctaattttttgcattttttaatagagacggggtgtctggatctctgacctcgtgatccgcccacctccgcctcccaaagtgctgggattacaggcgtgagccaccacgcctggccagaggttttcttaaaaacaataacaacaaaaacagttgtggaaagcatgtagagtgtgggttttttcggtcttcaggttggcagggcatctgatactgggacccaggttccttccctcaccttgctgtgcctctcctagtgcaggccaaagccaggtgactgcgctgtctgggctcctggctggcaatcggggaaagagtgcatggagcaggcatgcccactgttcaggtcctgaagccgtggctcatttcatatcatttgttgcttatttgaaagacaggcacagcactgacttccaggggaggctgactgaccatctaggtggaagttgcatgcctgggagggagaaggggacaaaggccacagataggcatcagttatcagggccttaagtctgccttgttggcatgcagccttttattggatcaaggccctggagaaaagccctgagcaggaggagataagccagcttggtccccttcatcctacccaggggcctctggggtacctgagccaaagtgcacagttcattggctgtgtggatggaagggatatgggacttgaaaatgggacactggtcctgggcagctgaccgacatggtcctccttaacctgctgtctggggagatgggttgcatctggctaggttttgactgaggaactgaggagagctgtcagctgtccccgctttggttcagaatgcccttttgtttggacagctgaagcctacaattcagccatggtttgtttgggctcagaaaacaggcaaggatggagagaaactgcaaagctgacctgggctgtcagtgggcaccaggtcctgctggcctggggtctggatgcaggagatctgagctcttcaatgtggggtggtcttgcagcagctcttcacaggctgctgctgctgctgctgtaggctcacccaagcagccaagacggacaggatctattctagttttgtgcagagttggatatagaagaggcattagagggagaggggatggggaaggagttccaggccaggtgagcatggggcacagtaaactgggatgttaaggaggggccagtttgtgaccagcctgggcaacatggcggaaccctgtctctataaaaaattaaattagccaggtgggtggcatgtgcctgtagtcctagctacccaggaggctgaggtggaaggatcgcttgagcccaggaggcggatgttgcagtgagcagagattgtaccattgtattctagcctggatgaccgagaccctgtctttaaaaaaaaaaaaaaaggaggggccagacccctgacccatatgtgctgctcttttctttcagggaggtctgataaaatatcagtagttcaattctttttttttttttttttttttttctgagatggagtcttgctctgttgcccaggctggagtgcaatggagtgatttcggctcactgagacctccgtctcccaggttcaagtgattcttgtgcctcagcctcccaagtagctgggattacaaggtgcccaccgccatgcctggctgatttttgtatttttagtagcgacagggtttcaccatattgtccaggctggtctcgaactcgtgacctcaggaggtcctcctgcctcagcctcccaaagtgctgggattataggcgtgagccaccatgcccggcccatagttcagttctttaggtggttcttggtgctgcatatgagatctctgcaagaaggacacgtctgagccgggtggtttagaagaccagcatggcccaagaccctcagagcaacaccaagaaccacctaaaattctttctcagacgtgtccttcttgcagagatctcacgtgccccaggttcgctgcagcgttaggggtcagcctccctttggagcaggagagcaggggccttggaggtggcagtcatggccctcctaattaattgcttggctcagagaagtgacaaattgaacatttcaaccacctgttaattcacaaggtacttcttttcatttcttgctgcttgcacaaaacacttggagtatggcttgtggatgtctggccctagggaagagtgtttggcacatagcaggtacttaagtattaggaaaatgaggatggaggggagggagggaacattattaagcggccaactgtgagacaggcattgtgcttgactctttctttctttttttttttttttttgagacagagtctctttctgtcacccaggctggagtgcagtggtgtgatctcggatcactgcaaccgcgcctcctgggttcaagtgattttcgtgcctcagcctcccaagtagctgggattacaggcgcctgccattatgccctgctaattttatttttagtggagacagggtttcaccatgttggccaggctggtctcgaactcctgacctcagtgatctgcctgcctcggcctcccaaagtgccaggattacaggcgtgagccactgtgcccggccgacacttggcattctctaacctacctactccttataacagccctgggaagtagttgaccatggccatttctatttggtagatgaggaaaaataaggttcagagatggattgttcaaaccgatgtatctagtcaagctactggttcccgagcctgtgtttgcaacccctctaccatgtagcctctccgggtggtagagatgagggggcagagtgcacagtgcatggcatcctgttccccagatggccaagtcttagtgcgagtgtgtgtggccttggtaacttgtgtcaagcacacaccccatctctctctctctctctttttttttttttttttgaaacggagtctcactcggtcacccaggctggagtgcagtggtgctatcttggctcactgcaacctctgcctcctgggttcaggcgattctcttgcctcagcctcccgagtagctgggactacaggcacatgccaccacgcccagcaaatttttagaagagactgggtttcaccatgttggccaggatggtcttgaactcctgacctcgtgatctgccctccttggcctcccaaagtgctaggattacaggctctcttgctctctctctctcttgtttttttttttttgagacagagtcttactttgttgcccagcttggagtgcagtggcgtgatcatggttcactgcagcctcgatctcctggctcaagcaatcctcctgcctcagcctctcaagtactagttggtactaatgggcatgcaccactacacctgactaattttttttattatttgtagggacagggtgtccctatgttgcccaggctctggtcttgaactcctgggctcgagctatcctcctgtctcagcttcccatagtgctgggattacagagatgaaccgcctggcctacacacccctatctctcctcgattcttttttttttttttttttttttgagacagagtctccctctgtctcccaggctggagtgcagtggggtgatcttggctcactgtagcctatggctcccaggttcaagcgattcttgtgcttcagccacccaagtagctgggattacaggcacacaccaccatgcccagctaatttttgtattttgagtagagacagggtttcaccgtgttagccaggctggcctcgaactcctgaccccaagtgatcctcctgcctcggcctcccaaagtgttgagattataggtgtgagccaccatgcctggcctctccttgattcttacagtcactttgttggctgtttctgactcagcagctacctgcattgtggccaaaggatgacctattccttctcaggagggcaaaaatgtggaatagtgtctgtccatgcctctcctcatgggctaccacctctgccaccgtggttaatcagtaacaaccaggagagaagctgctggaactgacctctgggaactccctggatggtttggtgcaggaatgtagtaggcatacacgtggttgcgtggatctgggccctcctgatgtgagtagagaggtaaaaggccaccatctccttgacctctggggaactcatccacaaagaagatgtttccaagatgcttctgaagattgcctaaaaatagccggtttccacccccgtgaatgcatccattctagaatgctccttcaccaggaccagagaactgatttacagaagtgacatgaaaacattccatcccagaatttgcagtagctcaaattaagtttctagctattaaaaagaaaagaaaacaaaactaaacaaaacacacccaccctgctcacttagaagcaacactgagtaattttaagtagttcgagaaaatgtatgtggtttgagggtcagggttgtccagagccaagaccagttatgtgggaattgttattggctggatttggggaggagaaacccatggcccaattccaacccactgaaatctaagcagattctaggtggttaggcggacctggtaggcgttggtttattttattcccgaaaaaggccctggagcaagtcttcacatggaatcctgctgaaaggcttccggctcatctggccttttcctcctcttaaggttctgctccatgttttaccctcggcgtaaacattgcagagcacgttcagatctgaaaagtgtctcatctacgtgatggtcagacgttgttgaccctgtgatgctgtgtaacatttcattttcgaggcttggggagtctcctatttcatgtggatgggaacctggaggtctttgggcaagtcgccatctttttattgttccaagagtttggtgaagcgtttgaaccttcacctgtcaaaatcagttttggaatgagaactgctctctctctagtccttataatagcagaaggaaggtatcatttatcccaatgagaccataaagggggctttcccgtgtggacacccaccttgaattcaattggaaacagaaattctgggcattgtattttttgtaaatttggctcagacttcaactggatcatatttcccccaaaatcttttcgaaaaagacttgtgtctcattcctttagactagcatgtgtaagctgggtaaaaatagagcaagccgatttcatgttaatgatttcatgttaggtttgtgaatcaaatctgcaagtctgcttttgaaaagcatttaacatataacttgggaaagtttgagttttgcagactaatgcctgtggccggatgagacttcatagctccatccaatccctcctggtgcaagagatcaatgccttgagggtgcctggccaccaccattaccctgacagtatacccactatttatttatttatttatttatttatttacttatttattgtttacccttttgaagattgctcttctccctttaacttaaaggaattggcatggaaacttgtttgatctggaatttctgataatcagtaggtagtaactccgtaatcaatagcacttcaaaacaacaaccaaataacaggataactaatccaaaaaattcagtcatggtcaaggacttccagctcaggaaatgtctggtcccgtggggtggattccttggataaccaagttccgtgcagggcctggagttttatgcagaccattgctccttgattgaccacaggacctcaaaaggagggctggcttcatgaccacatgacccgtgtgctcagaagggccctgtacttggtttattgctctgctgttgctgtcttgaagttcttaattttttttttttttttggcactggggagttgcagtttcaaacaacacttattcattgtctcacagtttctgtgggccaggagtccagccatggcttaagaccaggtcctctgctccgggtctcacgagactacaaggaaggtgccatctagggtgtgttttcatctgaatgcctaactaaggaaaaatccacttcattcaggttcattcaggtttttaaaagaatccatttctgtgtgattgtcccactgacaggtcccagctttttactagctgttgcttggaggctaacctcaggttttacaggctacgctcatatctctgccatgaggccttctgcataggcaattcataacacaggtgcctgtttcctcacagccagcaagagaatctgtctcctgtctgctaaagtggagtttcatgcatcgtaatatggtcatgggagtaatagcccgtcacctctgccatttttctgttggttagaataaaggcacaggttttccccacactcaggaagaacccatgatataaaggctttcagtaaaggagacgacaaacagaatatggaatgatcagaattactcttatgacccagaccaagaacatcagcattacctacgaatttattggaaattcaaattctcctgtttcaccccaggcctgttaaatcagaaactttaaaagcgagcccagcattctgtggtttaacagatccttcaggtgattctgacacctgctgaattttgagaaccactggtctagaggcaggcaggtcttgctcccctaggagttaagtttgatgtatcttctggtaatactgagaaatgagctgggaaatggttccaaaatcagattatcctccccaggattaacaagactcatacttgcaaaagagagtgaagaagagaaactaaaaaaagcaagaggctgtgtgtgaagctagattcaaacagttaaagacagcaacacatggcaaaggatgggaatttgaggaagtgggtagtgaaagcaattcttgagctaaattacaagaaaacacggtgaatttgtatctgtttcctatatttagggggctggcttaaacgttagtgatacatttggggagtagaaaatggatgttggtgtgaagttcttaagttttggacaaggaaccctgtattttcatttttctctgagccccatgaattatgtagacagtcctgcttcgaagttattatttatacaattcattatagagaaagtccttgggaaccttaactttgagtgaggattgcttgagttagtttttcttaccagccactccatgatactctttgttttttccaggttagatgatcgagttttattatgactgaatctgcacctgcaaaattaattctgattaattaatttaataattaaattctgatgatttctctctgatggtttgggtgtgggctcttaaagagggtctttttttgcaagaggatataacaataatcaggttaattaaaaaaataaggctctcaccctttcatttttgagtggcatgccatgcaccccttatcagcatgtgagtatgcttttcatgtggtcgtggttgggtttcattaagtgtaatttggcatgtgttcaaccagcattcaggtggctcttggtgggtggctggggagacaccaagatgcagatagctcagtcactcctcaacaagcggcttagttctggaatgaggtgggaggccaaggaactcacacataaatgctggtgggagtgaagtgccaccagctgtagaatctggtgtcagaatgatgagccaggagttatcccacaggaggatgggtgaaggtcttcccatcaaagggatagagaacatgtgaagaggtccaggggctcagggcaagatgtagtccaggaacaaggagtctttgagcctgcagtatggtgggtggaagtggcaagagtggaaagcggattggatggggtttatgtaggttctgaggtgctgtgtatgtttaaggagctgattgtgtgcagcgggaaccctggtgaatttggaagcacagaggcacctgacgagaaagatggttctggggttatgtgaacagtgattcggcttcaaggctatcaaagacaaaaatgtttattgggagggtatagaaaagggtttgccaaaagagttaggtagggatagaattgacacattgtggaaactatacccagagtttaagaggtggagtccaggatagtgcccatgtttgtagcttggggtcctggtagaatgggagctggctatggagtatctttgttggagagtgggtatagggaaacggagagagagagaaagttgcagggggtgcgggagatggatagctgcagagaaggcaagggcagggaaagtggaaacaaatggcagtgagactcctggaaggtgctggccaggggcatggcatggcatgttctgttaagcaaggaaaggactagaaaggggccatgattttggctgggcacttatcctcctcacaacaggacgcatttgtgtcatggcttactcttaagaatgactgacgtgtcagaatagcaaatatgaaaatgattgataacacctagcattggtgagatttgcagggataactagctggcctcttaaatctatagataggaatgtaaacagaaacaaactttttatagggaaaagatatctaggacataatgattaatgaaaagaaaaaaattcctacctatcgaaaaacgtgaattcaggcagcaaacacacatgcatgtatacacatacacacgtgcacacacgcatacacacacaatctggtaggctgtatactaccagtttagcaggttgttacctctgggatgcagtcactcctttttgttgtgtatatttgtgaaatgatttctttcaatttttgagacagggtctcactctgttgcccaggctggagtgcagtggcgtgacgtcagctctctgcaactttcacttcccgggctcaagcgatcctccaacctcagtctcctgagtagctgggactacaggagtgagccaccatgctcggctaattttttttttttttttgggtagagagggagttttgccatgttgcccaggctggtcttgaactcctaagctcaaagcaatcctcctgcctcggcctcccaaaagtgctggggttacaggagtgtgccactgcacctggccattattatggaaaattttaggcgtatacaaaagtagagacagtggtgtcttacatgctcatgaacccatgatccagtgacatccgttaatggcattttggaatcatatttcatctgtttttgtcctcaaatgttttgaagcaaatttcagcattacatcatttcactcttaaatatctcagtatggttctctaatagttgaagactccatttacatttatataaggagcataatttacacttgtgtaacccaaaggaatgaccaagcctgtgcttctctccccagatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtaagtggccagggctgcctaaaccatctgtccaggatgggggtgtgtgggtcccaaacattctggttttcaacgggaatgctatctttgctttgattagcgtatttctccaggtcttagcccattataagcccattataaggaaactaaaactggctctgtgtacccttccaagggcagattttctaggtatatccatagacatgtttgagcatcaagttgagtcttttatccaaattccaatgaaggagttggtgcttagaagcaagacttgggtttaggttccagactccaaaatcctgtgtcttcccacattggtgctcagtttctcattggatttggagaaacatttggtcctattaggtggcttggcatgaaaatctgaaaacttccatggagtggaaagtacccatttttattaaccactggtttgactatatatggcattctccacccttttctttctgtgttgctgtgaaatagcatttggtcaggatccagttggagccttttccacccttgatgggctgctcatttcttagtggttgagtgtatatgaaggttgtaattattcccactggagggtttagattgatgggtagagtttgctggtacacactcagtagaaagaccagagtcagagtttacacacaccccctaaagttgattttaataaaaaaaaaaggtattaatcatattttccatttactgtgtattctgtatttactgggcacattagtatttagttagttagtggttcttgacatactcaaagcagaactagtgtcagttgggtaggggagggctgaaggcctcattcttacttgagagcctataagttggtgtcatccaggaaaaattcaaagtgcagcattaattgatttcctaatatcctcttctttacttccatttaaggacacattttaggatacctctttccaatttaaacctgggagtttttactctagtcctttacctcatgtgcttacaaaggcttttaagataattctaggtttgtgcctttgagcaagtggatttttgaatcacacaggatgctattctagactttttagatatatccaggaatagagtaaaaaataaaatccctcctgcataaaggcaccaggctttttccaagctttgtttattttttaacaccacttcttcaaggaatggataatccccatcttcatgcaagaacatagcacccggaggagaagtctcagtaatggaggatagtttacaccctggcacactcatacctgtgatactttttgcctattaaatatatgatttgctcagattttaggaaaaaatcattctctgaactaaaagaaaaaatggggttagtttaggcacatggtttcctttaatctctttggtcagctaatgctaaaagaatcttttgtgttctgttaacaggtctgtgcccagactgggaatcctgggacccgcagaagcctgtggataatgcacgagaagccatgcagcaggcagatgactggctgggtgtcccacaggtatgcacaagtgtgccaggtcctgtgaggctgcccccacccactagcttgttctgtggatgccttcccgggtcaggcagcccgaccttcttggcattgagacttcagagagcattgcctgtgatgctctctcatcttcctcagtttacccataataatagtaggttctcattgactcaggtgcttatagatcttagtgtgttggtttaatgtagatcatccagaaattttcatgtcactcttctttgtcacacactggcaaattttctagtatttcttctctaaatattttgaagactacctttaaaccccagactacaaatatggaccctaactattaggttgagccataagaaattgatagtatttgaccatttttcaatctacattttaaaaggtaattttaatccaatagcttaagaaaagtcacaggacttaaaatttttttttttttttgagatggagtctcgctttgtcgcccaggctggagtgcagtggtgtgatctccactcactgcaacctctgcctcccgggttcaagcaattctcctgcctcagcctcctgagtagctgggattataggtgcgcaccaccacacctggctaatttttgtatttttagtagagacagggttttaccatgttggtcaggctagtctcgaactcctgacctcgtgatctgcccgcctcagcctcccaaagtgctgggattacaggcgtgagccactgtgcctggccgacttaaaacttttaaaaacatgtaagccaggataatccaccattaatggaaactgtggaagaatctctatcacccataatcctatcacaggaatataacaagagaactcagaaatcaaataagtcttggataccatctacagtagtcacattgcttagttgaagtctgatcttcctagctgggaggaaaaccagtgttttctttccagaaactccctctaacagttaggcaccatgagtcccgtgtccaaaggctagccagggaagattgcaggtagccagtgccatgggactgatggcgtcactataggctgcattgaggtctgagttcagtgtattttgtaacagggtcccttggaaggtagaacaacatgcctgtttctttggtttggttttggagtcatgtctctcctacatggctcattggtttcttggctcgtccaccctcaggaagtggtgtggtgtgtttttcatctccgcttaaacctaaaccgtctcctttttacgttcacgtgatgttggcatgggtgaagttgttgaaggagctgctgggaagaaatgccaaatcgacacacatcctactttttatggaatgtattgaaggcgactgttcaaacccaagtagctcttttgttcctgcaggctaatggtcagaatgttttctggtgctttttatcacatggggagggaagttggacacatctgttgttcattgcacatggttaacctggtccatgagacagagcctctgttcatctgaggaagtgtgatttacctccttagcaccattactggaggcagggaggactctgcaagctgtttagggctgggtcagatgatggtactgaaactgaggtggtggcaccttcagggaagtcacctgtccaggatgggtctagtcttgctcctaagctgaatatcaagagaagttcacccattccctattttttttttttttttttgagatggagtcttgctctgtcacataggctggagtgcagtggcacgatctcagctcactgcaacctccgcctcctaggtacaagcgattctcctgtctcagcctcccgagtagctgggactgcaggtgtatgccaccatgcctggctaattttgtatttttagtagaaatggggtttcaccatgttggccaggcttgtcttgaactcctgacctcgtgatccacccacctcggcctcccaaagtgctgggattacaggtgtgagctactgcgtctggccttttttttttttttaaagagacagcgtcttactcctctgttacccaggctggagtgcagtggcatgatctcggttcactgaaacctccacctgctgggttcaagccatcctcctgcctcagcctccctagtagctgggattacaggtgtctgccaccacactgggctaatttttgtatttttagtagagactgggttttaccatgttggccaggcttgtctcgaactcctgacctcaagtgatttctcttgtcttggcctcctaaagtgatgggattacagtcatgagctaccacgcctggcttccctatttttttaatggctcctaatatattgagatcacatatctaatatttacatgttatttcttttttatttaccttttttaattagtagagttaatacagatacagaccatgagtatacaagcaaaggaaaaagctggttaacctgtgcacttttttgtaacatgctctaatcccatgtgtgcttgtttcttcattttcctgccttgctatagcttatccttttatcatttttgaaattttgaccagaggagtaaatggacttttggggaatggggaggacaatgaacttttggaagttacatgcagaattttttggagaggggcccctagctttcaaaggggtctgcaatttctcaaaaatggttaaaaacactgatattggtgtgttggtttaaagtaatttcacttaattgagaagctgactcagtttcttaatatttgtagtgcttggtttaagaggcatttgcaaacacttcaatagttgcaaagtgatgtgttctgggtgttcatccaccatgtcattatcctaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggtgagtgctggtcctctggtgttgtattggagacatgtcctctggtgttggagatgatttcatggcttcaagagtgatgttcttagaatcaaaaatagataggtgtaatcctcaaagagaccccaagcctcctttgtaacacattttatgactgttttattctgccttgtttttctaaggctttaagaaatgtttctgcttagatggaaagggcaagtttgctgcttggtgattttagtgcagtagcccattgctcccatttttcagaagaggaatcgcggggtagggagtcgggggagtttggtcttgccccagatcaccacagtcagtgatgggggtgggccatctggctgctgattcatttctccttctgttacactaagcctgcctcagatttccagccggagtgggagctattgttaacccctggcagatacttccttgctaagacatcctgtttatgactgcgaggcagctgcggaacaccgttttgctcagaacattatagtgggtagaagccatttcaaggcatttggtgttgtgattggcacctgacttcaagcacactagctttgtgaagagaacagttacatggctgcaaagtgtggtttctggtgaagatcaacatggccagatacaacttaatgccttttctatgggggaggggaaggagtgcattttatttctcatttttcataattaagaaaatatcggccgggtgtgatggttcatgcctataatctcagcactttgagaggccgaggcgggcagatcacctgaggtcaggagttggagaccagcctggccaacatggtgaaaccctgtctctacaaaaaatacaaaaattagccaggcatggtggcgggtgcctgtaatcccagctattcaggaggctgaggcaggagaatcgcttgaacccaggaggcagaggttgcatcgagccgagatcttgccactgcactccagcctgggtgacagagtgcgtgagcctccgtctcaaaaaaaaaaaacgagaaagaaaatgttatcccagtgggataatagttatacacacagtattctgtatatcttctcccagaattgacagttgttaccattctagcttaatagttttctcttgccctttgtgtgtgtttgcatatgtgttcatgtgtatgattgctgaattatttgaaaataagttgcaagcatggtgacagttctgtcctcagtacatcactaagcttctcctaagaataggatatcctctagcataaccacagtattcattgccacatgtaagaaaattaacaatagtttcatataatctaatattcagtttgttgtagaatttctctattgtcctaagattatcttttatagttgttgctgttttacaaactaagatctgattaaggttcacttactacatttgtttgttatttctctttagactcttttcatgctaaataatttccccaaacttttttttttttttttttaaatgacactgactttctgaatagttaagggcatgtgtcttgtaggatgttccttccctacaaatgttccctttgaataaagtattttcctgcttggtatcagcttagtctttttttttttttttttttttgagagtcttgctctgtcgcccaggctggagtgcagtggcacgatctcagctcactgcaacctctgcctcctgggttcaagcgatcctcctgcctcagcctcccgagtagctgggattacaggcatccaccaccatgcctggctaatttttgtatttttagtagagatggggtttcaccatgttggccaggctggtctccaactcctggcctcaggtgatctgcccggctcggcctcccaatccgcttattcttaagacgacacatggctagggcagtgatgctgaccacgtgctgttctcacctcagtggtcgagtcttctcatctgactttttgggcatgatttagaccggcagatagttctggaacaaaccccttaccatttgaggttccgtttgcagtgggttgtgaggtgtgtgagacatcacttgtgttatgtagggactagggacttcaaagccctcctcccattcacagtcacttgaaggctggcatgtcctcactttctttaaaagtgctttctttggccgggcttggtggctcacacctgtaatcctagcactttggaggctgaggcaggcagatcacaaggtcagaagattgagaccatcctggctaacaaggtgaaaccccatctctactaaaaatacaaaaattagcttggcgtggtggtacaagcctgtagtcccagctactcgggaggctgaggcaggagaattgcttgaacctgggaggcggaggttgcagtgagccgagatcgcgccactgcactccagcctgggtgacagaacgagactctgtctcaaaaaaaaaaaaaaaaaagtgctttctttaaggcataccacaggtggtggctggaatgaggaatctctgactttaaaggttatgcttccttaatgacaaaacagttgcaaacaaccaattaaatcctttgtcaaccagattggtcaaatggactgaatctaatcaaggcatagtgtatgtttgtaataaccttatcactggccatccggcttccctgttgttaatgtgagacggtttcctttcacggtgctattttctagaaaatgatcacttgttatggttcaggaatgtggctggtcattgccatttccttcatctgcctcttagcaagtgtggtgcacttgtagaggaaacacacccttttaaaaaaaaatttttttttatatgtgtgctttttgcatttttttaattgtgggaaaatatccataacataaaattcactattttaaccatttttaagtgtggcattaagtgtattcacgttgttgtgcaaccgccactgctatccatctccagaactttttcaacttcccaaactgaaactccatactcattaaacaatagcgccccattctcccctctcctctgctcctggtaacctttattctactccctgtctctatgaatttgcttattctagggacctcctagaagtgaaatcatatgctgtctgttaggtacctcctagaagtggaatcatacgctgtctgttaggtacctcctagaagtagaatcatatgctgtctttttttctctggcttacttcatttgtcatatgttttcagggttcaccatgttgtagcatgtgttagaatttcattcctttttaaggctgaataatattcctttgtacgtgtatatcacattttgcttatacattcgtctgctgatagacatttgggttgttacattcttttggctattgtgaataatgctgctatgaaaacatgggtgtacaagtgctgtttgagaccctgctttcaattcttttagggatatacccagaagtggaattggtggatcatatggtaattctatatgcagcttatttttcaggaggaagtggcctcactctgctttttaaagtaggagacaaaatggtcatattaggtgacagggtcacaaggccacatgggtggggctgtgagatatgtccctgtcatgtggttagatgaaagccggggtcagttttggtcttctctgtgtgaccacattgcttcatttctgccacctgagcccaggaagagagaccgtttcatcttctagtttctaaaagatttgaaagtgttgttttattttttatttcctgattgtttaatagatgccagttgccagccagttagcatttgttgatccattcactgagtcccaccttgcttagttctagtgggttgaaaggagagagggctggggtgaggtggacctccagccacaaacagatctttgtggtgggcttccttgcagggttagctatgtgaaaagcattcgtccatgagctaatcagaaatctttgtaaaaatctagttctctatgaagcatttactgtagagcaatccttaagcacccttctatctgagtaatcagaggggtaccagttgtctcctttcatggtaagcaaagctccgcagaagtttacagagttggggtgtggttcaactttctaaccagccatggttagccacgggtgaccaacccaagcccagacctttgacaagctgcagagtacgttgtttcttaggctgctggagtcacacgaagtggaacttttagtattttaggtgcatgtttatttacttacttatttttgttgttgtcgttttcagatagagtctcactctctctctctgtgtgtggagtgtcgtgatgccatcacggctaactgcagccttgaccttctgggctcaagtgattctccctcctcagcttccctagtagttcggaccacaggtgtgcaccaccatgtccagctttttttttttttaatattttagtttgagaccagcctggccatgttgcccaggctggtctcaaaatcctgagctcaagcaatccccctgccttggccccctcaaagtgctgggattacaggcatgagccaccatgcttggctattaggtgtatgtttaaatccatttgcttatatcagttacataacctgagtgttatgtaaatcttaagcaaaagaaaaatatatgaaataaaaattgaaactcacttcccaactgccaatctcattcctgccttcaaagtttcaggtatttatttctagccttttttctatgctgagttaaactgtgtatcttctttgctttgcatttcttactgagcagtgtgggaaggctaccttttaaaatttatttgtagttctttataatttttacctttctttttaggcagaaagattatcttattatataacagtctacggccattttttcttaaactaaattattgggaaatgaatagaaatccagagtatagtaacaaatgacctagtgtctttaacagattggtagctaggaaaaggaagtggtggagagacagccggagattaaatgagacttaagagacttagcaaccatttgtaatatgtgaccttatttggatcctattcaaactaatggttaaaaaaattcatgatagctgggcatggtggctcacgcctgtaatcccagtactttgggaggctgaggtgggtggatcacgaggtcaggagatcgagaccatcctggccaacgtggtgaaaccccctttaccaaaaatacaaaaattagctgggcatggcggcatgtgcctgtagtcccagctacttgggaggctgaggcaggaaaatcgcttgaacctgggaggtggaggttgcagtgaaccgagatggcgccactgcactccaggctggcgacagagctagactctgtctcaaacaaacaaacaaacaaataaaaattcatgataaagcagcagctcaaggtgctgtaagaaattcatgatatttataagataattgaaaatttgaacactgaatatttgacattaaggaattatttttttttatatggtatcgatattgtgggtactttgcaagtatcttttaaggatacatagtgattgtggataaaaaatctgaggtctaggatttgtgtcaaaataatacaggaaggggaggtggcgggagtgaaggtgaaacaagaccagctgtgagttgatagttgttgaagctgggtacaggaggtccactgtgcagtgctctctacatctgtgtttgtaattcttttttttttttgagacggagtctcactctgtcgcccaggctggagtgcagtggcatgatctcggcccactgcaacctctgctgcccgggttcaagcgttctcctgcctcagcctgccaagtagctgggattacaggcgcccaccaccacacccggctaattttgtagttttagtagagatggggtttcaccatcttggccaggctggtcttgaactcctgacctcgtgatccacctgcctcggcctcccgaagtgttgggattacaggtgtgagccactgcgcccagccttttttttgagacagagtttcgctcttgttgcccaggctggagtgcaatggcacgatctcggctcactgcaacctctgcctcctggattcaagtaattctcctgcctcagcctcccaagtagctgggattacaggcatgcaccaccacaccccgccaattttgtatttttagtagagacaaggttacaccatgttggtcaggctggtcttgaactgctgaccttgggtgatctgcccaccttggcctcgaaagtgctgagattacaggtgtgaaccacggcgcccagccttttttttttttttttttttttgctgaagtttcacttctgtttcacaggttggagtgcaatggtatgatcttggctcgctgcaacccccgcctctgcctcctgggttcaagggattctcctgcctcagcctcccgagtagctgagattataggcatctaccatcacacctggctaatttttgtatttttagtagagacggagtttcaccatgttggccaggctggtctcgaactcctgacctcaggtaatccacctgccttggcctcccaaattgctggaattacaggtgtgagccactgtgtccagcctagtttggaattcttcataataaaaagctttttaaaaaggtaatatttggacttctgctcctgggaagatggaataggacttttcctaattctttcttctaactacaactaaaacccctgggctatacataaggaaaacacagggagcctctgaaaaaggatgaggcagaccaaccagggatcttgggactcgaggaatgacacagtactgagttccttgggtttactttgctttatatatcccagacttggagccaaagaaagaagctgacaacctgaaaatgccagtgggcacaaacacagaaagtgccaacaaaagctcccctgtccagccagaagaccaggaaagggcagcccagtgaggcagaaaacttaaagagtcactgctctactccaggtccacaccatagaaaaaactatgcagccccacacttacacccgcagaggtgaatggggagcctaggctttgacaacagtctagcaataaggaagccactctccggggccatggaggagcagtaatgaggcactcctacttcctccagccagaactcccaccttcacgcaccagtaatgagccccccaatcttgagcatcagtcgaggttgaatggagagcctagacttcttcccccactgttagtaacaaggtgtgtacccttccctcccctgccacagtggtatcataaaatgccagctacaacagaacatttacagaagacccagagtctcattacatgataccccaaatatccagtttcaaaaaaaaaaagaaatcacttgtcataccaagaaccaggaagatctcaaactgaatgaaaaagacagttgatgccaacactgaggtgatagagatgttagaatcctatgacaaaaattttaaagcagccattaaaaaaggcttcagtagccaggcgtggtggctcactttgggaggcttgtaatcccaggactttgggaggccgaggcgggcagatcacctgaggtcaggaattcgataccagcctgaccaaccttatgaaacccagtctctactaaaaatacaaaaaattagccaggtgaggtggtgggcacctgtaatcccagctactcgggaggctgaggcaggagaatcgcttgaaactgggaggtggaggttgcagtgagctgaggtcatgccgttgccctccagcctgggcaagaagagtgagactccatctcaaaaaaaaaaaaaaaggcttcggtaggcagttaagaacaatcatgaaaaaaatgaaaaaattaaaaatctcaacaaagaaatacaatgtcccagcaaaataataataaaaatttaggagataaaaagaaccaaatggacattttagaattggaaattgcagtaactgaaataaaaacttattggataagcgcaatagcagggtggaaggacagagaaaagaatccttcaactggacaacaattggttgttttgttctgaggtggagttttgctcttgtcacccaggctagagtacagtggagtgatcttggcttactgcaacctctgcctcctgggttcaagctattctcctgcctcagcctccctagtagctgggcttacaggtgcccaccaccacttctggctaatttttttatttttagtagagacgtagtttcaccctgttggcctggctggtcttgaactcctgaccttaggtgatccacctcggtaatccaccttaggtgatccaaagtgctgggattacaggtgtgagccactggacccggcctctgtaagcttttttctgtgtttaaaacttttcatttttgtacttttaaaacttttttttttttttaaacacacacattagtctagacttacacagggtcaggatcatcattatcactatcttccacctccaaatcctgtcccactgtcccactggtaggtcgtcaagagcagtaatgtgtggaaccgccgtctcctataataacaatgccttcttctagaatatttcctgaaggacttgcttgaggctgctttacagttaacttaatttttaaatagaagatgcccactctaaaatataatgataaaaagtatagcatattaaatacataaaccagtagcattgtcatttatcatcaagtattatgtattgaacataattgtctgtgctatatatgtttctatggccggtagcccagtgggtttgtttataccagcatcatcacaaatacatgagtaatgcgatgcgttactgtgacgtcagtaggcaacaggaattttttggctctatttataatcttacgggaccatcattgtatgtgtggactatttttgactgaaacttcattatttagcaaatgactatattagcaaataaaattgagctgtatataatgaagaagtatgcattataaccaagtggggtttattgcagggatgcaaggcctcgttcactattagaaaatcagtcaacagcctggctcggtggctcacgcctgtaatcccagcactttgggaggccgaggtgggcgatgggcggatcatgaggtcaggagatcaagaccatcctggctaacacggtgaaaccctgtctctactaaaaatacaaaaaattagctgggcgtggtggtgggtgcctgtagtcccagctactcgggaggctgaggcaggagaatggcatgaacccgggaggcagagcttgcagtgagccaagattgtgccaccgcactgtagcctgggcgacagagcgagactccgtctcaaaaaaaaaaaaaaaaagtcaaatagtaaagataccacctctcctcaaattgtcattcaggtttgatgcaattgctgtcaaaatcccagcaagagtttttgcagatagcaagattattattttaaaacctatatgaaaaggcaaaggaattaaagtagcaaaaacaattttgagaaagaagtacaacatggaggaatcagccttcctgatttcaagacttgctgtatagctacagaagtccagattttgtagtattggtcaaaggatagacattatagatcagtgaaacagaattgcagccccacacaaatatgcacaactgattattgacaaaggtgcaaagataagtcattgggggaaaaaaccttttcggcacatggtggcagagaaattgaacatccctaggcaaaacaaaacaaaagcaaaccccaaaccaaaaaacaaaaaacccatataactataaaactttgagaaaaaaacatagaagagaatctttgagatctagagctaggcaaatagttctcagatttgacaccaaaaacatgatccattaaaaaaaaataagttggatttcatcaaaattaaaaactttttaatgttttaagaaggatggtctgtctcaaagactcaacatggtacatggtggttggcctttatgtgctgttgagggttttcctgcattgaagggtgcactcctgggtcacctactgtcctgcaagacaagctgtcttagccctcacactataaaagccacccggacaccgtctcaaacagaactcaaaatgttgctgagactgggatctgggggctggattttacttttacaaacaatttaaaactttttacagttaagaggatgaatatacaggctaaagactgggagaaaaaatttgcaaaccatatgtccaacagaacactagtatctagaacatgtagaaagaactctcaagtcttagtcgttaaaaaacagacaaacatttaaccaaacaacccaataagaaaatgggcaaaagacataaacagtttctgctgaagagaacgtccatatgacaaaaaaacacatcgaaatttgttcagtatcattaaccatgagaaaaatgcgaattaatcctagtacacactatcagaacggctaaaataaaaaatattaatactgataacactaaatgcagaacggatggagagaaactgaatctggatcactcactcatacattgctggtgggaatgtaaaatggtgtagctactttggaacactgtttggtagtttcttaataaagaaataggctgggcacagtgactcccttctgtaatcccagcactttgggaggctgaggctggaggatcacttgagcccaggagtttgagaccagcctgggcaacatagggagattgcatctctacaaataatttttaaaaattatacaggtgtggtggtatgcacctgtggtcccagctactcaggagattgaggcaggaggattgcctgagcctgggaggtcgaggttgcagtgagccgtaattgtgccactgtgctccagcctgggctacagagtgagacttggtctcaaaacaaaaacaaaaacaaaacctcaaaaaacagtacatgcaactaccatatggcccaacaattgcactccttggcatttatcccagaggaatgaaaacttactgtatatgagagccactgtttttccttctatagtctcacagctaaagaaaaaaaacttttctcatcttctctactactcctctcagtatttcgcttccggtcaccaaaatctatggatttctgtcccccatactgacaagttctccaattttatgtggacaacaagtaggtgtcctataatcaattcccttcaattctgacactatctacctgaagttagtgcagacgccattaagggctcggtccctcaaaactgcccctgacttcagaggccagtcagaagtggtgggtcctcaggtaacccacagcttctgtccaggtttgctacaaatcagaaggtcccattaccccttcctcatgttatgttatttgctagagtggctcacagaactcagggaaacacttacctttagcagttgtgtagtgaaggatatgatagaggatacagatgatgccccagatgaagaggtgcacggggcaaagtttagaggcgttttgaacacaggagcgtctgtccccatgaagttggggtgggccatcctcttggcacatggatgtgttcaccaacccagaagctctctaaactccatacttcagggatgtggaggctaagtcacgtaggcgtgattgacattaactgagactacagttcctctcccttccctgtaggatggggagtggggccgaaagttctaagcttctgatcatgacttggtctttctgttgattagccacatcttgaaagctatccgggagcccactaagagttgcctgattagaacagaagatgctcttgtcaccaaggacattccaaggggtttaggaactctggaaccaggggcagagacctatatatataatttcttactattttatacttatgttcacacacacacacacacacacacacacccctatgcacagatgtttacagcagctttattggtaagagacaactagaaacaacccagatgttcttcagtgggcgaatggttaaactgtggtacatctataccatggaatattagctactcagcaataaaaaggaaaaaaaccattgacagaagcaacaacctgggtgaacctgtagacaattatatgtagtgaaaaaggccactcctaaaaggttacatagttatgattccattgatgtgacgttaccgaaataataaaattacagtgtggagaacgggttagtggttatcagggctaaggagagtgtgggtgtggttatgcaagggcagcaggagggctccctgtgctaaagggaatgttctctattttgattgtatcaacgtcaataccctggttgtgagattgagtcatagctttttaccgtgttaccactggggaaactattttgagatggagtcatgctctgccgcctaggatgcgatctgggctcactgcaacctccacctccctggttcaagcaattctcctgcctcagcctcccaagtagctgggattacaggcatgtgccaccacgttgtatttttagtagagacagggtttcaccatgttggccaggctggtcttgaacgcctgacttcaggtgatccacctgcctcagcctcccaaagtgctgggattacaggcatgagccaccgctcccagcaagggcattgtttcttacacctacaggtaaaatctgtctcgatgaatttgctcgatcatcttaaaataaaaaggttaattaaaaaaatgattgaatataatttttaaaaatgtcaggcaatacaataaatgctgtttaatgagaaataagcttcgctcctccctgctgtgttgcttccatcaaggcaagctctgctactacttattaaccacattatttccacaattttatatagactcctgactgaggttctctgaatatcaaaattggatattacttcaataacatgggcaaaattaaggctttcgacctgcctgattttccttgtcaaggcagtttgtccccatttcccacatgggatctgcagggctgggtcccatctctcagttccctgaaagagatgcagtgggcgatggctcatgacacaccctcgcctggcttctaacatgtctgtgtaaacctgtggcaggaatcgagcccactggaaacatggtgaagcagccagccaagttcactgtggacaccatcagcgccgggcaaggagacgtgatggtgtttgttgaggacccagaagggaacaaagaggaggtatgttggaggatgctgcctctcctttccagcacctcatggagcttttggggcttgtaatgcggccagggactgtgcctccattttcatttcagctcacaaccaaaagtgttttttaccaaaaggatactgaggcttatagctgttaaagtaacctgcccaagaggtgagccttgaaatcaaatttaaattgattgccagggacacagtgtttaatgaaataaaggatactttggatttagcaaaggtgccttgtcagttgaggtttatgtatgtatttatttatttatttatttatttattgagacagagtttcactcctgttgcccgggttggagtgcagtggcacaatcttggctcacggcaacattcacctactgggttcaggcgattctcctgcctcagcccggctaatttttgtaacccaagtaactgggattacagggacctgccaccacgcctggctaatttttgtatttttagtagagacagggtttcaccacattggccaggctggtcttgaactcctgacctcaggtgatccacctgcctctgcctcccaaactgctgggattacaggtgtgagccaccgtgcccagcctcagttgaggttttatatactgatggccagaataataagagtcttgccctgctctcttcccacattggccattctttggttcctccctcagagcctttgcacatgctgttctttctgtcacttattttcgtaggaccatattttattcttggcatttagcataatttgcaattctaagtttacagatggatggtccatttcccccaccggggcagggattgtatctgacttgctcatgttttatttttagtacctaacactgggccctgcatttcataagctttcaatgaactattgagtggataaaggtttaagtttcttgcttcatattctctcttacctagagagtgccagcctgacactggacactggagagtcctgactctgttatgcctctgtgctgcatggttttgtttctgtgacttcaagcagtttctctctaggggcgttgtgcaagagggacaggagctcgccagcaccttcagtgtttccgacctggcagctcctgcagaacccctgctgacacagcatgctccttactcacacccggcaccttttctaactgttgcccaccttccctcctaggcacaagtgacccctgacagtgacaagaacaagacatactctgtggagtatctgcccaaggtcaccgggctacacaaagtaagatgaagcagcatggctgtggcttgggctgctctggggctaggagaagaaagatagcccaggaagaagagtgtttttcttaagtgaatttctgattttcctttctgattatagaaggatctatgctcatgatagaaaattggaatcactaggattccctctactagctaggatgagttgtttgcaatgtcgtaagatttttccaactccatctaggtaactaatggttgcagctgtgtgtctggagtgtagatgctgtggtgactacactatagatgggttctttgtccttgattctttttttggagacagggtcttgctctgtcacccaagctggagtgcagtggtgtggtctcagctcactgcaacccccgcctcctgggctcaagcgatcctctcacctcagcctcccaagtaggtgggattataggcacccacaaccactcccagctaatttttgcatttttagtagagaccaggtttcaccaggtcacctagactgttcttgaactcctgacctcaaactatcctcctgcctcagcctcccaaagtgctgggattatagacatgagccaccacaccctgctggctctttgtccttaatgctttcttaagaactctccttggaggtgctctggaggagctgtcagcattgaaggctgaggatggagtagttcagctgaatatagtagagggaaatggccctctcagcacctggagaaatgatagggattgaggcctcaggctctttgtcttggcagcctttcgagttctgtttgagatgacatccaggtgacctatagggcaagggctgagagagcctgtcttgcaggagagtggggtgacccaggagtacacttttcattggaagaaagccctcaacagcacataaaggccaatcccatcatgtacctgcccagactttggaatacagactgtactcaccaccttgggctttagtgaattcacctggaatgatggccttagcgttctcttagactcttagactatgatgcatttggagtaaatgctcttgaagggagcatttataatgtaattaattaattccagtcaagtataggttcacatgaaacccaacccaattaccccccaaaaatttcagagatgagaacagtgactcaagttttagatggaaatcattctactttgtcccaaatccatgtatctaagaatgattttcgtcccttgaaaaaacagtttggctgtggatttgaaatcctggaactgcatattttattctgagggatagtggcccattcagcccccgaaaggactcaatgtccagagattgaaatgtgtttgtttcctattaaagagactaagtgtatataaggtcagcatttttattttgctaaaggtgtgatgtcccagacccagctgtatggctgaaggggccaggtgggagtcccattcaggctgttaaacttggttccagggctccttattctagacaccttgtgtgtgccatcatgggagggtaggagaggtgatcatcaatgtatgtggcttgatgtcagtcttgctgggcacagagaagtgattatgtatttctcacctatctgtcacctataggtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggtaacgtgcctctcctccatggatctgacctttgcgctttcttccagaggctgaaatataatcctcggggacttgaaggcctgaccttttgtcttttaaatcaaataaataatcacaaagacaattttttcaaatgtgttatattagatttttcaaaaccagcttttcttctctaaaatactcaggcttcacttgaataagacatacttcttgaattgttggcttcttttccatgtagtaaatagaaaatgcagaagaaggaaacattcaaccataaacccttcaacccctagaaaatagttgttaacatcttggtgtggacctctctgagggcctgtctcctgtttacttgttttgttgttgttgttgggggaacagagaatcactctattgcccagactggagtgcagtggcgtgatcttggctcaacgcaacctccgcctcctgggttcaagcgattctcatacatcagcctctcaagtagctgggattacaggcgtgcgccaccatgcttggctaatttttgtattttttttagtagagacggatttcaccatgttggccaggctggtctcgaaatcctgacctcaagtgatctacccacctcggcctctcgaagtgctgggattacaagcatgagccaccacactggtcctgtttgcattttgcactcagcagcagtgagctttcagagagggtgacttgggctcatggaatgcttgctttcttgtaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaaggtgagtgctgggctgctggccacatgtgcttctcatagggaagctgactgcacagctgggcagggaggccaggaaaacagtcagggcccaacattgaccttatgcctatcccttttctgccagggctacttcagcagtaagtggcttactttgtcctcaatatattaatattaatatcttctatgagccacgcagagacctaaatgctttgcttatattaactcatttacttctctccaaaacacatgtacaggagagtaattatcctcatggagggaggtgggactgaggcagtgggaggactcggtagcataactgaagttagcagcagcaacatgggccctgcagcctccattgcttggcctttactggcccaggcacttaccatgactgcatctaatcattgcaccagcctgtgtgttgcaggtgctattattatccctagcttgcaggtggagatgctgaggcttagatagcgttaggtatcagtactacaaggcatcagcagggctagaaccacagactctgttggccttacccttaactactctgctaaactccctctggcgctgggggtacgcatttttctcaaatgttagactctctccctctgactttgttgcccctttttttctgttttgttttgttttgttttgttttccaactgtactaccttttctaacccacacttgcctttccctgttctgtcctctgaatctgcgtctgcagacgtggcttcctcttccgaatcctacctctgggccagcctggaccctgaagctgttggcttcctagttgagaccactgggccagaggcctcttgcttggtaagggctggttgggtgggacttccttgccagttctttgtgctgcttgtgaatgttagctgggcccgtgttctgtgtgattttaggaaactctgtgcaggtgttattattacagcctgtccagccggaacccaaacccactgtctaattgcctttaaacacatctagggcttttttagatggtgaaggagctggtggtgcccttcagactctagccccatttaatgtttatatgaactcagcaattactcttttgatgttgagactgttgcacatgttcataatttccatgagtgtgtgtgtgtttcttaagacacattaaagccctccgaggaagtcctgtcattgtattgtgactgacttctggtatgaccaacttttctccccttgacaaagaaaaaacaggcaaaaaaaattctaacatattcctaagcaaagctcttttttacataagagagcattttgaatagctttcctaattctactattgttttccaacctttcctcactcgtggacttcctttttcttttctggcctgtacatcctatactatttagcatttaatgaataacctttttcttttaatttactaacatcctctctcccacctaaatgattttacatatgtaaaaaaaaaatatatatatatttgcaggggcgcggtgggaaggatacagggtctcactctgtcttttgggctggagtgcagtggtaccatcatggctcacttgtagcctcgacctcccaggctcaaatgatcctcccacttcagcctcttgagtagctaagactgtagatgtgcgccaccatgcctggttacattttttaccctttttttttctttttctttttctttttttttttgttttgttttgttttgagacagagtctcactctctcacccatgctggagtgtggtggtgtgatcttggctcactgcagcttctgcttccctggttcaagtgattcttgcctcagccacctgagtagctgggactacaggtgcacaccaccacgcctggctaagtttttttgtacttttagcagacacagggtttcactatgttggccaggctggtctcgaactcctgatgtcaagtgatccacctgcctcggcctcccaaaatgctgggtttacaggcataagccaccatgcctgacctaatttttcttttttttgtagaggtggggtctcactctgttgtccagactggtcttaaacccctggactcaagcaatctccccgcctcagcctcccaaagtgctgggtttacagatgtaaattattttatgttaaaagaaactttatatcactttcacaatggaaaaccaaagtcacttgccataaagtgccaccgtaagcttatgttcatccataaaccatctaaaatcatctctaactccaagggtatgtgtatgactctttgggaagcagttgtttgccaaatagccagctaaggccattgcaggaaggaggaaccagaggaggaattaccttccgtctgtggagtagagtcccgtcttctggagtctgtgaccttcctgtatagagatttgtcaaattttcagtgttagatttggaaaggaaaagccacttaataacatgacattttccccactagtctcccgtttctatttactgaaaaggttgtccgtgctgggcagaagatttattctagggcataaaggtatcttttatcaacctctagataccatggaacagtagttctgtggacatttcaagtaaggcatattggaagctatcttcgcccttaacttttagacttacaactctaggttttcaagctagacccggaaatgaaatcagcaatggtgtttactgctaattattgcctttatagccacccacattctgaaggccttgtaacagacagcacgaaaagattggtctgcctcagccaaggtggggctgaactggtctctttccaagctgtgttggttgtttttgcctggttgttcaggcggaagacaacaacatttagacacttaaaaatggctgacccaggttttggaacccagacaggcattttcaagtactgcattttccaagaagacttgaaaaagtccagtctatccaattactgagcccttgagtatggcagtgaggtttgaataatgtccagcactcggccttaactccctttcacaaatgaaaggttaaatgctggaagcaggagcacagcatggatttgctgtgctctcctgttttctttgccaaagtcacttttctccagtccttctgtggtgtcactggacaaagttatattgtgtctgtatttgctagcctggtgtgctccctgagtgggacccctggtcttgggcaactactgcatactatttgtgcaaagcaaatattttcttggcgggtggctccaggttaccttggctttcacgactctgactaaagaatgaaagattgaattgatgtcaaaactgtgcttgcagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctagtaagtgttcctttgtttctctatctcaggtgtggttttggctaactttgcagccatggcatatggatttcatcccacggccagttgtcctcaataatcccagaaggctatgtcaaggatttgaggctatctgggctccttggggaagacggcagtgattgattagtaatgtctgccctggatgcggccagtgggtggcttgacagctttacattacatcaagacttctgggagtagaaaaagcagtgatgtaaaggagttggggaaatgctgctgttggaacaagtggctcattttttattttagacatctgggctcagagaggaaggctcttgcctaaggtcatacagcgtttgtaatcatctgagctggaattcaagcacagtctccaaagccagtgattttcccactacaggttacattttatagagtatgaaattatgtcaagtacttaattactatgatcagtgcttatagaaggagaataaaattccctaagattaagttttctttgtagataaatgccatttgtggaggtacaggttaaaccctgcaacccattctctctccctcttttggggaaggagacagcagatgtggggatgggtgtcttcacttttttcgttggaacagagaagcatttcagcacttctagtctcgggtgtagcagcctttggtggttttactcccatgcctgtggaatcttgagcttcctgtaccaggattgctcttaccttctgtgttcccaacaggctggggcaggagcattctgagctccagaaagttaatatttgacttcacagcaccaggctttgggtcaggctgtgccctgagggtagccgaggttctagactgcccagacctggagtcaagctgcttggggactgtcttccctcccagattattccaacaggagccaaggagggtgtgtgtgtgtgtgtgtgtgtgtgtgtgcacgcgcgtgcatgcctctgcgtatgtgtgcgtacgtgtgtgttttctcctgaccttgaatacttgcttgactcaacggctttcctggccaaacctcagggctcaacacaaaacaagttcctgcctgatggctgggtttggagtttgcagcgtcacatctaaaacctgtcctcttgcagatagcgtctgaggactttcttgcttttgttgtccagctttagatggaaaagtatacgctggaacactgaacctaaaactcataccaaatacttctaaaggtttacttcttccccagtttttgtgggggactaggaagggtagctatgattattgggaaatactgaaatgtgactggatttatctttatgcaggcccagggagttcaggacctcagggcccctcgtagccaagcaagatttctaaagccaattagctgggaaatcctccatttcctcataccttgaagcagagatggctgtgtttttagctttgaaataatctcccaggctttgaggggagaggtcccatactctggggcagcccacttggtttttatgtatggtttatgttttgttcagtgtggctgcctctctgttcttgtccttttgattctcattttgggcctaggattgtgttggaaagattatctccttccttcccacagagggtctggaggagctggtgaagcagaaagactttctggatggggtctacgcattcgagtattaccccagcaccccggggagatacagcattgccatcacatgggggggacaccacattccaaagaggtgaggctcctgctgcagaggggtcttctctggagggtgctcggcccagggcggactcatgggtagttgcttcccgggctgcaggagggaaagagatctgctttgttgaaaactttttttttttttttttcggagcagcacagacatttggcctgttctcaaaagcagcagaaagttgctgtggttttagctgacttgctttaaatcaaatgctggtggttaggggctggtgggaggcaggggaggcagaaggagcagttagagcaaatgggctgtgtgtctagatgcccgcatataaactgagattctctttttcaatgaactcctttgttcatgaatgccacggggcagaatctgctgtggtttacattaagaccgtctacgtgagtgctgtcaggggccaagggacgcagtctacagctttgccttgtgggcattgcacttgcccctctgcgttctgtgttttccagctcccctggaggtgcaactttaaactccgaataaattcagttagccttgagaaatatttgggcattattgggttccgaatacctaccacgcttttttttttaagcctcccatgccaaggttacagcacattcattcatgtatgagataaagcccattcaaccaagttttctggttatagcataagcaggatatagtgtgtggactctctcactttccagggtcatagtctggggaggcctgcacacaaaggtaaagggccaggaggctggtgcaaagcagcgtggcttgagtgccaacccagtggccacctgagctcccagaagcagtcacattacattatattgttgacataacagtagctatgggtgagaggcctgcaggaggaagggcttggctgcagtttgggatgccagatgaaaggatcaggcaagtggaaagaatgtgcaaaggaactgcagcttatggctatagtgacaccttactttactcttctttgatgcttcttctattcctttccctgtagcccctttgaagttcaagttggccctgaagcgggtatgcagaaagtccgtgcttggggccctgggctccatggtgggattgtcgggcggtcagcggacttcgtggtagaatccattggctctgaagtggggtctctgggtaagtggacacagctgaccagcatcttctggaggactgaggattacagggcttccgggctgtgtcaggctggatgttggggccttgcctagcctcaatacctttagcttcctggcctcctggccaccctaagccatctctgcgtgctgctgtacatttgcagttgcctctgataccagcattgattcattcaggagaccttgagggcagaaaccttatgtgggtattgtgcctaaaacaatgcttggaacgtagtaaacacttagcaaatagtgttgactgacctttatagtttagatgaatgaatgaatgaattttgctgaaatttggatttggaagataaatatttcctttggagcacagctgaagtatattttaaatacatgtctaatgtatatatgatcattttatatcaggagtcagccagctttttctataaaaggccagatggcaaatattttccacctgtgggccttatggtctctgtcacagttatttgactctgccgttgtagcctgaaagcagctataggaatacgtaaacaaacgtgtgtggccatgttccagtaaaactttatttgcaaaagtaagcaatgggccagatgtggccttcagactgtcgtttagcaacccgttttaggtaatagcaataagcaaaagagaaaaataagaaatcacatttaattttcccttctagagagatgatatgaatcgtcttgtatattcttagtctagagataatattaagtcttttagtgtatccttctagacttttttctctatatatgcatgcaaatattgatttggtacagaaaatatcttagacaagtctttatatctttatgcgtaaatatagggtatgccttcattttccatagcttccatggaattccattgtatggctctatccattgtcaggctcttcagttatttccagggttttgctataaaaacagtgctgactgtgtatccttggtaattgccttcagataaaaacccagaagtggatttggtggtgctaagagtgggtgttggttcaaggcttttgccacatgttgccacatctccaacagaagggtttgctggttggacttcccctgttggatgatgataaaatacatataatgtatttaatactatatatatatatatatatatatatcctcctggcctcaagtgatccacctgcctcggccctcccaaagtgctgggatgacaggtgtgagccaccacacccagcccaggcctacatttgaaaaaaaaaaaatatatatatattttccaccccttccatctctactgaagacttaatgagcttggttttggaagaaagggatacaaacagatttcaatcttctggccaacacttggcttttagggaggcagcgggaatgagctgtcgtaacatagaataggtgctttccaccatataaccagggagacccttccacctccaccccctagggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggtgaatcagctgctgtgcttctgtcttcttgtccctggcccctggttcctcacccccatgcccgaagttgccttaagcagcatgttgagagatggcagagaggaatcatttggattttaggaaggaaacaggcctgcatttgtttgtttgtttgtttgtttgtttgtttgttttgagacagactcttgctctgtcgcccaggctggggtacggtggcatgatcacagctcactggaacctctgcctcctgggttcaagtgattctcgtgccttagcctcccaagtagctggaactacaggcatgtgccaccacagctggctaatctttgtattgtttagtagagatggggtttcaccatgttggccaggctggtctcgaactcctggcctcaagtgatccacccgcctcggccctcccaaagtgctgggattacaggtgtgagcctccacacccagcccaggcctacatttgaatcctggtagtagcacttagcacttttatagtgttgggcaagtaacttacctatctgactcttggtgtcttcctctataagacaggaatgatagtagtctctgcttctagagagcttctaggatgattcaggaggtggcatgcataaagaccgcctttggcttatgcctggcccatgcagggagctccataagctgttattttcttgcaactccggggatcatatgtcagtcttacagccattttctatagttattatttcaaggtgctccatagataaaggatttttttttcctagttccgtgtctcttaagttggagcaatgtttccaagagtgtcctctcaaacccttagcaggctgataagcatcaagtctgagccagcctggctgacagggagttggccccagaggccacgtgtgctactgttggcccacacgggcagctgtccataggctgatgtcagtctgggctggtagctaccccgttttggccaaatgatattcctttgccctctagggcaaatgttgtccgtggtaaagattctgagtcccctcaaagtgggaacgttgaaactgggcatgactagaggtctctgccccagttgttagaagttctttaggtcaactcagaataaggcagggagcatgggttagtttgggcatggttttagaacaggggtttccaatattttgccttccctgggccacactggaaggagaagaattgtcttgggccacacataaaatactaatgatagccgatgaacaaaaacaaaaacaaaaaaaaaattgcaaaaaattttataacattttaagaaagtttacaaatttgtgttgggctgcattcaaagccatcctgggccgcatgcgggcttcaggccgtgggttggatttgtttagagagttttctcccttatgagggagagacatttgtttttaagttacaacctactttagcactttacttcccataaccaacctcttatgtggatactgtaaaaccagacacaggtcattttgttcttcccccaccccctggttacctgtctttgtataagggtttagttggggcattacacagaaagagacttactatctgcctttgcttcaggttcgagcatacgggccaggtttggagaaatctggatgcattgtcaacaacctggccgagttcactgtggatcctaaggatgctggaaaagctcccttaaagatatttgctcaggtaaatttcagggggccacctgtgcaggtaattgtcaggtaacaagatctgaccacgtaatggcaagttgctgagtccatctgatcttcagtttcctcatctgcaccgtggaaatgataagaagattatcttatagggttatgtgagggttcagtgagactaccatgtagagtactgggctttaaaaaaatcagctttctgatttatattctgtggaaatgaggcttgtttgtttcaggttattctataatgtcttttggtgtggctgaagctgctgaggccatggggggagatttgtaaacaaggatttaaaaagtatgtttatttaatctaattgaatttggccaaaggacttaaatgcaggaattgagtggccaaagctttgtttttgggtcacttgctcttaataactaaaaataaataaatgcatgtcatattttgtcactggttgtcaccgtgttgtgaaaatatggcacattgtagttggtccatgaagttttgttgtataagcaagtggtgacttggctgtcttgggaggccacagtgaccctgtctgatagagacagtgtgagggccacctctggtcctagctctggcttttttgcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtaggttgtgaggcagaatcctggctgttttatggaaatgcctggtcatacaccaggtctgggatccatgcctgacagccaaggcagacatatggaaggaacccatccctggtgggccttgaatgatggaggggcccgaagggcagagtgctccagcctgctcagaagaactatttctaacaatgttttttaatagtattttactgggtccaagtggaggagaacttgatgaccttctccatgtcttctctaggtcaacatcgggcaaggtagccatcctcagaaggtcaaagtgtttgggccaggtgtggagagaagtggtctgaaggcaaatgaacctacacacttcacggtggactgtactgaggctggggaaggtgagaaagggctttgttcaacccagtgatcattgctccgtggggaaggcagttcttttcataacgtttcaatgccttttgaactaggaagtagtccatctgaataggtaatcatctactgagcctctgagtcattccttagtgatatctttgctaatccatcatccctttccccaaatccttactctttctcaggtttcttactagaaacttcccaattgctttttgagggtgttaacctgagctggaagagattgcacaggacatgctgtttcttgtaagctggtgctaataagctggtctgttccaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggtacgtggtggggcctgggaggagatgggtggagtaggcctggattctctttggccacttgtgtgcatgtctcatctactttttggtgttttgttagtattattatttttgagatggagtctcactctttcacccaagctagagtgcagtggtgtgatcttggctcactgcaacctctgcctcccaggttcaagtgatcctcccacctcagcctcccaagtagctggggactacaggctcataccaccacccagctaatttttttttaatttgtttttatttttttattttttttttgagatggagttttgctcttgttgcccaagctggagtgcaatggcatgatcttggctcactgcaacctctgcctcccgggttcaagtgattctcctgcctcagcctcccaagtagctgggattacaggccaccacgcctggctaatttttttgtatttttatagaaatggggtttcaccatgttagccaggctggtctcaaacttctgacctcagatgatacgcctgccttggcctcccaaagtgctgggattctaggtgtgagccaccgtgcctggccactcagctaattgttttgcatttttagtagagacggttgcccagactgctctcgagctcctgacctcaggcccacctggcctcccaaagtgttgggattataggcatgagccaccacatttggcctcctttttggtgttttactgacagggaagttgtcttgagaacactgctcaatcgttttctctctggctccttacaaccaagaaggaaaaaaaatttacccagagctaaattattaccactttctaacaaaagtgaggcagtgtgttcagtggttaaaagcaggggtctggagagagactagtttgtaataaattttcatcaatattttggttgaaatgcagttagcttctagatatgttctactttgatgcctttgaagcaatgactgtggtctccacccttaaatttttatagagagaggtgatttgaagtttcaggtatgcaatagtgaagatagggtgagcaggatcctgaaagagagaattttgaaatcctagggattaaaattaaccttacataaaaatggaaatcttagtagaatgttctgtgcctaaaggtagtggtcttgacatccatttaacctcttctgcctttattccaatagtctgcaacattctttttgaagaattataatcattctgtctctgatcacttcttgcatttccccagaccttagctctcagctgtccctggaggacatttccttcccccagccccatgtattattgtcgtttttggttttattcttgttggcatttttcatcctgagtactcaacattcagtattaaaggctcaaagtcctcgggtttgtttgtgacatcagggatccaggcattagagagtgacctgttatagaaggccctttcccaatgctgggcccttttggcttatcttacccttctgtttacctgtggtaatagaagtctgctcaccactcgctaagtcagagtgatgctaaggttcaccctttgttgaaggctccctgagctctggctgttgcttcaggggctttcctactaagactgtgtctctgctacaggaaatccccgccagccctttcagagtcaaagttgacccttcccacgatgccagcaaagtgaaggcagaaggcccagggctcagcaaagcaggtaagatggcacgtctaggttgtcctgggcccctctgccagccggtggcactgggcgtgtttcatccacggccttgaggaacttcatctccaccaacaccaacaccaagctggcaggttttctgtgcagctctgatgcagcagtggctggccaggcccgttgctggctgtcataatagacctggtgctgttgaacctgtctgacgggttctcaaagtgaaactactccagctggtctgtctcctcacttcacagtatatctttccaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacaggtagggtccttctcccctctgctcccctggcccccagccaggcccctttctatgcagtcggtgctgggtcactgtggacaccaaggggtgtgagaggtgctctgccaaagtgctccctgatgggaggcagctcctggcactttgaacccctctgggagcacctataggaagcccaatgggttctatcaggtgaactgcagaattccccaaaagcaagcaggaagctggtcccatatctccacctttggtttgcattttatcagagaaatgctcagttcttgatattcaggccctaatatctatctttctgttacacatgtgcacacatgtgcacacacacacacatacacacacacacgtgcattccctcgcggcctcaccagctgccttttagtcttttcattaattacccacagaaaaagagctgctacacctttgtgtttccttcctggtccttttagcttagtttaccctttttatgaggtgttggaatgaggtcttttctcaaagagccagttcagcctttcgtccctaaggcccagcacactatttagggcagcaaattattcccctttacaaaatgcaggatttcacatgtgatcttaccatctaggctggcttactctgattatttcaggccataagggccttaaaactgcctctctgtacaagttaatgtttatttgtttaaaaacattaaaaaaaatttgtatcgtggtaaaatacacataacacaaaatttaccgtcttaaccatttttaagtgtatagttcattagtgttaagtgcattcattatgtcgtgcacccatcaccaccatccatctccataattctttacatcttgtaaaactgaagccctgtatccattatatttgtttaaaattttgtttcgcttcatgttcacacctctggggtctggagagcagacatcctggcagaaaagtctggattttaatacttaagcctagtgttcgaagtggttgttccaagcctctgagattcctttattcttaagggaaatgatcctgctgtgtttgaaatgccatttgtaggagaagaagggcaacgctttctgcagaagcactgctcagaagccttgctcccgtctgggtcctctcagcgaggagcagtcaagagtcaagtggggaagaaagaggattatagtgaggaaggggtcatggtgtaactgtcccctgagtttgggggctgcactcccttggagatggaatccttactgtgagaacatccctgcagtgggagggattccctgggcgaagggattctgtgtgtcgtgttataaatgtggccccttacatccaggcttgctgctgtttgtgctttcttccccaaatttttatttttatttatttattttttagacaaaagtcttgctctgttgcccaagctggagtgcagtggcatgatctcagctcactgcaacctctgcctcccaggttcaagcgattctcctgcctcagcctcccgagcaggtgggattacaggcacatgccaccacacctggctaatttttgtatttttggtagagacggggtttcgccatgttggccaggctggtctccaactcctgggctgaggcaatcctttcacctcagcctccaaacctgcggatattacaggcatgagccactgcgcctgacctcagtatttgtctttttgtgactgatttatttttcttcctatatgtcctccatgttgtagcacgtgtcagaacttcattccttttcgaggctgcattccactgtatgtatatatgttttgcttctctcttcgtctgttttttgtttgttttttcttgagactcgctctgttcctcaagctggagtggcactgtctcggctcactgcaacctctgtctcctgggttcaagtgattgtcctgcctcagcctaccgagtagctggaagtacaggcacgtgccaccatgcccagctaatttttgtatttttagtatagatgtttcaccatgttggccaaggtttcaccatggggtttcaccatgttggccaggccggtcttgaattcctgatctcaggtgatctgcccacctcagcctccgaaagtgctgggattataggcatgagccaccgcgcccggccatcttcatttgttgaagaacatttgggttgcttccgtcttttgtctgttgtgaataatgctgggtgtacaaatatctctttgagtctctgcatttaattcttgtgattataaacccgaaatggaattgctggatcatatggaaatctctttttaattttttgagaaactactatactgtattccacagtggctgcactactttacagtcctgccaacagcatgcaagggtcctggtttctccacatccttgctaacatttgttttttttctgttttttttttttgttgttgttgttgttgttgatagtgaccatcctgttgagtgtaagatggtgtcttattgtggttttgatttgcattttcctaatgattagtgatgctgatcatcttttcatgtgcttattggtcctttgcatattttctttggagaattatctacttgcccatttttatatcaaccttcttaattttatgttgagttttaggaattctccatgtattctggatattagttccttatcagataaatgatttgcaaatatattctctcactccttggtttgccttttcacgccgttaacagttctcgtgtgcaggttataaacgcggcttcttatctccagacttgctcttcctgtgctttaaaataaaaaatccaaaacaaaacattcattattagtaatgataaaactaacacttttatagatagagcattcttttctcatcaggccactcaatagtaagtaggtaattattttcctgctgatggttctgagggttggtgggagccttactactgggtgcaccacgctgaatcttctttgttgccaaattctccatattctttaggagaaagcaccagaaagccatagctgtctgcgtacaatgactgggatcacaaggccatgacgtcttctaaaaacattttgtgacttctgctttattctatgtctatatgccttttagtgttttggctgagccgttagaaagtaagttgcagatatcaggacagggtcagggtttgacctgcatccttggaaaggactgcagaacccagtaccccagacgtcccctgctgctggttgaggcagaagtggagattaggagcctaggtccggttttgtcccctttgaagtaatgctggagtgggaggctccttacttcagagtcaccccaaggtcacattcatccagttctctgatagcagcaggtttgagaactgctgccatgctgagtactcacttagggctttgtgtccggatgctcccaggatgcattcaaggagccgggtgggccttggtggcggtcgttgccaccaagtggcaacatccaagctgcttgaagccacccacaaccccacaaccaagagaagagaagaccaaagtcctcaggtaaatcacaagtgtgaatgacttgcagggtggcactggggtccttcttgttgtttgttgcttggagctgggtttattgtttcattatttgggcaacttgcaattctgcctatttttctatggcaaagaacacattaaatctctccttagattgaatttccttcccacccccacccccagcacagagcctggccctataagtgctctgtgtggattaatggctgtgagtgagcgaataaatgacatggcgcctggattcacaagcggagatggcctaagaacgttgtaatctggtagaggagtgatgccaacacctcctcattctcctttgaactctgttttctgaagagcagctaaaagctcaagactgggctaaggaagtgtgcccttggatgtggttaagagacctgggtcagcccagaaagccaccccctgacacgggggagggagcatactttgagggctgacacccacaggcacaccttctcatggtagttttagggtataacaggctggaaatccccagaaaggtggctgcttgggcatgggtgtgtcctggcctggtgtgggcgcttccccctcagaacacaggctgtgccacgtggggagccgaggtcctgcctgagtaacccaggtccctgattgctggttttgctccctgacacctgcaggcctgccactccacctcgcaaagtccctgagtgacagcttgcaggtgcttgcctgcctggggtggatgagtgatgtggatggctgtaggatcctgtgagtcccttgaggatgcaaaagtagagcgcgttttgccttagaggaatggacttgttggcttggggcttgaggaccctcccagaggtcaaagactcggttttatagaagggaagtgatttccctgaggactttggtcttctcttctcttggttgtgggtggcttcaagcagcttaaatttctcaccgcacgttcccctgcgcagagcagtttgagaagctggtggcaatgtctccattacgtgctgtgctgggagccactaggattggggaccactccatgtagtactctggcacctttagaaatccctgtgagctcacagaccctcacagagtaacagcttctaccttgaaatgttcttaacgtggtggtcctggctgctcctggagggccctaaaagggatggtgctgagggtggctctctcagtcccatcctcttctgagctgtctggtcagtgtcttgtgtatgtatattttgaagaataagattcaggtttcagaagcatgtagaggagagtgaaactgtcttgcagcctgcgaagtcgtggcgaaatgcactggccatcactacccagacatccctcacttcatagccctgttggggaataaacacagtccattccttagttggggcctcaggggacactttaaaatgctgtaggcattgtaggtgtaaatctccgagattttttccctcccccttcttaggttatttaaggtacagttcattttctatctgagtttttgttttgtttttgactggtaacaagagcatactttcttttatgggatgggtgggcttaactggaagagggtttttccctctcttttttagcacttcagagaagaggccagaaaactttatgcgggtgagggaggaggtatccccaagacctctggttagcctgaggtctgcttagtgagcccctgaattgttaggggctgtggggaaacggaagctcgggaagagttggcacgttgggaatgccacgttggctgaagtagcgagtcagtcctgccttaaacagtacaaaaaggagacctttcctgccccttggctggctcccagctctgttgaatttgacctgtacacattttaccaggaaatgttgttcacatgaggcagggggccaattggttttgtgtgcagtgcttaaaaatgctggaaaattaatcctctcttcattgatgcaaccagtttttttttttttttcttggcctttacccccttccttattacaaaaggaatgtgacaaaatatacataggccaaatgctacacccttttaacacttgatcagcaacagctttcagcagggcctgcattccagcaaggctgctggattcttggggggaactcgtctctccctcacactttcctgttacattatgcctggccgattgtggtgaaggggatcttgatctactgagacagccatgagatttcttggagcctcgatttggagggagggaacttggccaaccatggagagaagaagccggctgtgtgccagcctggaaccggcgagaggagagaaatggcgcacacatggctatcgcgtgccacccggccacccgtgagggtgcctgccaatcctgcaagcaccatctgccttcacacttgcaattttattttctttcacatggaaatggaagttcagatattgtgcgatggtcttagcacaggtctaggtgaactcttgcaaatccctgttgcagcctgggggcctcaaactgattcctaggacagaaatggttctgtttggtgagtggccccaggcccagctgcactggctggcactgggtatgatgatggggaggtggtgtggcagagcagctaggacacagatttgggggccatgggtatgaggcccagctcgcacccttaccaaggtgtgtgacttggggcacgttcctttaccagtctgagccacagtttcctctcctgaaaaaatgagatgacagtaggaactaccccttaggactgttttgatcttgaattgaggaaatgcataaaagcacatagcatggtgcttggtgtgtagaaaatgctcattaagttgcttctgttattattagctgctcttatttgatctaatttttctgttattcttgccttgtggtcaaaagctagaagaaatagatctaagatactttctacattgattggaatcaagtctcccctgtccgtgagaagaatgagggatcttgaggggattttaaatgccaagttagctttttggtacccaaaggtaaactgagttttctctcttgttccagggcaacatgcaggttctggtgacttacggtggcgatcccatccctaaaagccctttcactgtgggtgttgctgcaccgctggatctgagcaagataaaactcaatgggctggaaaacagtaagtgcctgaatggagagcagatgggttgttgatgaccccccaacgtggctgctggttagattttcttcaaaaggtgaaatttgcagagaagcaaattctatgttaagagactttgcagttgcacagactttggttcgaattaaggccgtggtgtgaagtaactgtgactgtgtctgccccttagccacaccgagactcagctttctcatttgtacagtggggggtggtcggcggggagaggttgagaacacccatgggaatattttgaaaattatatgagctaatggttcagaggctggcacgtagtcagccccctggcattgcagtaggaagttttcattaaaaagagaatttgggctatgttgctttctgatgagtttctaactgtgccagctatccttggcaactgaatccgcactaaggttgcgagtcaagcataaatgccaaatccctggcactcagaagtcactaccaccacacctctgccccatcccaatgttcctttagcttgttagggattttactagtataagctcatttcgcttattttcaattttctgattattttttagtagggaaaatttcaaacagaaaaggaaagagaatagtataacatgaacactgatgtacttatcactcagcttcagatgtgcaacacatgctcataaaatgatttttttatacaagtaaaaatatatccatttttcatctaaaaaacattacagttaagggataattccactttaaccctcacctctccttctccctagggttaaccaaagttttcaattcagtttctgttcttccagatcttctctctgcatctatacatatagatgtgcctgtggaacacatttggctgtatttattttgcattaaagttgccctgctgtataaacctacttcttcggcctgccttccaacagtgcatctcgggaatcattcactcctacatcttttccgtctgtgtttactgctgagtggctccagactggatgtacctcagggctcacattcacctggtttcaggcttactgaggcagggctgagtgcatacccccaggacggggcctcctgtattcacctgtgagggtttctccagagtaccactagcagtgccattagtgagcatcttccttcactcgtgacccaagtgcacaagttgcaagcaaggccagctcccagttgcagagatccaaagtgagagctcactgttggcttttgtggctggagcagccagctctgagtgtgtaaacgtccactgcccaaccctgtcatgtgtccccttgtcactcctttccccaagacactgagagctttgactccagaacaggaaaagcagggtgccaattaggaaagcctcttttccggtgggaagtagcgatccgggacctccttgcctgtggttcggcagtgtccatcttgccaggccctatgttccttcagagtcaaggttctctgggttgtggcaggggccctgtgttcccagtgcttttgttttgggtaaagtcctttccctgttcttgtctaatctaacacttgggcttcctgcagccctgctttgcagagaccttttggaaaccatcacggtacagtcagttctcagcacttgcttcaatcggctcgcatttggcagctctgtgacttctgctttcttgagggggaggggtgcctataagatggagttggctgccaagaattagtaaataaaacattgacttatgagggtgtttggatatcaagttaacaccaaaagtaagtaaataagagacgacagtgtcagattacaactttctggtcagcaaagattgtggggtcaggtaaatttcactttgagtcccagcttggcaggctgctgcatatgtcaccctggacaagttacttaacctctctgagcatcagtttccccatctgtgaaagccattggttaataataaataccccataggattgtggtgaaaattaagacaataacctatttgtgcttggcatataaaatgcattcagtaaatgatagccgttattgctgtcatcactaattgattattgtgccgacacttgttgttactgaggctgagatgctgatgatacttactcagctttgctgcttgtcctctgcagcagctgttgcttacagtggaggctgagataagtccccgtgtccaaagaaccattgcttctgtgctctggattgttcctgctgctgaaaagggtcagctcttcacctcagcttgtgtttcttttccaggggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtcagcctttgcttttgtcccagaacttgtctcattgctgtcaaacatgacaccatagtccttctctggttcttcctggcaaagaccttctgaaaatcgttttgtgatgaaagttagcacaattcactgtgaaaggtcccctgggtaggtgggtcacaaccctgctcctcctcttgctctctgactacaagactttggtgaggggctccctgtcccagagtcttctttcttcgcttgttagcataatcacagtcctcactacaaagccagcctgtaaggggtaggtgagttagcaaacgtggaggcctctgcccagcacccagctcacagacggagctcaccctccagaagctagaatcatgtaatataaaaatacattattctggccaggcgcggtggctcatgcctgtaatcccagcactttgggaggccgaggcgggcggatcatgaggtcaggagatcaagaccatcctggctaccacggtgaaaccccgtctccactaaaaatacaaaaaattagctgggcatggtggcgggcacctgtagtcccagctactcgggaggctgaggcaggagaatggtgtgaacctgggaggcggagcttgcagtgagctgagatcacaccactgcactccagcctgggcgacagagcaagactccgtctcaaaaaaaaaaaaaaaaaaaccacaaaaaaaaacattattcttggctgggcgcagcggctcacgcctgtaatcactgcactttgggaggccaaggtggatggataacttgaggtcaggagtttgagaccaacctggccaacatggtgaaaccccatctctactaaaaatacaaagattagctgggtgtggtgacgcatgcctgtaatcccagctactcgggaggctgaggtgggataatcgcttgaacctgggaggcagaggttgcagtgagctgagattgtgccactgcactccagcctgggcaacagagtgagattccgtcccctccaaaaaaaaaaaaaaaagttcatcgtcatttcttcatagtaaccctgactcaaggggttttggaagatttccagtggtctcaatggtgtgaatcctatgaaggtgtcttatttgttgaattagaggtgaaagcctccttcctcactcttttttagaaacagtttagttttattattatgcagaatttgttgagcaaattgcaacagcccaagccacagctagctccacaagagcccttccatgagccctcaacctgggatctcgtgtatctttgttggaatggacattaggtttccaagtccaggcctgtgatttagaagggtcaggttgggtaggagagaggagagtcttggaggggctgctccatgggggtcacacctctctcctgtgggttttcgctggtgattgagttctgaggcatttgctgcattgactgttgtagctttaactcgtgtgcacgtgtgacacataaagccccaagagaagggctgcctggctcagatgcacttccatgctgattatatgcatgggtgttgaaagcagtgctggctgagcagcgatcccagtgcagtttgactttattctttgctcaaataggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaaggtgggtttcatttaaaaaaaaaaaaaaaaaaaaaaagacaagctgggacttaagggctacctgaaacttggagctgcaaactcagccacctgcaggagccaggtgacatataaggcggtgctcacctgttccctctgcctcggggagtagttggggggccctggtgaaggttaagcacattgcatttctggggaccgtgctactcaacccctgttttctgtttctccatggggaacaggacctagcattgtcagcagaatctctagttttttggcaaaggcagaaatcttgatttttctctggaaactcaacatacaacatgttggcatttaattggaaaaaagtttaaaatgtagtgttgtctaacacctgcatgccacacagcaggttagtcttcaacctttaacctgtcctcgagcccggtgtgagcagtcgtgttgtcacttagccgtggctactctagaaaggccttctttgggatggagggggttaatattcttgatttgagagttagaaaaaccagttttccagttactgaaattggacttcatgtgtcctgaagtgccaagaaccttggttctggggtttgcttttgggtctggggtactggtggcagtgttagctatgtgcttgctctgcagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtgagccgccctgtcctcggactggaccctcgttcagagctgcccttggtcattgcctcctggtggctggtactgatgcctgccccatgtgctaggcctgtctcagcagggccacgtgcagagtgacagagtggaagtcagcgtccgctgcagtcacctgcccactcagtgcctggcttgctggccttgtgtaataggtgggctgggtttagcctcagtctcacctcagcaagttatggggtaatgtcatgatgttgctcatttgtgccatttttctttgcgtatgaatttctttcttcttgagtattaggaattataaaaaatttcaataaatagaaaaccataaagaaaaaaaagtgccatgtatatctccactacctggagatcggaagcctgcgatattctgatatagatattttcagtcttcttgtggatgcctgtttcttctgtttcacgggtttcgctttttcttttggttaatggctggatggtgttttcccgaatgagagtagtctgtttaggatgactgacttgaatatttgcttggttggggtggagtggcttatgtgactgcagatagacggtttgtattatttaaaagtcagatcatacctacattactgtgggattgttttgttttgttttgaaacaggatgtcactctgttgcccaggctggagtgcagtggtgtgatcacggctcactgcaggctcaacctcctgggctcaaatgatcctcctgcctcagccccctgagtagctggaactgcaggtgtgcaccaccacactcagctaatttttgtattttttgtagagatggggtctcgccatgttgcccaggctggtcttgaactcctggactcaagtgatctacccacctcggcctcccaaagtgctgggattataggtgtaagccactgcccccagccacattactgtgtttttaacccccttttccaaataacatagtatagcatgcagacttcgatgctagatgaaactctgaagtagagaatcatttttcacaaataggggatttgtatgcaaatatgcgtttctgtttgttgttttgagcaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccaggtaggcaaggccctacatttggtgtcttgagtctcacttttgtggctagattctacctatgtgtcatggtttcctaacttttgataagatgaatttttatttttataacatgtatttccttctgtagagacttatgttacatagaaagaccaagcatacctaaaaaacataccaaagcacttgataatggtcatgaaactatttagcaaaccaggagtcaatcaagctctataacttgataatgtaaaaatttgtagccaaccttgtaagtatttttattaaagttggttgcaaggcatatgcctgcgttgtacttgcagtcctagccagtgcaattagataagaaaaataggctgggtgtggcggctcacacctgtaatctcagcacttcaggtggccgagacgggacaattgcttgaggccaggagtttgagaccagcctggccaacatggcaaaaccccatccctacaagaaatataaaaattagctgggcttggtagtacacgcctgtaatcccagctactacttgggaggctgaggcatgtgaattgcttgaacccaagagacataggttgcagtgagccgagaccgcgccactgcactccagcctgggcaatggagtgagactctgtctcaggaaaaagaaaaataaatgaagcataagcattgaaaatgaggggtcagagtgtctttacttacattatactaatgtgaaattccctatgtgagaggtgtagtaattgagttggggtggctacgtggaatagtttataaagggaatttgcatgaattttggcaataagcagaccagcataaataaatggtgcacatttcactttcttttccactctttccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggtgagctattcctcagagaggaccccagagaataattgattttgcaggaaaatgggtttgattttggttatctctctgagtggggaaaacaatctgatatttgtaatagctgcaaaaggagagtttttcttagggctacatctccaagattatctcaactcccagtagaaccggtaacatggcaaaaagcatcggcttagaattttgactggaaacagttgtgcgtgtgttggaggacctagttcttgattcaggggaaagctggttctttacaaagttgaaaatcacagtggctcacacctgtaatccccaaactttgggaggccaaggcatgcagattgcttcaggtcaggagtttgagaccagcccaggcaacatggggaatccccatctttacaagaaatacaaaacttagctgagtgtgatggtgcgtgcctgtaatcctagctatgtggggtgggggctgtgatgggacgatgtctgagatgggagcctgggaggttgagtgagctgagattgcgccactgcgctccagcttgggtgacagaggaagaccctgtctcaaaaaaaaaaaaaaagaaaaagaaagaaaatttctaccttattttgtgcttggctccttattcatgtgtcttggtttcttttttttcactgacaatactagtagctgatcaagatatgcagattcaaattctttcttttgtatttagtgatgtcatgtgtaatcactgtgaaacacggtttctcaactccggcactatgacactttgggctagatgattctttgtggtgtggggctgtcctgttcattgtagacttttgtcagcatccctgccctgtacctgctagatgcccatagcagacttctccttccccattcttatttgtggcaaccaaaaatgtctccatatcttgccagatgtcttaagggacaaaatcacttcagcctgaaccactgctgtaaagattcaaacaataaataaatatatgacttaagtagtgaaagaccctcctccatttgttttggggggaggactctccataggttctagttatctactcaaatgattgtcacccccacacattttatttatttatttcaatagctttggggtacaagtcgtttgtggttacatggatgaattctatagtggtgaattctgagaccacctcccccgcccccatttctaaaagggcaggcaagtgtgtggtgtggacagaagaccgagggctggggctgttctgggccacttatgccttgtcttaggtgtggtgtgaagagggcaaagccccaccccaggaccccaggagcagaaagagcctcagcggggtcttgttcttctttctctgggtcacgctgagaggggaagggcaggttgaggggcccactgctgggttctgggttaactctcaggcagctggagtgtccactgaccacacgctttcctgattccattcctgcttcccccttaccacatggaaatgtgcacacacactcacactcactctctctcacactgatcagaaagtattgacattcaactcagactgattctactcagatactcatttaagcctcaagtcatttaaaacaacatgtttctcctcaaacttgtgcttgcggctcattcaatatagatttaaaaaattcctataatcactagtctaggggacttcagctgtgggcaagacaaagttcctgccctcagggagcttactgtctagggcttttacaactaaaacttgtgatgactgctatgaagaatgagaatggggctcggtgacagaattcagagctacgggcttgttttggagttttgtaacacttgcgttaggagagagttgggcacaggaaacgggtagaaggctgctcccaggaggggtgatgtggctccgacctggcaggcaacagtggagatgaacatctcctgtggcaatgaaactttttgactatggggaaaggctggtgagtgccaccagcttccgaatcccccttacagaaaggggtcagagtttgtcccctgtggccgacctgtgagcttaaagcaaatggtcgtctttgagcataacaacagaaagacactcatttgtggttttcccatcaggtgtggatggtgcctttttatgtttcaggctctctgttgcctcccagagagccaaatgccggcttttccagaaccccagaactttcccaggcagagatatttagtgaagtgttggttggttttctaagcatcaggcttcttagctaaggcaacctatgggggtactgccgggaaacagtcggctacctgccaccttctaatttgctttcatggtaattctgggtgcttaaatattagcctagtttttcctggcctggttaaaaacccggagtggagttatttttaacaacgtgtcctgtcttacccgtaatggcatgttgatttcctgtggtaggccagctgtggttggttggtggcggctccctagaccactggattgactggggttcagagtgcatgaggaagaagatctggcatgagggaatggtgacatgtgtctgggcatggaacaggggagtggcggataatgcttggggtctgccatcttggacagtttatcttacccgggtttgttggtttttggctactctcatgctgagctcagacaacttctagtggaggctctgacttaaagattggcctcagaggtagtcccttgccatcagctgttgacattgaaatcctcaactgtcactctctaaagtaaagcccccttttgttcctctcaccccagtgtggaggcctgtgcttgtttgccagggccagccatttatttcacgtagctaaagacctggatgccgttgaaacccagctgttgttagaaagccagggactcaattctttgtgtgtcttggctgtctaccatctctaattctacaaagtataaattctctgggatgcaaagcagagatccctcagctttcacggcagtcattaactttgccagataccatggggagcaccaggactcccatgcgaggcagaggtgcacgtagccccttggtgatgggcgtggtagcctgaggcatgctgccgttcgctggatggggaggtccccctccacagtggagtccatgagtgtccttggcctagcccttgtttctctgtttagcacttctctagcaaatcactatctcctctcctcgactcctctgtgcttcatctttaaaactgacaccctcaaggagtcagaggccctcagggtcccccggggggtcagccatgtagcaggagctcagcttacactcaggaagacggcaaggcttcaccaggtggccgagtgaccgagaaggctgagtgtggtcagaaggtgccagctgcattggagggagaggagtctgggggacacacaggagccatgtgtgggggacagggctggatgtgggctgcagggcctgcccatctctctccgttctgttgttccaccacttggcttcctccttcagttgctccagcagcctgtctcctccctcgcctctaggctcctgcatgtgctgaggcctctctacttgaagcacctctctgtctgctccctcttgtgccgcaactgagatgttactggaaagctttctctggtctcccgcagaccaggttaattgcctcctgagtgctccaccttccacaccccaaatatgttatgtaggatgttagagtgacttgcttgcctcatccttctcctgcagttgtgggttcctggggggtgttaaccgctcaggatccagcacgtggcacaacatctgcacgtagtaggtgttctgtgagaatggttgacaacaatgagtaggcacatgagcagtgcacacagtgaggcagggggagctgaccgaggcctgcatggccgaggtcccgggggagcagcagtgctattctgggtgtgcacaaggtggtctccaattcccagcttgtgctcagaatcccacaacctctcttccaggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggtaagtgtgcaccctgccttcctgcagacattcatctgccccaggcaggggcagctgtaacccagagcagatgctttgcttttgagtttgctcatgagcttaaaattaaattaaaaaaaattattgtttcatttctagttaaacagtagaaattcctgcttacaagtaagcaggcttgttatttctccagtgatctgtccccccatttaataatatggctatcaatttcttagaggaagcagcagtatttgggctgtcatatgtaatatggtggcgactgtttcattatgtgtttcagcatttgtgagggggtgggttgctctggatgtggcagatggtggggtttggaggtgataactcattgagatatcttggtgtccatgtggtacataccagaacctctgggaatgccaggcacatgatgcacgtgatacgtggctttgtcattgtcttagttccccagagagagagtgtgtcttggggaatgggctttgttggcaatttggcctgccttgttggcagcttggaacttgggtttggtaaggctagcgggccatatagggacaaagccctgaagtgcattggaacttgccttttttgataagtgaccatgtttcctcctccagcacttaaaatgtgcctttctcccacatagaggacagtgtgcctaatttcttacgtaatctggattttcctcgccaatgatatgttcttggattcacagaagtggcaaatggggttttccctctttgaagaggaaccttctccttcatggggttcagcaggaggttttatcttttgaagctcagggcagaaatggtttgggggaaattaggtcatgggtctgggatcagattctgtgaagttactgagcttcaggacctgcatgtgtttgtgtgcatgtatgtgtccctgtgtatgtgtgaatgagagagggagaaaaagaagaaagagaagctttacttggatatctgcctctattatgaaggactctcaagtaacagccttttgattttagctgacgacacggattcccagtcatggcgcagccccttgaaagccctttcagagttctttaaaggtgacccgaagggtgactttaataagacaggtttgcattttcccatggctgctgaattatgtaacccaaatgcttcttgctggcctcacttctaaaattgcttacacctgcctcatctgctttgcttaatgagcatgccatcctttgattaacctaccctggagttgacccatccttgactgtcacgttggaagctgggatctggactctgcaacccaacgcgtgccttgattatgttttagcataatctctaacatctccacaggcttcaccttgagggtccccttgccccatgagattggcaccctcacctgccctgcacctatgccccagcatgctggtaccacagtgttctttgctcaaaggtggccacaagtcttgactagccagcccattggttaatttttgctcttcacaattctggactctttggcagtgtctcagctgtagagtaaaattgccacatcctaagcgtgcctaaccagcttgaaaggttatattgtgtcttcaacacacatcatccacatacaccctccagcagcaagcacaggcagtctccttaattatactctagggcagactgagtgtattttagccaacaaaaagctaaaggtgtctctcggggtcatttctgcaaccatgaattggggatcctgtgatttttttcaggcctgtgattatggttgctggcctttttgttactcatcagtggaaaccaatagctcttggggatggatgtggtcctatttcagactcagccaagggtggagtaaaggtgaggccaggcagctccttaaacctctcatctctgtcctcaggcttggtggagccagtgaacgtggtggacaatggagatggcacacacacagtaacctacaccccatctcaggagggaccttacatggtctcagttaaatatgctgatgaagagattcctcgcaggtaagctccatccatctgcccatccattcctccatcagtctatctgtccacccatccattcctccatcagtccatccacccatccgttcctccatcattccatccatccactcatccattcctccatcagtccatccatccacccatccattcctccatcagtccatccatccatccattctttcatcattccatccatccacccatccattcctccatcagtccgtctacccattcatagaggcagcaagtattacatagaacctgcaacttgtcaccacacactagccttgatatttgtggctcccgctctctcactcccccagttcctttcagacatctttagtttaaaggtgagctgaaattaagaagttggaaatcctaaccacgtgtggtgggattcgcctgtaatcccagctacttgggagactgagatgagaggatcacttgagcccaagagtttgaggccagcctgggcaacatagaccctcccctgacatctctggaaaaaaaaaaaaaaaaaaaaaaaaaaaagcaatagtagtagacaatcattgatgaaataaataatttattagtttattagaggcttccttttggtgttttggtgaacctgcaagtagttttctgattgggacaggacaaaggtctttacttcagggtttgcttgataaaagcatttccaaaaggttttacatagaaaccttgttccttgttgatattaatacaaaaaaaaatgttacataagctcttcacctcttggaacaatctctaagggttttcttttctttttttaaaaaatcatgccccttaagatgaaaaactttcacccatatcccctaacacatattttatatagagataagcatattagctctatgtagaaatatgtaatttataaattacatttgtatattgctttactaatataccatgtaccatatgaagcatactatagaataattatagatacagaatatagaataagatgagatataaatattaaaactgaagttccagtattctctttccatttggtgaccatgatcttagcataacaaaagtggggtaaatgtgtttaaccctgtgtttcccaaactaatttgtgaactcttcctccccaaactacttgtatcccttggaacagaggtccccaacccttggagcgtggactggtgtgggtgcacggcatgttaggaattgggccgcacggtggtgggtgagccatcattactgcctgagccctgcctcctgtcagatcagcagctgcattagattctcataggagtgcgaaccctattgtgaactgcacatgagaaggatctagattgcacactccttgtgagaatctaactagtgcctgatgatctgaggtggaacagttttatcctgaaagcattcccccaccaggccccctggtcttctacgaaaccagtccctagtgccaaaaaggttggggaccgctgccttggaacacactcaggacaaaaccagtctgtcatatgatggttactacctcatagttgtaaatttctgctagacttaggcaccttgactaactcactgtcttatctgctgtagaaatccccttttccatcccactcttatgtgtaagaaaagtcagatgcagctgggttgacatgtatctttattgactagggtgtgtgtgtgtgtgtctatcaagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggtaacttggagttattttctgagccaaaccttaatcctaagacttaatttctgggccagatttaagaacaagggtttcaataaccgatttctgactcaatgcaagttgtttgttagattttcccaccaaagagtcagtaaatgtgcagaagcagaagcagctcacctgagagatttgagggtgtagctccaagaaccactttttggtgaattttcatgtttttttactacatctattcctatgtttttatttttattttttttaaagatggggtttcaccatgttgcccaatctggtcttgaactctcttgggttcaagcagtctgcctgcctcaacctcccaaagtgctgggattgcagacatgagacactgtgcccgtcccctatgtttttatttttaaatgttttaaattactctttggttcatttaagactaagttatgctgcatatcacagtaaaccttaaaataagagtggctgaaataaatgagattattctctcttgttaaggaaccccaggctaagccacctgggtgccctgcagctcaccaaggaagtcagctccatctctctgctcctctacctagcatgtggcttctgtccttaaggtctcctcctggaccataaggctgccagtgctctggccatcacatccacatggcaggccagaaggaggaagaaagaagggaaaaaggggtcctcccagctcagtgggctctcttaagcagccctgccaaaagtccatcatagacttccattcccttctgatttgttgggggttggtcacaattcacattacctagtggcaaggatgctaggaagtggattcccatcttctgggagcggtgcacctagctaagagttatggtcctgttaataaagagaaaagggagactggatgtggtggtgtgtgagcagaagcctctgcctcctcccctccctacatttcagaggatttcgagctaaaacactcttggttcacctgacaacaaaattactaaaaattggccatgtctgtcatggtgttaaagggatctgtgaccctctactctccctaccaaaaaacaaaacaaaactagattgtattaagccatcaattctgtctgtttccactagaggcactaattggaaaatatgtcagggttttccatgaatgttttctacatcttgacaacatcctaaatagcatttctctatgatccacaggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtgagtacagggcatctcaaggtcaggggcacaggctttgcaatcagaaagccgggccgtagcccttctctgtgacttacaagctacatgatctgggcacgttgctcaacctcactgaacttcagtttgacatagattgaagctctttgtttttatttggagaacatttagatccaagaagctcttctaaggaacagagactgttttacagggttactgcaaagattagatgaggtcaggcatgaaaaatgcttagcacagtgctaggtacatgataactattattatatgcttttgaaatgttgagaacccaactctgatggcggctcccatgaaaagcagcacatttctgccttttatgagtagatagttactcaggattcattcaagagcatttcaggtcagcattagagaaacacatttaaggatctaggtttttttcatcatgcatatgtaaacctctcaggaattctccatgaatatttgagcatcacagtttctttggtttctttctttttttttcccctcctttttccttcagtttctaagacacaactattgactgtcacaggccattctttttttttttttttttttttttgagatggagtcttgctctgttgcccaggctggagtgcagtgacgcaatctcagctcactgcagcctcagcctcctgagtagctgggaccacaggtgcccacgaccatgcccggctaagttttgtatttttagtggattcagggtttcaccataattggccaggctggtctcgaactcctggcctcaagtgatctgccctcctcagcctcccaaagtgctgggattacaggtgtgagcaccacgcctggccggcctttcagtttttaagaacagcccttgggcagctcagtgctgctgctcaagcagattttaaaacacgaatccccatctctaaaatgagacagatttacttctttttaaataagaagactaaacacaggaccacccttgatgtgttctgtttctctcttagcccatctttttttgaatggagaaaatctgggctttcacggcaaggttgtgaattgctcagcgtggccctttttggctcacccatggcaaaaaatggaaaaattttggaatgcaggccaatccaccacctcctaggtctatgcagctgccagcgacaaccagatcatctttactaattgatggcatgttaacgttggatggggacttcccccttgccttgcaggccctatttcctcccccagcttgggcagaagcctgagctgaatacttgccttttggccacacctctgggtctgtcattcagggtcttccacagattgactccagtcttctcttccactcctccctgaacaaactgttcttgccaccctccctattactcctacgcacttggctcatatctaccaatgtgcttttagttcatgcttttctgcatttcctgatatgtggatcctgtgtaaaggggcgccagaaatcaagagagagactggtcactggggagaggttgcaagtctcccttagctaacagcacccatccttcagggttcagccatgtttcctttctttaggaagccctttgtcagtgcggcaaccctgggatataaattcttagaacctttgcctagatatgctgccagacacttctctgaggaacagtttgttattttttctgtaacttagttcctcttcagcatttccactgcagttggaaatgtcgttcttggtgcctggccctgttaacatcttgagagcagggactgtgtcttgcccacctttatgtgtacctggcacttaagaaaatgcccaatatgtttgctattgaaagtcaaccttcattgccatacctttaaatgctggcaaacccaggctaacctttagtcaacactcagagcttacagatgctccttatttagtaagtaattgatgacgtaaccctttgagcaacacctgatcaggggatctttgggatatccctctgaatggcagcagttggaggcctaacatttacaggcacagacaacatggatgggtatgatttgttcttgggcctccaggatgtgtgtccatacttccattctcttcccctgaactcttctccaggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtaaggaaaattccttctcccgagcatgctgttattggtggaaactgtaacagctgccgtttgttgaaccctgactaggatatcctcttcaccttttttttcctttggaaaaaaatttgttaagcagtcatgaccttgtagagtcccagagtaatctctagaaactcagagaccctttggctgtaagggtttttagggaatcttactggccaccaaggtgtctatcataataagggacttgggcaatatcctggcctaagcccaggcattttgaaagataactcctcagaaaaacacacctttatgaaaatgtttctacataaaacatgacaggtttttaaccggccagctcttccttcttccatcttcatggccattctccatggctggaggagagagcttcctgatgctgttttgtttggagacttgactctgaaatcccaggactcaaagtacctccacttgtgttttggaaagattcacactttatgtatgagggggaaatacctcgtcttttgcagctaggaacatctggaataaaaggaggaaaccattatgcaaacacctgggttagtgaatgaccaaggtctttcattttcagttgtgagttacttatagatcttcctctgtttatttatttttattattacataatagatcttcttctgaatattcttcaaccaggaaaagggttagaaaccttggggacattacctcattgaaccctcaaaaccaagcatcgttggcttttttacaaatgaagcatgcttggtctagacagacaccaaataccatgctgtcatcctcactggtgtcctttgatactgtggtcagcagccgcacttgaccacaaggtttataggcccttaatgacctggccttgtgcacagccgacaaagcaccttctaattatttcattttgtgcagcaatggagaggtgcatgaagactccattccaaactccaaagctcagggactttcttccgaacagtctatactctgttgtagtattattcccttccatcgacgtctgtttatctgtaaacagcatgccagagatctggaggctcttttatgtctcaagtatgtaaatgtaaacacttgtcaacttttgacattgttcatttaagagtgtttttctcctgtaggaagaaagaaatacagctgggaagttgatgtccttattcacagagaagggtaccagttgtagttttcagaatctgtttttagcccatagtgggttttatctggttggttagaattaggtggaaggagggaagagcagccaagcactgagcagtggtcatgggcctgctggtgcaatgatttgggggtaagagaagaccatattgggaaggtctacgtgagaaagtcagagtaaaaaaattgaggaccctttttgcagaagtggaggcttccaaactcagtaataagtgtcttctagcccctgaatacacacaaagcaagaatactttgtgtttacccactgccccctgaccactgctgaaggcagaaagggacgatcacctacagtacctggtttgggtctttattctctcattccagggagagaaccttaactagatggactgactgactgttcattggctttggttgggtagattccctgcttccctctataagtttgacgccaaaaaaggacaccgaccagcactgcagtcatagcaaatgtctcaaggagacccacagggtggtttcttcaaatacactactcacacacagcacatggagtcatggacaaacagcttaactgcccattgcctttgagaagtcctggaccaaaggccatagctcagccattgaaagatcttccttctgactgatatgtccctgcatagctccaacctgtgcaggcagaggatagggctgttccaaatgtcgctcacagagctgcctttgcctttctgcagatcccaagatacacacaaagcagttaacatgggtaaataggccttcctctgtaggagagggcttctgattcttattctttcttatggcggaagagggtgttgagaggggttcccttgctgttggttctgttgaatcaggagcattaaatcttttttgtttttttttgagacagaatctcactctgtcacccaggctggagtacagtggtgcaatctcagctctctgcaacctccacctcctgggtttaagcgattctcctgcctcagcctcccgagtagctgggattataggcacctgccaccacgcctggctattttttgtatatttagtagagatggggtttcaccatgttggccaggctggtaactcctgacctccagtgatccacctgccttggcctcccaaagtgctgggattaccggcatgagccactgcgcccagccatgagcattaaagctaagatttgttgaaaatgaatttataaaaaactttagaaacattaactgctgagcatggtggctcatgcctgaaatctcagcagtttgggaggccaaggtgagagggttgctggatcccaggagtttaagaccagcctgggcaatacagtgagaccccatctctaccaaaaaaaaaaaataataattagcctggtgtggtggtgcacgcctctagtcccaactgctcaggaggctgaggtgggaggatcacctgggcccagaaggttgaggctgtagtaagctgagattgcgccactgcactccagcctggatgacagagcaaaactctgcctcaaaaaaaattaaataattaaccacagtagacatttatcaagtaaaaaaagaactttttcctgattctgtgctgcagagatgccttgtgttagtttttacctacttacacttcacacacctcactttcatgcctggggtcacaccgtacatactgctttcgcaccttgcttccttccctcaatgtgtcataggtacccttacatattgattcattggacctgactgccatgttccactggacagactcaccagaatttatttgaccaaatcccttccagatggacattgggttgctttagttttgcacgaccacagacagcaccagtcaaggtccttacacacatcaattaactatggagtctcccgccagcttaggtctgcgtgctacaagtggggttgtgggctcacagggcatgcgcatctgacagttgaagagaggacaccaactgccttccaaaagggcagtaagaaagtgtccttcgctagagtgagtggctcactgcagttcaagatggagcagtgggggaagcagctctgtggtggtagtctactgagtgtatccttccagtatggttcccaactaatctccatttgccactgaccaggccacagatggggaagtcacagccgtggaggaggcaccggtaaatgcatgtccccctggattcaggccctgggtacaattttggttttttcctttttgtgtttctgtgtttactcagccttcatttcagaaaatctgccatctgcttctgggattgcttaagccctgtgggtgtcctggtcattggtgtgcccctcactgatcagcccatcacgatgatccctgctttttctgtaataagatcacctttgcgtcaccatccgtgctccacgaatcgccagccgtcgtgtctgtgatcacgctcggtgcagtttgtctctgtgtttaaagagaaagacagacagctgtctgcagccctcctgctgcctctcaaagccgccacttgcacattcagtttctgttcagggggaaagccacccactgctactctctgccacttaaaatgcaccttcttttccaggccacaagcaactaaacctttccagatggagcctcttgggactcatagacattgctgtctctcacttttccactttcccgtgggtgctgctgggaattttacaaacagactcccgagtgattgctaacagttggtcagcatgacctctccagtccctcaggttctaccctgggtctggagccacttagacaaagcccataccacaatgggcagccgcattcccaaatcccggcctcactggcttgtagaattcccagcagctctaacccctgtagcttcaccagctcccgctgttgtctgctttacccagtgaccactgccttctgtttttaggtgaccgaagaggcctatgtcccagtgagtgacatgaacggcctgggatttaagccttttgacctggtcattccgtttgctgtcaggaaaggagaaatcactggtaagcacttgccataaaggccgtctcattctcacttgctctcacgagcttcccagaatggtgctggggaggtgtgtccactgtcccccagacccaggctccttaacccagggtcacgagttcttggtctccggtgttgggccgtgggctcctgaaactacagaatatgccacgtgtgtgtttctctgaagaagtggctcactgacaacttgcattactttcttgagcagtcccatgattctctctaggttaaaaactgctgtgtttagatacctcatgactgtcgggttcttgtttgcccctttttcctgccttctcttatttgacttttccagatgtgactttgacactgagtctgtcatacaggagttcctttctcccctcagcctcttttcaatggcccacttctctttggtttgatgctctatgtatccagctggtttcatggtgttctcaagtcctttctgagcttgattttgccagttgtagaaaactctttaagagttgtctgctatattttgtggaagccaaatggaactggaaaaaaaaaaaagaaaagagcaaatggtctctcccattgtgggacttgaatgttttaggcagcaacgaatgttcttgggtctggaaacctttattttgaatacatctgtgccttgggctctgcttctctggggaaggttgctggtgggcttcattgccccgtctctctgtgctccataggagaggtccacatgccttctgggaagacagccacacctgagattgtggacaacaaggacggcacggtcactgttagatatgcccccactgaggtcgggctccatgagatgcacatcaaatacatgggcagccacatccctggtaagctgagtcagcaggcccagcagggctccaccattcaggggcatccgggcagcctgcagacactcctcagccgctttgcagggagcagctctcggcagcaggctggagaatgcagcgttggtacccctgtgaaaccaaacagtctgggaccctagcaggtccagctgatttctggaagggatgatgtagctcagtgtcttgggtcacagtgcaggcctttgggtctgtggttgtttatctttgtcactacgctgagtgtggccagaggtcaagctgggagaaaaatgggaggcatggtgagggactttccagcctggcctgcagagccctgtgtgggctggaggcttggggccaggtcagaggtggaagaagaggaccagcagccctggaagaagaggaccagcagccctctacaagggaagccagcccaggtttcatgggtcaccaaccagcacagtgtcaccagttcattctttctttttgtagttgtatttgttttttaatttagtattttgaataggtaacacattctcatggttcaaaaataaaaatgatacgaagaaagttttccttcctacccctctccttgaactagactatcataaatttttttatgttcgatttcagagtttcagggttttattttttatttttttgtggagatagggtctcactgtgttgcacagattggtctcaaactcctgtcctcaagcagacctcccgcctttgtctcctaaagtgttgggataacaggcatgagccgccacgcctggccaatttcagagtatttttaagactctccatgcaaacggaaatacagatatataagagagtgtcttcccagccttccctcatgtggacgaaccattacatatttgaccatttccctattggagggcattttggttcttcctgccctcgctgtccccagtgttgctgcgcaaatcgacttttcccctagtcacctcacactcacaaagatgtatctgtgagatttagttaccagaggaggcaatgctagggccccagtgcaggcatctatgattttgacagatcttgccaaattgcccttcagaggggctgttgcagttcacacgccctctggccatggagaagagcaccttcttttccacaaaatttgccagtagaatatggtatcaaatttttggagctttgccagtctgatggttggaaagaaacagaatctcagcgttgctttatttgtatttctcttgtgaatgagaccacacaactttccctatgtctatttgtatttctttttctgtgaactgaacatttggatccacggcctgtttttctatttggttattggcctttgtcatatagtttctaagagcaatgtaaacattggagagattagccctttgtggtaggagttgcaaatgtttctctgagattggcatttactttagttgtctgtatgtaatattggtttaaagcaaaaatgtattatctgcttctatttaaatattctaaagcggcagatggagagagaggaaaaaatgtctttctcacatctgccatccacttccactgctggtgtgagttgtgtatcttttcagatgtttctctctgtatctacaaacatacatataattttattctattttgtttttaaaggaatagcataatggtattcatagtttatagcaacttgctttttttctttttaatgcatcatattatggataatttctcaagtcagtaaacatgggtcttcctcactctttttaatggcccatgagtagatcagcatttatttaaccggtcccctgttgtgaacacttaggtcttttcctgatgtgcacccgaacactgcagaaatgaaagtgcttacatagggctaggagtcggggtgggcagagaagaccactgtggggttgattccttacaggttgaatggcatgggcaaatggccttccaaaagccctttccacttaccttccctctggccatgggtcctttcaccacccagtgcaaaagtttcttccttatttgtcaggttgggctggtaccttaccttagcccccttcctcatctggagcagcttccaggattgtttttcttatgttgtgattgaaggaataatactgcgtagaccctctctgatgtcctaggatggcgggggatgggaggtgcatgtgcatctccttctgtctcttcatgcctctgcttaggaggcgccagacctgtagagaggtggacgtcaagatgccagttgtccagggtcttcgttcaccccttaatgagcaccaattttgtttgtgtccttcgtaaacccagagagcccactccagttctacgtgaactaccccaacagtggaagtgtttctgcatacggtccaggcctcgtgtatggagtggccaacaaaactgccaccttcaccatcgtcacagaggatgcaggagaaggtactgtgtggtttacgtgtttatacgcctccagctgtccatttggagggtgaagtggacacggttccagggtggcttttaaaagtgagacaatcgaatggtagtatttgtcttgtcttttctctcgtgtaaatctgtttcttctttagagccgcttcgtcttctacccagacagacatttttgaagtcctttgtgttctaactgaaatcagattcatgctatgaaatactttatgtgacttgtctggaatttaagtgtgttttggttggtgatgtttttgttcttgttgcacatgtatccacaagaccacatgacttactgagtggctctttttgataaagctgtgtgcccattcccgtggtattcatggataatcccaaatctgtggttctaatgggatttccgtgatggcagccagtgcctgatgggcagggacaatccacctctgccctccaccacccaccgtctcctatgtgtaattgatgtacacggctccttccttttctcatcccatgcatcctgagagtagagagagctccagggttacttgcagtgaagaactcagatgtttggggtttcttctcagtgggtgtttttactgcgtggactgcttcattctgacagatgtccctttgcccacagctcacgtggagtgcgtcaatccattgtccccagcatcagggctgccctggatgagttgttaaaaggaaactcttaaaacaaggcaactctctccctaacacccctgcatccctgttcccacttgtaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacaggtagggttgtctggcttctggggtcttcctcgtgggaagtatggctgcctctgactgccaccctccttatcagacccctggcagcaggctagacgtctctttgagtttaggtttcacagagacttgttgaggaggagcaggggatggaatgcaattttggattagctaaatccttctcttgctgataatccaggaaaatgcgagagctagtatttggagcacacttttattgtgccagtgtgactctagggtgcaaagagaaagctctcagatggagtgttcgaatcatacttactgcaatagtgcatgaagtgcatgagcttagacatgcccttcagcgtcactactaggtaaattttctgctatcccttttacagatgggaaaactgaggcttggcaaggtagtggtgtagccaagttcacatataggtaaacagatccaggttatcaaattccaaagcccatgctcctcaccttgctgtgttcaggttatgctttcagtgggttataaggaagatgcacaaggcagatcctgtttccccaccgtatttagacctgtctgtgaagcagccagtagtactgtgtggaatgtggtcattgtttacctagaaatgcccacagccatgccaggcaggtatgaggtgccttcaactaacaaaaattcctatattttattttatttttgagacagagtctcactctatcacccaggctggagttttagtggcatgatctcggctcactgtgacctctacctcctgggttcaagcgattctcctgcctcagcctcctgaatagctgggattacagcacccaccaccacacccagcttatttttgtatttttaatagagatgaagtttcaccatgttggacaggctggtcttgaactcctgacctcaagtgattcgtctgcctcagcctctcaaagtgttgggattaggcacctggcccaaagattcctttaaaatgtggtccatgaggactcaagtctctaggtcctgccagcttcttgtctttgctgcaagcaggcatgaatcccatcattcttcattggttgggtctactcagtgttcaaggctcatttttttttcacttaactttgtgtaattagttcttgcgtgttcatccgtgaacagcatatggcatggcagctctgtgaagccagggtaaccacatgtaacgggagtcctttttgggggatgtttcccagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggtgagctaggctacccttcctggctggagccaggacatcttgggtgggagatggggactcttgcagtcctttcttgggaatgggtagcacaatggagtgtgatgtgataaacctgctgggtcacacgcacgataaatgcccaagcgtatttgtgcattgtgatatcgacactctggattgttgggtgtcaggaaagaggacatatttctatttctgagagtgtgtctctctcctgcttcctctccgccatccccttacaagccccaatctgtgttctggtccaggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggtctgtgtggtcccaggggagaggcccagagcttgtgggaaccgacttattttgctgaggcagcgtcatcttttcatcctaccaactccttttcctttctgagcatccttcaagctataggtccttctgcctgcattgtcttttatgcctcatgaccattggcaaaaatgggattgtctttgttttttagatgatgaaactgaggcttgcaaggtttagagccccctctgcactaggatctgaacccagagccacaacacctcgcaaacccctgttttcttatctgctctcccacccttgttctcagcttcccagcgtctctccaagcaaagaatgttgggttgattggccaagaccatggtcatctgagcagagcttttgtggaaatgaagcatctctttctgttttctctttgagatggtttgagttagattgtgtctcttccaagcttgccacaccccagtgcctccagtcatctgctttcttgaaggatggccacgctggtgaattctagacaaattctaacccggggagagggctggagaatttctggtcctggttgggagatactccctgttaaaccttcggatatgctgacctagctgaggtagccaggggctatttaaaaattcaaaatctcagatctggctgtggataaacccccaaggtggtacgtgcagtacttggaggcgtgagggcagaaggtcctccccagcagtttgtacgggacacatcatctatgggatattagtaaatatccttaaggaaaggcttctgtggtcaaaaccaggttcagcaggttatttcactatggggcttctcaggacgcttaacctactcatccccctctgggctttgcaaacgaggccgccattgctttctttctgctatgtagaaatagattgaggcgtaagggtcggatgtcctttctccattcatcaggctccctcttcctgaggagctgctgtcagaacagcctggggctgctgtgttgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctggtatgtgcattccattcccctccaggtgggatgcttgggttttctgtaaatgctgtgccttggcctctggcctgctcacaggagccttcttgggtcttgcagggagcccatttaccgtgaagatcagtggggagggaagagtcaaagagagcatcacccgcaccagtcgggccccgtccgtggccactgtcgggagcatttgtgacctgaacctgaaaatcccaggtgggcgtcggggactagtagggtggggaagccttggctccagccttcagggcagtgggtgcctttgggaaccaagtttaggcatggcccagaacacagtatccaagtcggctgtgctgaccttttcatttcacttcatttcattatgttcttctatgtttattttcacagagtctcatccaagaaaaacaaatgtttaccttgctacctttttcctcttccaaataaaaatagctttattgtgtcacatgggggaaacgtagatatgcttttagatttttagattaactatctgtcaaatagaatcatgtcagtgaaagaactggccctgccgatgccagggtctggaagtatttaagaggtggcagcccagcggcatccttctagtatttctctttcattcctgaaattagaacgagggctgtgctgcagaactcgctgggccacatctagccctttggtggtgaattgttcttcttgggccccgattagccagtcaacaggtcacacagtctgtctgaaatgtgttccaagttctttctataaagaatccttccagagggaagccactgtgagtgaaaattttgaggctcctctgcccagaagttggcatgtcctgtggaattgcacaaattctacagagaagggaaatctaaatcgtcttcagatggagcttgtgttgcgagctctggagagggggttgtctttctacactgcatctcccatccttcctaacgagtcacggagctgtcgactccgccttcttggctttagttaacaggttcttcttgtgtagtcacatcaacgtcgggtcacatgggaatgtggtaaagcctcattactgtagagttcagacatgatcacttaaaaagagctttattgggccgggcgcggtggcttactcctataatcccagcactttggggggccgaggcaggcagatcacctgaggtcaggagttcgagaccagcctggctaacatggcaaaaccctatctcttctaaaaatacaaaaataagcagggcgtggtggcgggcacctgtaatcccacctactcaggaggctgaggcacaagaattgcgtaaacctgggaggtggaggttgcagtgagctgaaattgcaccgctgcactccagcctgggcaacaaagtgagactccttctcaaaaaaaaaaaaaaaaaaaaaaaagagctgtactgatcgtttgtagtcataaacagttcgtgtgcctcaaggtggggggaggaagtgtcacctcccagagagagcttggttcacattttaggtacagagttggaccctggctgccccatcctcatagccacgtctgctcactttccagtcacattggtgtactcatccactgtttttgtgggcatcttcccacctcaaaaaatagacatccacatcatctctttcatgaccctgataaaatgccatttcattcaatggaactattggtgatagaaaaagagagattccatttcatgtctagatgcatcaaccttcgttactcatctctgtgcctcagctcccatcatcagggctgctgtgacatttgccaccctgtgctcaggctgtgggctggatgcccaggagtgggctgggctggtgcatttcagatgctgccatgccttggcagaccgccctccacatttctccatactcccccaccagcactggggctgtctctccttctcactttggccaacctgatggaaaaacatggcattcagtgttcagtttcatatcttcgattactagtgatatgtgtactgtgttttcttttcatttgctttacatttctcatttggcaaaatttctgtgctctgcttatttcttgaggaactagcaagtatctgcagtgtggacgtttaccctttctcttaagtctcttccagctcttggccattttgttattcttttagttacttagtaccagatgactctgggtgaggctcgattttccactcattacccaaatgatcctctcggagatcccctcctccttaatggaggacagctcactaacttcagatgtcctccggacccaggttttgcggggcatctttgtcagtttgggctgctgtagcaaaatcacatgaactaggtggcaaccaacagaaatgtatgcctcacagttgtggaggctggaagtccaagatcaggtgccagcatggccagattgtggtgagggcctccttccaggctgcaaaccgacagcgtccccttgtatcctcacatgctggagaacggagggagccagctgtctgggactcttacaaggccactgaccccatcacagggtcgctccactttcatgaccttatctaatcctaattgcctcctcaaggcccatgataatcccatcacattgttgggggtagggtttcaatatttgaattttggagggacacaaacattcagttcattacatgggtgaccctcttttcaacctcccttcccttttctgtcctcaggggtcagagtcatgaactgctctgcccagatcctgtggggctggagggtgcagtttcatactggctctaggtgatggcagtgctccgtgccccgcatgcggccgcctggcctcaccacggcagtgcaggcacagtcgttggcatgacgtgagcagctcacggagagtgatgtggtcttgcgtcctagcactggtgacccgagacattgcttttctgaaagtgtggcccctggtctttggtttgctcaaagctttgctcacgcatggtttcccctctgccattgggacttacatatgttcacctttttctctaactttgtcttgttgcctaaaagaaatgccaaagcttcttgacggtaaaggatgatggctcttgttttctacccttacctatctgtggaaaggagcccgtctgtgcatgatggatgaccacgtcacctttggcaaaaagtctcagtgcccccagcatgggtggcctgaagggccctgcccactccatgctggccacagaagggcaggcacccagcctgaagggaaggaagcctgggcacctcacgtccaccgggctgcacacaccttgctctcggctgcttgccctgcatgtcctgccctgtctcaggcccttgccctaaccctcttctctcccccaacctccctccctctttcagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccaggtgagcattgcgggcaggattttcacttgggaagaatagagttgagcccaggcagtgtgggcacccacatacttttttgccccatttgaaagagaagacttctgataggtggcattaagggcattatttaaaacaaggcatcatgactaagtctggcacagtttgtaactaagctttgctcacttacgtaaagccaaacaggtttcttactgggagcctccttggagcccgtatcttattagtgtgcacctgagtctctaattggggagcagagtaatacggtttccagagcatctttcagggctgatgttctgtggaacatactagaaagctacaaaactgactgtaagcatcctttcctgtggttgccgctggtgggaagatctgtagggaaaaaatggaacattctcatctttctctggcttggttaaggtgtattcattttttaaattttttatttaatatctttttctctcttgtttgttagagatggggtcccactatcttgctcagactggtcttgaactcctgggctcaagtgatcctcctgccttggcctcctaaagtgctgggattataggcatgagccactgtgcctggccggttaagatgtattcagggctgggcgtggtggctcacacctgtaactctagcactttgcaaggccgaggcaggcagactgcctgagctcaggagttcaagaccagcctgggcaacacggtgaaaccccatctttactaaaatataaaagaaattagctgggcatggcggcatgagcctgtagtctcagctactcgggaggctgagacaggagaattgcttgaacacaggagatggagcttgcagtgagctgagattgcaccactgcactccagcctgggcagcagagcaagactccgtctcaaaaaaaaaaaaaaaaagacatgtcttcagaggactccagatgtcctgtgaatttagttatcactagtgatgcttaggaaacttcagcaatggaccttggaccttgcttgggttctgcttggggttggagaaagaggaaagggctagcaacagacgaaacctagcactgcaggtttgaacaaggatggaagagggacaggggctctgtggggctcagtcactaaccaggtttctctttgctctcagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtatgtattcagggttcacaagaggacattttccttgtttgaacatgattaggttgcaaggaacagaaatccatcaagtttgctgaagtcaatgaggaatctatgtgtatgggcacatgggacagcctcctagaaatccagttgcaagatacatggccagacctcttaagggtgggaacgcttgttctggttgccttttgcctttctccattagcctctctgcttcttgctttcattcaattgctccattctttccaccaaccagcctctgtctgcccacccatggctaccctggctggctgccccagaagagtggccttggcatctgagctccctctagcaggagctcttaaccttttgtgtgccattgactcttgccatctggcgaagcctatggggactgttcttgggataatgttttaaagcacataaaatgaaatatgtcacattataaaagaaatcattgatattatagtacagttaccaaaatcttacaagaacaaatatgcaacatagaaacatgcatatcttcgttaatacattaaatcataagatttggtgacagtatattaactgtcatcaaagtgacaaagtaataagtgaaaatgatacgtcaaaataactgtaaaatgacataaaaatatatgatttttaatggtgatgtaagtcatatgtacttataatgtgctgtgatttcttgtcaacatttctgaagaaaggaaatggtaaatttcagttagagaatggtgaaaattaaaacgtaattttttccccattgaagtccatggatctgctgaattcaatacaggccatttggggaccctgtgagccccggttaagagtccctggccttaccccactaaggaaatcatatcggcccagcctcagccaggcgactcccactcaaccaatcagctgtggccattgaggagggctgggtctctctgaaggcattttagcccttggtgagaagcaagagtccactctgggtccagagtctctgaaatgatgggactttcctgtcctcataggtaactacgaggtgtccatcaagttcaatgatgagcacatcccggaaagcccctacctggtgccggtcatcgcaccctccgacgacgcccgccgcctcactgttatgagccttcaggtgagatgcaaggaagcatccatctccttggccgcaggccaccagtgagacccctggactcctgaggctgcttcaatgtccccttaggtgctgaggccccttttcacattttgaccacagatgtcacccagtcactggggagctttcctgtggcagagtcaactccccatacacttagggcggatgacacttggggcgagcaaaaacagagccacagtcaacaacacaccttaatgtttggggacacgtttgtttttaaaggtttatttaagagaaacaaaggaagcctgttcataactggttaagggataacaagggctttcaaaacaaaaccaacacaaaaataacagtgcagtgatgttttagcctgctgttgttggctgcctttcttcaagaaagtcagttgcaacttactgtgattcattaataagtgtgcagggaactatattaagagctttatcagtgttacctcagtaaatccttgcaatagcctgacaagtaggttctcttgaccccattttaatgatggaaaaacagagatacaaggaggttttgtccactgggaaccagctagtatgaggcagaacaggcacagtgtggctccagaacctgtatttttgtttgtttgttgttgttgttgaggcagagtctcgctctgtcacccaggctggagtgcagtggcatgatctcggctcactgaaacctctgcctcccaggttcaagtgattcttctgcctcagcctcctgagtagctgagactccaggcacgcgccatcacacccggctaatttttggatttttcgtagagatggggttgcaccatgttggccaggctggtctcaaactcctgacctgaggtgatccaccccactcaacctcccaaagtgctgggattacagacgtgagccactgtgcctggccagaacctgtgcccttaacggcaacctctctaacccccacctgatgttgtggcacacggttgcatagtccatcccattaggataccaggagatgcaacatttttcctcgtcctaaacaggtcacttaattcaaggttgtactagcaccttcagccaaactaagaaccatcggggatgcctctgggtttttgcccaggacactgaaaaataattaggtgtctgaactgggagtagcaattaagttgtgaaataacatcgaaatcccaaagtatgatttctgggtaagagtttctaaatagccttgagctgcccccagttcttgaaaatattggattcattaaaatccaatctgatgtctaagattggtgatatcattggctttagttccatacacttggtttacatttgagattctaatcttactctgaggggaactgggatacctccagttgttccaaacattagtctttcatttagagacgtaaacagaacccaaaccagactcagtccacacattgaagcggcctcatccggagaataccaagggtactaactggttactgtggtgtagatgtttttcttgtgtttcatttaaaggcttcttaacagaagtgtcttttgtggccaacttaactaaaacctacggagggagataaacccagcacttattgagggcaggagctgccctcatgcatctcgaagatttctttcaaatctgccgaggcatttatctccctcttgaggatttagcggcaagcggattcaggtaatgtaaatgattctgtctaaaaggagctggtttggaaaaatcccctccaggaaacttctgtagagtgctctcgtcatagctgggtcataaatgtttcagtaagtgcacagcaggctgtttcttaagcttttgtaaccagctgctgccgcaggagaagtgtgttcatcagcatcgccccctgttcttcccgggtcatttgatgccgagtgatatgtaaattattgatcagagattttgcggaggcccacgcaagcaacatctggtgctggttagcaaagagaggcatgtatcgttttgtcttgcttttgagactttttaggaaattggagtaggctggcacttggggtgggggtgggatgggagtgatctggtgatcaaagaccctctaattctgtgttctgtcctccctcctcagtctatatcccctagggcagcacagtccaatagtaggttctgcagtgatcaaaatgcttcaagtctatgctatgcagcatgatagccactaaccatatgtgactattgaacatctgaaatgtggccagaggaaccaaggagctggatgtttagttttatttaagtgcattaagttgaaatatatgtatatatggcctcgtggctggtgactaccaaattagccagtgcagctttaggaccttgccatgaagatgtggttcttgggccagttcttggacctcagcatcacctgagaacttcagtcccagacccactggaaaagaatctgtattttaataagatccccagatggtttgcttacacattaagtgtgagccatgctgcttcagagttattgcctgaggagtggctgtccgaccaagtctaaatcaaaattactgacttgtaaaatgctgctgttcaggattggctagtcttaaaatatctcaaatgttgttgctcagctttgttcttaaccatctgaacttctaatcccctcctcccagaagaggagatagtttccaagacaaagtatggggagtgaaactgatccagggaagagcaaaagctatgtctttctatggcttcttgtggggatacaacctctaaatgcatattaatatttaataataagctgacgttttcgagcctctctgtgtatgggctaggccctgtgataaatgttttgcatgcacagcttcatttgatctttatagtagccctcgagatagatcgttattatgcccattttacagatgaggaaactgagactcgaagaggtttggcaccctagatatatagctaggaaatggtaggaaatccagatccagctgattcttaactgctatggagtactgccttctttgcacacgtagccctttataatatgttcctccaggtctgcccttgagataacaaacagcataacataaaactgtgttcgtgttcgtgagtgcatgactttgttagctgcagtatcctcttaaaagaggacacttttttgacctggaacatactgggttttctggcctgcatgggcattattttggatgctgagatgatagtccttttgaccaggatgtctcaagtatccaagcccagaaatcatctcttctaggctgaatcaagatggtttgcataagagaccatgcagatgcacgtctctgctatcttacattaaaaatgcagaatggctcacctgccctttgttgtcatatgttatatagaaaaacctatttgcatgagaactgtcacccacagttttgggtagggtcagtgtgtgccactgagcaggaacgccgagggccataacctgtctgatgtattaaattctcaggaatcgggattaaaagttaaccagccagcatcctttgctataaggttgaatggcgcaaaaggcaagattgatgcaaaggtgcacagcccctctggagccgtggaggagtgccacgtgtctgagctggagccaggtgagcaggaggcctgctggggggtcccagcaccagcactttccagcagaatgttcctgtaaatgtgtgtcccaagggagggctgatcagtttcattactgccagtgagcctctgaattccctttgctgttgccagatattgtttataaattagggtttaaacatgtgccagggatagggagaccctttatgctaggagagaatgctcattctttctttcttttttaaacaaatgctgggctgggtacagtgccttaacctgagaggtcaaggctgcagtgagctatgatgcagtgagctatgattgtgccactgaactccagcctgggtgacagagtgagaccctgtctccagaaaaaaaacaaaaaaacaaaaaaacacatacacacaacacaaaaacaaatgcttctttgttttctgttagtttttcagattccttttgcatgacattcatcataatttttctttcatattgtaacaacatcttacagatttttattcattgaccttatggcacgagtaagcatattttgatctcactttactctaaaggaaaagtaggttaatgttctgtaaatttaaaaaagaaaatctgggtctctaggccctaatgtcctaagatttttcttgcttggtgccttggtatatggaattctctgatttaatcaactttaaagagacagtgttaccggtgaacataataaatttattaagtgtcagaaacttgaaggaaggtataaggctcaaagagttgctcaaagtttagtgaaggcctggccaaaaagcagatgatgaccccaaatgatcactagtaccacaggagaactgtgaagcaaatggtaaagatggtcagagcaggagagagaaatagtttctgcctcggtgagttcaggagggcttctcagaggaggtgacatttgatgtgggccttgatgtatgaggaggagacctatgattactgccttatagggcatttgttgtgtgcctggctgtatttgtatagtgtagttggaaatctaggctctgaccaggcatggtggctcacacctgtaatctcagcactttgggaggatcagttgagcccaggagtttgggaccaacctgggtaacatagtgagaccccttctctacaaaaaaaagtaaaaaaaaaattagccaggcatggtggcacacacctgtagtctacttgtgggggatgaggtgggaggattgcttatgtccaggaggtcgagactgctgtgagctgtgatcatgccattgcactccagcctgggtaacacagcaagaccctgtctcaaaaagaaagaaaaaggaatgtaggctctgtgtgaacatttagatctatgtttcctagtaggcagaaaggcagtggggagcctcaggaggaacaagtgtaaaggatggggtcagatcctggttttagtctgaaaggccaagtggcaagctggtgctcccagagtggtccatttgaggaagcagtggcactggaaatggagaggagggacttgaggccagagatctatggtggctatagagagtgagagagagaatccattccaaaatgttccacgtagcttagtgattgggtcggaagatgacagtgcagttatcagaactagggccagccaggcagagggtgggtgaggattggtcagggccttaaagggtttaatattttactttgaggggttttgaaggatccccaatacccaaatggagatgtttactagatcactgtgaggtttggtggcctcagccccaacagtccctcactgggtaccctccctcttctcttaaagccaatgtgcttcaggggaagctaactccaccccagacaggatttgaacccctacagatgtatgagatcattagcatgacacagttactattgattgcaaattacagaatacccagctcaagccaactcacacaataaaggggcccagtaagttgcataactagaaagttcaagacatccaagacaggtttcagcaatttgatttggtcattgagctgcgccctgcaaggcgtcaaatatttctgctgttctgctttgtgggcctggttctggccttcctcttggtggcaggatggccttcctcttggtggcaggatggctgcagcagcaccagatgtcccaccttcacgccacatcaattaagagagacaccctctcaggattcttagaagtcgagagcctcctttcccagaagtctccagcacgtctgccttcccctctcactgacctggacacatgcccactgctgagtcatttcctgtggctaaagaaatgccatgtgctcattgactaaggcttagtgaagaaggatttttccctgatccactcagggaccacacctggacatggcggtggagccagcttcccctacaacacattggctttaagggaggcggatggggactgttggaggatgttcagtgccaaaggacgtagggtgcacagcttcatggaggtgcacctctgtggagacgtccagaggcagggagaagagctttggggaacacaaattctgagagggatgaagagtactaggcaccagggagagaccgagagactacctggagaggtaggaggagaacaggctctgcaccctgggcaggagggcttcaaggaggaagcggcagtcaggtggtgcacaatgggtagatgttctaggtgcccacttcagttaacagattaccttgctacatgctgtgacccaaacgcacagccacaaacctgccctgtgggggcagttcctagctttgagcttaattaaggagcattaatgccagttggaaccgttttttttccccttcaagtggccaaatagagaaacatagaagaagtgaggttttcttttttcccttcatatatattcctttttatttcttgttatgccttcccaaaacagagacattgaacagtagttagaatggccatctcccaatgtttaaaaacaaactgaactccccaatgggtgaacaaagtaaagagtagtaacctggagttcagctgagtaagccgctgcggagccttaagtggtgaggtcttccaatttcagagtgctgtgtcttcaacttgtatcatcattttagtggaaaaacataatttaattttggtgaaatgagattcatctcgtgacaggattagtaacagcattcacagaatttcacactgaagaagtgaggttttctaaagaaaggaagtgttcttctgaggcaggggtcagagtcttgtcctgtgtttataggatttgcaatgtggatgcgtttcccttggggctgatgagggatacccagggggtctgtctggttctgaaatccaggatgctgagtgccaggctccctgtagaactgttgattttaaatgggccatctcagcttggcctccatcctttatcctcactgaactcaggggtgtccatttgcttgatttcaccctgtgcctttgctcattctcctagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtaacccactcttctgcttcttgaagccttaactgaaccagctccagggaccaagccagatggaaatcctcaagccccatgaaagctttttacacgtactccccgtggaaactggggtcatgcacacttcggaggcgcttgctgtccaaagctgttttgggagttgcggtttgacccacgataaatccagagtgagagctcgatggccgtgttatcacacctcattactgttagttgtgattcagattccttcctctgccaagtttcttgactttcagaacaggatgctgatagtcagggaacacagcacagtgtcattaattttgagggtttctttgcctgcacagaattcatgatgcgtccaagtgggctcctacccgtctgttctttcatggtaccaggctcccagaaatgcactgaagcagcaataagacctgtcccagcctatctcctcctctttttactctcagatcttaatggaggaggagaaaagactgaaatgttcaaagaattctgaagctttttagacccgttacaatttacttttattctttgccacagatgggacatgtttgattatgaaagatacaggcagtgaagaagtaaataaagtgagactcactccatcttctctcctcctcccccacctgggtctggaagcaaacggctctgggaagggaggaccttcaccctgtctgtcatctcattgtctgtcttcattcttggttgctgggttggttagctaattggttcattagacaagcagacacagagttttgcttttgtcttacagaaagaatcttactgtatccactgtgtggtatagcttgtgtttttgctttgacatcttaaagatctttccatgtcagaacagatcttcccctccttttcctggctgtagtgagaattcctgctgtgaatcgcagttatttgaacaggtggcatcgggtggtgcgcagtgagtgcgtcactgttatggaggctgccagggtggagagtcagtccttagtctttgcaggggaagtgcgcagtgtggactcactggggcatgtttgcatttggtgttactttggaccctcttgggaaagcagtatgtcctggtttcttgagtctcttgtgtgtgtacccccaccccgcataaggagagtgggatggagcagacttgcctcccaggggtgaggggtgagtggctgcatggttgcctggcatccagccctaggagcaagtgacctgtgtggccaaggggccctctccgggtgcaggagtgactggtgggctggcaggctgcccgggactctggccaaagcagtggcctcagcaaagccacccacaggggtggtgtgagtgctgccagactccccaggcaaatccagcccggctccacgctgaactctgggcctgcggcttgccttttgtgaaaggcatggtatcattttaccgtaagtgatgtccattttacagatgtggaaagtgagatgcagaggttgagtcactccccaaacaacactcccccaaaaagcagtcagctgggaggaggcagaaccaggaatcagtctacatccgtgacctcagagcctatgcgctgaacccccgagcttggccccctctctaagtggctggctcacccagaggcagtgactgcatccccagcccactttggggatgtcctaaaccaggacccctgtcctcccagccactcaggagtactttccaggcagcagtgctggcacttgggccctgacaaggtactcacctttgagggcccaggtggggtcctctcggcacttggagcgcgtggcaggcttcaggccaggcctcacagcagctgctggggtctcccacactggccaggaagcatctcaccctcctgctggctcatgccgctgtgcctgggccctctcccatttccttttggctgttcgcacacctttttgggagcttgggtttcaggctgtgctctgcaagtgctggacgctgctgagagaaggagttgctcttgcagggaagctcctagccaggaggggagaggtacagaaccgcctgcttcaaaccctgtgtaaatattgctcttgtcacagggaaggcgccttgtttttccagccctcctgctcccaagcctttccctaaatatccattctgagattacacagctgcagtgtgcatggaatgaaaaggtatctgtgcttggccgccagagcgcccagtatcctgaccttctgaacaaagcaaacctccctctgtttttaatgggtgagtttgctgtatctcttggctcaagctttaaatggtccattctgtagattttggagtaggggaatgtggagaatttggggcgggaccctgctggaggcggcttgagaggctgggagatagaccagggagctccagattctttggagccgctgagcaattttcctaatgaaatggtccaggaaccccagtgtgctcggggtataccagaagggcctccttccttaactgccttgaagaacaagcagtgctgcgtttaacatgcattaaactcacaggaactgagctggacatatttgagggggtgggggaagaccgccacgcccagagatgttttgtggtgtcagatacaggttatagctagaggcagtggtgagagacttctgcttgtggatttttttccttccatcttctctcaggtaagtgctttagctccaagttggacagactttatgtttaaatcccagttctgctggtccccagctgtgtgactccagatgaattatctgacttcactgtgcctctgcttcctttcctgtaaaacaggattaataacaggacccacctaataggcttgtttggagctgtagaggaggtaacagccaagtagtagctcttgtcccataacccctgctttctcttttcccacctcgtcttccctgcccttttgggccctcacagtcaagatgaactgatttttggttggtcaaaatattgcattagggccaaatgggtgcggtggctcatgcctgtaatcaaagcactttggaaggccaaggcagaaagattgtttgaggccaagagtttgagaccagcctgggtgacatagtaaaactccatctctaccaaaaaaaaaaatttttaaagacgaacttaggaatgaaacagcttgttaaaaaatggtggaactttcccctgcagccacatcatttcaacttcactttaaaaatatctttttggcctggcacagtggctcacacctgtaatcccagcactttgggaggtggaggtgggaggatcacttgagcctaggagtttgagaccagcccaggcaacacagcaaaaccccatctctacaaaaaaatttaaaaattagccaggcgtggtggtgcatgcctgaagtcccagctactttggaggctgaggcaggaggatggcttgagcctggaagattgacgctgtggtgagctgtgatcatgccaccgtactccagcctgggcaacagaggaagactttatctaaaaaaaaaaatattagtaataaggccgggtgcgttggctcatgcctgtaatcctagcactttgggagaccaaggtgggcagatcacttgaggtcaggagctcaagaccagcctggccaacatggtgagaccccatctctactaaagaaatacaaaaattagctgggcatggtggcgagtgcctgtaatcccagctaatcaggaagctgaagcaggagaatcgcttgaacctgggaggcggaggttgcaataagccaagatcatggtactgcactccagcctgggcaacagagcgagactctatctcaatcaatcaatcaataaaatatctttccttatcatcaccttacagctgcttcctggatggacacactgtctccttgttgctcacctcccgcttcttccctacgtagccccaggcctcagagctgctgcttgaggggcttcttggctgcacagattagataccatgatgaggttgagatagtgttgggggtggaccttggggcaggagcctcaagagcttccaggaacagctgggttgtgtttgagagttgcacgatagcagctcttttgtttttattgatatccagaacaataattctttctctggactaggagctataattaaaccaaaatatttcccagctggggcagtgtctagggctctggcagaagcatagccctgcatggggatgctatgccaggcatgccccatagagggcactgtagcaggcatgcgccagacctgatgactgaaggaggctctccctgggccagctaagttgtctcagggctgcagttaggggatctgaggcagctccactgcccatccaggggtcaagagatgagcctggcaccagagccatgcagacatggttcaaacccggctctaccactttctggttgtgtagcgtgactggccccctccctgagccgcagagtcatttgtgaagcaggaatcacggaaaggattccataccacatgcgtaaatggtgctgtgcacaggacctggagccggagtggggtacgcatgccccgtcagcgggagctgctgttctgttcctgtgcttgttgctggaattcacggcaaagtgggtgggctggcaggtcacagtggctgcacccggtctgcagcacagtgcctggggtgagggctgaggaggaagggaggagatgcttggcctccctggcttctccaagtctacccggagaagaaaggacagtcagaggggcccacgcctcccccacacccctggagggagagctggactctggtggctgaagcagcacttcaggctcacagtgtgactcaggcttcttgccctcagccacaatggctcatgcccagaggagagaacagggtgtccaggctgttggtgcttgtgggcgaaatgtcagccatgctcctcctgccttggcctagaaaagggagcccccaccccgcagggcctgaggttctctctgccagaagttcagagctagtgccagtgggttcccatgccaccagggtgagccctctgtaaggggatctatgtgtgtccctcaccacggcctcagtgctcccaggaaagccctccaagtcatcaacacagcattttctattcctttctcccaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggtaacgaacaaccaccttcggagttactctcccttcctggggagctggttgtgtcagatcaatcatagtggaaactatggatggttttagatgtgttaaagctactttgaactttgaatgtcagtaaatagtatgagatgtcagagggcagtgtttgaaacttacaaaagtccacagagtggagccgtgcagaagttgagaaagcatgttaggatgttaggtggttttctatctctaacaggaaagaatacatattgaaatcttacgtatttgtttagatcagggtctgaaaaatcccctgatttctaattttcacttgaaaaataatcaaaaagttttcctatacttataaaaatgtgtctcctccaaaacactggaaaaaataccaaactatgaaaaccacttcacagccaccacccaaggtaaccaccataaacactgtagtaaatcccttccacacgtcatgattcactgttacataaagaatgtaggttcatcgcaggaaaattagaaaattcagatagaaaaatcatcctttctcatccacagaatcattttttgatatttcattatatgtcatcccaaacttttacactgcttatacatagactattttatgtcaatagaaagatgtgaattccacaggcacatctttggtgggtagggggtggggggattgggagggtccttggccttgtcagccaaggccagactcatccatttgcccagaaagccagatcctagttgtatgggggtgggatcctaggggtttagaagacattatgggtgtgagatacaggtgtggtggcttttgtgttggggtgcgcgggctctcctggggttactgtgtagggtactcgcctgtcctctggctgagagacccctcttgatctggccattcatgcctgtccccctccctcctgtatcttaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggtaggtgtctgggccttttcaagggtggggtggggcaggggcaggctgggcaccctgggtacactggccttccctgctgaggtctcctgcagtgcccacccccatgtaggccagccgtttgcaagtaaccatcgtcatgaccctgttctcctgcacttaatatttttaaatgatttccttctcttttgccttttgaacttgggtatttatttgggtttcaagggtcggttgcctgggttctggcatccagtacacctgggctggaaacctagtaccgccacttcattcattcattcgtttgttctaaaacttatttagccatgtgaccttggaaagttattaaatctctttccaaaagtcagtttcctcttctcggaagtaccttccttaaggtgcttgtgagagtaaacaagaagattctcatagccaacacttagaatagcccttactgtgtgctaggttttgacacccataactcttaaacctcacaactagttcgtgaggtatgtgctgttctcattccctgtttacagatggggaagctgagctagggagaggtgagattccagtccaaggtcacccaggtagcaagtggcagggcagggattcgaacccacaccgtcaggctctatgagcctctgcttgtaattgccacgctctcccacctcttaggggccccagcattatcgtggaagcaccttacctttggctctcatatttcctcttcttcctgtgcctgtcctgatgcatccgggtggagtaaccaccttttgcctcctaggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgt

SEQ ID NO: 37006 - DNA, 1634 bp, Homo sapiens
gccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaatgcttcatatttgaaaaagctgggaattgctgtctt

SEQ ID NO: 37007 - DNA, 53622 bp, Homo sapiens
ctcggcggacgcaagggcggcggggagcacacggagcactgcaggcgccgggtgaggcgtgcggcggccggggtcgggacgggggttctgggcggggggttcctggtggagggcccgggcgggcggcggggttcggcggcaggtgcggcgggcagcctagggggcgcggcgcggggttctcgcccggcacccccggggcaggtggagctgagccggcccgcggccccgcgaccttcccctcggcgccgggtcccctcaggtctctcccgaaggaaacgcggagcctgggtgcctgggcgccgtccctcggcggctcccgagcggttgcagtttttgaaagagtttctcaaaggcttgacggttgtgactgcagccgcggggcaacggttgctacacaaagtgaaacttgccgagtgctcggcttctcacgggcttcctggcagccccgggaagttcctcggcggaccccgagcccgcgccccctctccacggatccctccccagcgagtgcccccccgcccgccctgtgccccctctcccctgacccctccctgtcgggtgccccgcgggctcgcgctggctgtcccgggactccttcctcctaggtgttcctcctgcccctcgccctctctctcccaggcgcgcgctccctctccccgggcctttccccgccgggtatccctgggcccgcgccccctcttctccgcctctctccgctgggtgcacctcgagtgtcccccagacccctccccgcccggccggcgctctctcccctgaccctcctggccgagtgttccccggggcccgcgccccctccccccgatcctccccactgagtgttccccctgccctctctctcccgggcctgcgccccccaccagccccttcatgctgggggtcccctgggtgcgcaccccctctcctcggacccacccccaactggggggcacctccagtgcccgccggctgccccttgggcgcgcgcccccgctctcgggcgcctcctcgccgggggcccggcccggccccgccccgcccgtgccccctccccatgcccgcagtgctgggcggggcgctgactcacccgggcccgggctggccggttcttaagcggcagcgcgctgcgggcgccgagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccagtaagttgcccagtttctgggccgggcggacgggagaggcttcattggagaggggaggcacctgctcgaggtgttggggcagttcctggggaacagggttcttctcacacgcagaagacgataggaataggaggaggttttcgccgctctttgttacttgttgacccttttgtggagcgttaggaaaacaccattttgatgcttttctctgcagtctttttctttgtgagccccctccccagtagttacggtcttttctaaaaactagaggcctttttacactgcttccgtctgtttttaaagggtatagtaatacaacttagaagtttcttaaaaagtccaaatcacagggagactcagatggcttccgaccacacacaccagttctcagagctcctaagggtccgaaaccacaggcgccccagatccaactggggagatattaaagggcgtttgggagaggagactggctttcggaagttgcctttcagcttcgcttcctactaggcccatgaagcggtgccctgtacaccagcaaacttgctggctgcagcagaatttctgtctctaacagaaggttagccatggacttgaattgtagatgcaggcagccggtggagtttgataagaggttcctggcaggccgggccgagcactcctggtcagctgatgaaagggctgtgcctgcgcctctgtctccttgaatctgattgtgttgagattgctggcgagacctgggggttgtaggcacaaggcaggttctctgggactgacgcttcttagaaagttgtatgtattctacctgcttttaacactggggaactggtgactagacattagggggaaggtttaacattttttgagttttgaatcacaatggacaaaatatcaggattcattacaaattgggattacagatacatctggaatttttttttggtttttcaaacaagttggttctgtaatcaatgcttgtgtgccttttgtgggggatgggggagcggagtctctctctgtggcccaggctggagtgcagtggcatgatctcggctcactgcaacctctgcctctcaggttcaagcgaatctcctgcctcagcctcccgagtagttgggattacaggcatgtgccaccatgcccagctggtttttgtatttttatagagagggggtttcaccatgttggccaggctggtctaaaactcctgacctcaggtgatctgcctacctcgacctcccaaaatgctaggattacaggcgtgagccaccacacccggccttgtgtgcttcttctgttacattttatgttctctaagatctttgttagaggtattaattttgctgttaggataaagaattaatatgccagtagattcagaagccaatataatttttgcctaagttacatcaagatgattcatttgtgatgcagagtattttctatacaaaatttttctttttaattcaaacttaaaagtgacacgtgacatcgaggcttgacagtgcatgtggtatgaaactgacctaagtacaaccccttactcaggcagagctgagtgcaacggtatgcggaggagtggtcaagaagattacccttctgggtgtggttttctttatttcactaaaagaagaggtgcagagctcagctaagatagcactcaggaaaaagttaacctgttctccgtcactacttttctttctcatttctcataatgaatggtaatttatttttatggtttcttttttgtattttggtaaaatatacagtttatcctcttacttttaggtttacatttcaaggtattaagtacatttacattgttacatagccatcaccaaggtccatctccagaactttatcttcccagattgaaactctgtacctattaaactctccctccccatccccaccaccagcccttggcaaccaccattctactttctgtctctatgaattcgacaactttagatacctcatgcaggtggaatcgtgatagcatttgtccttttgtgacagtctcatttcctgtagcataatgtcttcaaggttcatccatgttgcaatgtcagaactcccttctctctcttatttcttatggcaggtatgttttcatttcattttgttttagaggtcttttatgatagatcagaacttaaaagatgtttctgacatttgataaagtgaagatagttgtgaaactgttaaggaaagacagtagccatcaccttgtgtattagagccagagttactctttgaaagactgtattctgtataatatctacaattaaaatttttaaactttttttgaggccaggcgaggtggcctgattacaggcacgagcctgtaatcccagcactttgggaggctgaggcaggcagatcacatgagcccaggagttcgagacttgcctggccaacatagactctgtttctacaaaaaatagaaaaattatctgggtgtggtggctggcgctctgactgaggctgaagtgggaggattgcttgatgagccctggaggtcaaggctgcagtgaactaagatcaagccactgcattccagcctgggcagcagagtgagatgttgtctgaaaacaaacaaaaccccttttttgagaggcttccttttaggtcagccatacctgtctgccatgggaaatttctccctgccccctctttggcagaggagggtcttagagataagttaaacacactaagcctttctgtgtgtaaattatattagagccatcccacaaatcactgagaagagcatcgtaggttgcacatatttgaatatgacatttcttaaggctgttagagaggatccagttagttttggtttggtttggggtttttttgctgccttagtaaatgttaaaatgaaacatccaccaacagctctgtggatgtgtcctttaaacaaaggtttattgattctaattattcaagcctaagttaagaatgttagcgaagaatgttaggtggttttcttgggcttaatgtttaacaactggattaaggggcaaacacacttaaaggatggatacctctgagtagttggccttccacctgattcattgcaactgttaacccttgaattcaacgggcaaagtatttttgattgatttgcctgaactgagtgagtggatgactttattcataaaacagtataactgaaaatactcatttcctgtgttttctcctaatactgtttcccaaaagcaacagttacttaaaagactgaggcggtacacagtggctcatggcagtaatcccagcactttgggaggccgaggtgggcggatcacaaggtcaagagatcaagactatcctggtcaacatggtgaaaccccatctctactaaaaatacaaaaattagccgggcgtggtatggatgcctgtagtcccagctacttgggaggctgaggcaggagaatcgcttgaacctgggaggtgaaggttgcagtgagctgagattgcaccactgcactccagcctggcgacagagtgagactctgtctcaaaaaaaaaaaaaaaaagactttattcatcagcaagcggagtgacctgcacagagggcgaggcagaccttgttctctggaagcttagtgtctggtacctgggccaagatgcggggtaaatgctgaaattgaaaacccgctaagtgctgtcagactgggaaagagcctaggtaacgtcgagaggaaaatctgatggggaaaggaaaatcatctgatggggaaattggcagactgtattgagaagtaacacttcagctgaatcttgcttgagggctggggggcgcacgcggcagcactccacagggaggaacagctgtggtttgttgtctggttttgcttttcccacagctgcttagggactctattcatgtgtgactggctgacgtccaaggagggtgatttggggttccagagggagccttggcctctgttcaggccagtccccaggacatggtgtgctgtgtggccttgtgggtctgccccatctagggagagttgtaggagttggtgctcagatcattggtcccggaagcatcctctctgcccgccccttcatgttagggtgactgcggagcgcctttctcccacacttgctttcttctgcccagtggaaagaaggcatggggagtgagcaaggaacactgctgtagttaagctctggaaggaaaaggggattgtgttcagggctgagatctctttaagctgtcatgagaaccatagagctgaactgcctttaagtggctccaacacatcttacctgttcatttctgaagtgttatagacatttctaatacaaaagcaggtttacctttcattaggaaaactctgaaagtgtgttcacatttctactgtgccaaaattttaaggtaatttctgagattaccttgcctctttgggaatacataaccttttctattaaatattttaacagggacagtttactgaatgtactcccccctcacaatcccctcgcaattgaggaggatgcgtagcatctgtttccacccctcctcctccacgaggggcagtggtgaattaggtagctaacattttgccatgtggcagtgagaggtgctggtaggatgagtgatttgccatgatcacgctgtaaggcacaatgaatgtatttggatgttcacagacacagtccctgtcagtggatttacagtctggtttcggggacagacagcaatcccagagtaaatgtaaaactgcagcttcagagagtatgcctgaagaggggtacatgaggcctgagagtagatgaagtgtgtatgtgctggtgggggtgcaaataggggaggtcaggaaggcatccttgaggacgtgacctccctgggcagaggtaacaacgtgtgcaaaggccctgtggtgggaggaagtagtgtgagtttggggtttcacatgaagcccaatgtggctagagaggaagacaggtcaggccatgccttgtaagccattcttgggtgttttttagtttaacttggggttttgactgggaggtgacatgatcagatttgccttttgaaaagttgactgtgatctgtaataggaaaatcacaggaggcaggagacagcaagggtagttatggtagaccattgagggagctcatagcttggaccaaggtggtggtggtgggaacagaagtggatgcatttgagagttctttgggaggtagaattgatagtgcctggtgatgggttggatatgcagggccaagggtggtgtcgaggctgacttctcgtttctggcttgcgcaagtggatgtgtggtggtgccatcgctgaggtaagtaatcctggagaaggaccaggtgtgggggaaggtggggagtctggatttgttgttacatgttaataagtttgtgacaatcgttgatgaaaaaagtccttgccttctttcattactacatccactgccccccaaaatattaaaggaccagactccttaaactacgttatttttaaatccaaataattcagtagctttttgttttccctagtatatgtacacaccgtacatacctaaagttaagaggaagggttaatttagtgcagtgttctcaaaattttgtgtacacaattgtctggagactgttgattcctgggtcccttgaagaactaatgacttccatctctagggtgaggtgcaggctgggtgcttatgttttaaataagctctccagatggtactgctgattcaataggaaaagggcagttattatatattcctttctcctgcaccccaatcaagcccagtgtgatttcagagcacccatttgggtgaaagcagtcacttgatgcccagccgccttacagtccggctgaaatgccaggagtgctgttattggtatttgggactcgaataggggctaggatgactctgtgaaaaagagccataaaaacaagaatttcatagctaatttactgcttacctatacttgggcaggccattcaacataatattcttctgacttgagtttctctctgcagggagtccagtaacagcttcatttggcagtgcccagtggtctctcacattttggctctttgttttcaaagagaaaaaaagaggctagaccttccctataaatggtagggaagtaagagatcccattccttgttcctcttttattccttccacactggcctcttttgttaatgaaataatgtgaattttttttttttggaaacagggtctcactctgtcacccaggctggagtgcagtggcacagtcacagctcactgcagcctcagtgccccggcccccacccttggctcaagtgatcttcccacctcagcctcctgggtaactgggaccacaggcacacactaccacacccagctaattttttatttttttgtgaaacaagatctcactgtgtggcccaggcggctagtctcaaattcctgagctcaagctatcctcctaccttggccttccaaaatgttgagattataggtgtgagccaccatgcctggctgataatgtgatttctaacaaatgttgaataattatagtttgggaaaggaaaacagtatcatttagtgaactataatttttttcttaatttttttaacttaaacttttatatctctttgacaatttggagattcttagggtggtttgatatacctgctttctaatggtagttagatgtttcagctctattctgaagcagtgaaattcagtctgctttctaatggtagttagatgtttcagctctattctgaagcagtgaaattcagtctgctttcaaagtcagtgaatgcattttgaattatcccttatttcatttcagtagtaactaccttgagactccccaagtactccaattagtttttaatttcagcagtaaatgtgtgttgaaaagaccaaagtttgcattattttccttctgatgtatttaccatccatgcctgttgacataaaaagatttttccagacttgggtagttttcagaaccaaacaaaacccttgtgctataatgtgacttagagacttttgactgaaatgcttgatatagttaatacacataatttttttcaaaatgaaaccacaaagagctataaagagaatttcatagctaatttactgcttacctgtatttggggaagccatttagcatctgtgaacctaaatttcgtcagccgtaaaatgggagttagtttttaagtggaaagaatgttacataagataaacggagacaaagtttttatcagtgaaatccaaacaactcatcttaagatgctgtaagctttatgtgtttcttttgtgtttccctaccccgcaaatgtttttcaaacttaaccctgttaggtaaaaactctgggttcctataaacgggtaaagtttgtccattggtcttctcaaggaaaaagcaatatgaacagtttgggttatcttagtaaaagggaggactctgattttgtctcatgtccatcctctctctgtgtgttctagtcggaattcccttatcagtcacatgggtaccaccttcatgttttgaagcgctattatatcccattatgtgcttggtgcagggacaataaaaataagattggttttgcctttaaggagttctcagtctcctagtgaaagcagatatgtaagcaattacaatgcagtgtagtgcatgatagaggtcttcacagaagagaagtgtgccctggagaccagggagggcctcccggctggtaagatcctttgggtaagtgtggagggatgtgggcttcccagtcagcagtggtcagttctgttttcctttattcattaacccgttcttaacacttacaggcaaacagtaatgctgtttcaaaggaaatgtaaaacttcattaagttatccttttaatctaatatacttgaaaacaaaaccttaaaagcaaaataaaaaatatctcaccatgacccaccttttattgataggagaggaaccagtatcacctgaggatcaaactctagtagtcagtatatcagattttgctcatatttttaagttagaagtcacttctgcaacctaattttgttttccatttttgcctgagagatcaattttaaactgcctgtgtggacagttgtcatttcagatactgtaaataattgtttttactttaggatggggtaggtaaactatcatcttagggccgagtctggctgtggcctgtttttatttggtctcccagctaaaaatggtttttatatttttgaaggattttaaaaacaacaatatgcaacggactccaagtaagaccctcaaagcctaaaatacttactggctggctctttagagaaacaaatggaccaactcctgcttctagcataaaaataattattgttaagcatttattctaaccttgtatatattttatggctggactaatatttggaagcagatccaccccattggttccagtttttaaaaaattgttctcaaagaacagaatgtgttttgttagccaatgttgagcacatcatggactctgagcatggactcagaaactactgaggagaggcatcgtggtgctgaggtaatgttttaaacaaagctggtgtttgggtgggtctttgtgtagagaaagtggcagtatcttgtgtcacacttgctaagctattgtgtaatgacagatttctggcatatgctaaaagaaagcaatttgtacctgatgtttgagttggaaagagaatgttatgtaaatgaattgcttttttcctcattgatagtttaaaatgagcttttgatctactatagtctgtatgtgaatttctgactgcagatgttttgtaagtccattcctgattcagaacaccctgtctaaagtacagctccatctctgtgccgtgccccactttactgcactcatagaactcggtctccacctataacgctgtcaggtgcttgtttatttgtgctttttgtcttttctggcagcaaagcaagaggataggtgttgtttttgtgtttttgagatgcggtcttgctctgttgctcaagcacgagtgcagtggtacaatcatagctcaccacagccttgaactcctgggggaccgcaggcgctcactaccacacctgactaatctttttatttttatttctatagagatgaagtttcacactgttttgtgcaggctggtctcaaacacctggcctcaagccatcctcctgcctcagtctctcaaagtgttggcattatagccatgagccactatgcctggcccaagtttgtttgtttgttgtttagcattattattttatagcaaactttaaattcttgtttattggcaggataaatagagggaagaaggacgagcaaataggtaaacatacctgcctcctagtgggtaatcttgggcaagttttttcacctccctctgcctcctcatctgtaaacaagatcctgcgtgcccgcctgggatgcctgctaagatggcacatgggaagcacctggccttatgcctggccctggtcagtaagggctgtgcggttccacttgtacctgataaaattctaatctgattaaaagctttactagctcgtgatggtcattcttttcctctaacttagcagcccgatgaaataatgtagtaagtaaatgtaaccttgttgtttgtccttttgctgccacgatgaacacagctgtcttgctagacctctgttgacttcaacagggatagcatcaggtttattggaaatttacatatgggacagtccagtggtggtgggttggacagaacagcaactgcttcccgaaagcttggaaaaagcatgcagtttacacagcattcttacttaacatactccccctaacagcctccacctggcagccttaaagtgcttgtgggctgggggttcagatgttccccatagataaggaattgatttcagggttggccactaggattccttagctcggaactccacacacgcattcttcttaagttattgatgttaggtacacctgtacaaccaccctgcataaagttcattcattcaacaaatagagcacctactttgtgccaggttttcaggtactggggagacattggtgaacaaaaagaggcttttaaaggattatcacctgcttggttgacagtcacatccagtgaatggtggaacccatttcctgctaatgtgtatttgagcctgaaatgcacattgtcccacctttcctcaatggcaaaatgctctggaaaggagatgctggtctgactaaataaaatgggctttctgtttggagttgtaaagggagccgtgccttcctcagcccctcctgaaagaaagacctgctttcaagaagcttatattgcagggggaaagacacatgtctaatacatcgtcagggggtggtgagcgtgctactgtaaattttcacctaggctttggcaagagctagaattaactttcattctttactgactctttgaagcgttaaaaccactgggcagagtgacttaggagtgggcccactgtgatgtgtttttgttggttttctggtaaatcacttttgggttggacagtgaaccatgatggtctttcttcaagaacttgtttttgcaagggtttggtgataagtccatcatttccaaacccacttactcttccatcctttctcaggtgctgtggttcagggaaatgattgttttgatagtattttacctattgcaccattacttcatctgtaaatttcttataaaatatgtcttgggatccagccttgtcttttttgtttgttttttttttttttttttgagacggagtctctgtctgtcgcccaggctggagtgcagtggtgtgatctggactcaccgcaagctccacctcccgggttcacgccattctcctgcctcagcctcccgagtagctgggactacaggcgccagccatcacactcggctaattttttttgtattttttagtagagacggggtttcaccatgttagccaggacagtcttgatctcctgacctcatgatccgcccgcctcagcctcccaaagtgctgggattacaggcgtgagccactgcgcctggcctgttatgtttttaaagagaaaattgaaccacaggtcacttggttaaagcttagcacataaatatgagattggaatcactttatttgtaaacatatatgtagtgtatattggtacagtattttcattaaggtgtgtttcattgcctcagttaaataattaagggtgttggctgctgggatgttgaagtatttgcttacataatccattgctgtttgggtgagactcttaaatggatttagacagataatggtgagaaaactggattttttatttagaacgtggctgaacaaggcaatgtggaaatagtgtgataacaaggtgcattatataacttgaacaaatcaactgcaaaaagacattttcaaagaaatggaggaaaattgaataatatttactgaacttgacgtattaaggaattgttttaaattatgttggatgtgataatggtattgtgatttttttttttagtgctttagagcaatatactgaagtttttacaagtgaaataatgaatgagggccttaaaatatgccagcaaaaaaaaaaaaaagtgaaagtggtagagtagaagaaagaatggtgttgaagctgaaaagagagtgtggaggatcatggtactacttattctctctacttttatgaatgttttcaactttccataatagaatatttgcttttaaaaagcatgttatagggtagaaagggagagatgctttacttttgctcgtcatgaagtgcctgagtgttgaggtgggaggatctcagggcgagggcaggtcccccattccctgctgctggggcaacctttgtgctctggatcaaatgagtaactgatttgatctcatcaaatggccccacccgggccatctcaccctccatgcacatgttttaaaaggaggtcactactcaaaattgcagctgacttggaaacacatagaacgatttgttcccagttttttccactattactttgtattcccaatgttttggggggcccataggaatggggcacagtgctgtgacccaactgggaacaggtcattgtcttaatagcgattttctcagacttgaaaattgaaatgaacaaaataaggggcatctactgggtagggctttagccattttaagagatcaatctacatactggggctgtgggcagggatgggggaaggaaatacagcaaaccatgggttggggttggggtgagtgatagggttgtaaaatgtacaccatgtcttttccagtcaagtaatgatgtacaaattataatgccatttcagatgtaacatacttgatactgacagtataaattgaagagtttttttaattttaatttagtataatttcagaaatggtgattttaaaagttttggcagggtttgcttatttaagcaaattttgtaagattactgatttagtttggattttttaaaagaagctactttggtcttgctaatttttgacacatggcaaaagtaaagactggggtgagttcaaatcttgtctaatcgaagtttcttacaggagaaatgttctttaacattgtataatattgctcatgtgatcttaactaggggcaaaaatttatctcagcaatggcacaagacttaagtatggtttatgtcttatgtcctctaaaaaacaggttagcaaagaaatttttcgacctttttttttttttttttttttttttcctgagatggagtctctgtcaccaggctgggagtgcagtggcgccatgtaggctcactgcagcctccgactccctggttcaagcgattctcctgcctcagccccacgagtagctgggattgcaggcacacgccaccatgcccggctaatttttgtatttttagtagagatggtttcaccatgttggccaggatggtcttggtcgcctgacctcgtgatccacccacctcagcctcattgtttcctagactcaccttctcactcccaagatcagaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaaaaaataagaaaaaaagaaaggaaaaactcttcacaggcttctaaatttgcagagacaaccatgcattccaggtgaatagtgatgtttaatctataggcctttagttccctatcttttctgagcctacaattaaaaccgactctagcatataataagccatcttggccttgtcccttacttttgtttatgtgtgtagttactaagtttactaagtagttactaaacttaagtttctgtgtataattacctgcacatttcagtgaagcatgttggtgatgaagtatttatgatatacctagtgaaactgaaatcacatggtatacaatcaagacttagacttcaggagtttattagataaattcttgttcaaggtccctttctctttattttgcctgccctgaggtaaggagatgagaaggatgtagattgtgtttctagaaagaatagtttcttttgctgaatgtaacatcctttgattatttcttttccctttcttaggggaaagtggtgtctaagaattccagtttacttccctgttagataacacacaatgtatgttatttccagtgtagaagaagttggttcttaattagagacactcaccaaaaagggccttaaaaactagcagctaataggtatcaggagcattattttcatacgccatcagcaggtcggaaatggccatcagtgttactcggcagtgcaggcttggaactcgggcatgactagcagtcatttcattgtcagacctatggaaagcagctcctttctgcctcccagatgcagtggacagtagggagggcttagcacagaactcttcccaacctggttttaaaatgaccctcttttgaatgtgaatgcccagaaagttcccttctagttctaaggtcatgattttcttgctgataataatgagcacagatgggactggtttgtccgctttttgtgtttgttaagcagccttggtctgacaggatgtgggtctaggggcaggaagtggcttactctcagaggaaaaaggagagctatttaggatttgagatttcattacatgttcttgaaattatggggtggctattattctggactctctctgtatattttatatatatatatgtatatatatatatatatgtatgtatatgtatatatatatatatatatgtatatatatatatatatatatatgtatatatatatatatatatatatatatatatatatacatatatatatatatataatgttacataatatttaccctggagttggtaaatacaaacttttcaaaagcataaaaccattggcatctatttaaagatactattttaggagtaatgttaaagagccagagctacacagatattttggtagctgattaccagaagttgagggtctcagtttttgtaaccattaaaaaaaggtcatcagacgaggataaccgtatacctcgtatcgagtactcatttggagtcactctaccagttatacttcatcactattctgattggctacttaaaacatacgtttatataacataaaaatgtaacatcatgtagatacgtgaaaagtcagttactaggaaattcccagcccccacttctgtgtcaatactctgccctgttaacgtctgctgcacattaagaatttagccttgacattttaagtttagcctaatggtggtgctggaggaagtagtaaggagaacagtttagaaaaggaggtgtgagtggcatgtagtgttacttttcatcatttaaattactcaaaaagttccttaaagtgcttctggcttctctgggaaatgagttcctgcttccctgtggtgtcaggagaatcgcagggtaggagacacggcccctaggatactggacatgggctggatgctgtattcgagggataaaccatgtatggttcttgtgcttaaataagcaaaaacctggccgggcgcggtggctcacacctgtaatcccagcactttgggaggccaaggcgggtggattacgaggtcaggagatcgagaccatctaacttaacatggtgaaaccccgtttctactaaaaatacaaaaattagctgggcgtggtggcacatgcctataatcccggctactcgggaggctgaggcaggagaatcgcttgaacccgggaggtggaggttgcagtgagccgagattgcgccactgcactccagcctgggcaacaagagtgaaactccgcctcaaaaaacaaacaaaacactaccaccaaaaacctaactagccatagtcaagtagaagtatacaaatattccagaagaactaaactataaggtgtttgtaaatatttagatgtgaatgagtataaacaacgcatcaaaaaatcataaaaattgatatttggtaaattttcctttctgccagacttgctggcagttaaaatttgaaacagtgactgtaccgaaagcctttttattcaggttaaaagttgtactcccatttcctaaaataaggactgaactgagaaactctagctacagctacttggttttccatagagttaagttggctccttagatgctgaagtctgtagttatgaccttgctttcattagtaattagcacctgggcaggtactaaccaatgaatgccctttacacctggcaagaaggaatgggtggggaggccagattgtttcaatctaaagggcactacgttgtggtgggttacgttttttggtagacagacactgcctacaggcaactaagtcattccattaactgtcattatcaatccatgtgtggccaagcttgaattgtcctgctggtttagcttcctgatggggaacaacagctgtcgcaacgcacagtgtctgcagctccatcatgggccccaggacgtcccacagcagctaacactggtctgtactcggaactctgccacctggccagtgacttttgtgcgtcatgttcctgggaatagtatgactgtccatgattcctaggaaagctagaggaataactgaggatgaggagctagcactttgacccctgtggggagtgctggttatagtggttatcagggttgtgacaagtggactcttgtgagttccaacactggatgattttattattcctattactcaggcagtaaaagactagtacatatcctggtgttatataattatatgaaaacttatcagaatgagttttataactagcgtacccatgtttttgttattgtgctgcagataaaatggcgcactgaaatgttactgaattatgtgacaatttttgttacaattctgtgcactttttacaagatttgtggagcttagatagatggctggcctttggcatctgaacattttcctgagcccgatagacaagcagattttttttgtttgtttttggagacagggttctcatgcctgtaatcccagcaccctgcctagttcaagaccagcctggctggcaacatggtgaaaccccgtctctaccaaaaatacaaaagttagctgggcatggtgatgcacgcctgtaatcccagatactctggagactgaggcaggagaatcgcttgaacccgggaggtggaggctacagtgagccgagattgtgccactgcactccagccttgacagagcgagaccctgtctcaaaaaaaattaaaaagacagggttctgttacccagtgtggtggcgcaagcatggctcactgcaggctcgacctcctaggcccaagtgatcttcccacattggccttccaaagtgctagggttacaggagtgagccactgtgcctggccaagatttctttgcctttgcgctcatgttcttctttaaccttaaaagaagaggtcatataaaataatcaggtataatttaagatacagaaagcttgatagaaaggagtagccgtgttctacatcttcatccattgcatttgcagatatgcctcaggattattttattagtacaatttttttttctttttgagacagtctcactctgtcacccaggctggagtgcagtggtgcaatctcggcacactgcagcctccacctcccaggttcaagcgattgtcctgccttattccctggtgtatctgggattaccaatgtgcaccaccacacccggctaatattttgtatttttagtggagatggggtttcgccatgttggccaggctggtctcgaactgctggtctcaagtgatccacctgcctcagcctcccaaagtggtaggattataggcatgagccaccgtgcccagcctagcgtcatgtatttatactgttatttccacctcctaaaagtcaacaaggacacttagctcaagaaggctgatgttgagagagaacgcttatcagaacagggatctctgaggaaaaagggagcttaaatgtgtgtccctggaatttcttctagcccttcctttccttggtgacatggccactgctatgggcgggaattagagaagagccctgaccagtggtgttgatgtctttgccaagtatactgtcaggtcagtgtcataaattgatgatatatatagagagacttcatttaatagaaaataatattttaaggaccaccttgctattttacttctctaataatgttttgaatattttgataaatacctttagcaacatagtggttctcatctcagccctctctgtccttgaaagaatgttatttataacagggtggtttctggactgcccttctggagtaaaacttgggcattctaaccatatgcttgctggaaaccataataatgtaaaaagtcgtcattgggttttcaattgcaattacattgatataattttgtatataaaacagtctgttactgggagcagcattgttcatgtaagaaagatgttcgcttcatataatacatggaaacaaagttatattttcaatgttagccattactgtgacactccaaaaaaggctggtgatggggagaaagaagagctttaaaaaaacctacagacaattcacttgcctctcgggcttttctgctttgcctgccttgaccgaattagagtatctgcatttctgcactaagctggttgaggtttgctaagtcaatggtaatgttttacagagcttggctgttagccagcatttgtggaaaacgaccaatgtctgtcatagctagtgctataatttattcagttggcatattgtttatggagacagtgagataaggggattaggatccagagagactattaaaatatgtgagtccatctgttgtgatctgaggtttcattagagaaaacctgtctgctagtacaacaaatggagacttagtaaggatgtttttatataaaggattataaatcagcagaggtaaatacattaatcttggccaaacaggtcatgtccttttgcgttttcctgatggcaggttctgccccctgccgcccgggcactgttggtcatagcgtgaccttggcatcagctgtgagccggtaaacatggaaatgtaggcccctcccaacctgagtcagacccttagcctggggtccaggaaactgttttaacaagcccctgggtgattttttttcacatgttcaagtttgagcgcctcgagggcctgtgaatggctgcatataaggtacagctggccatatgtcttaaatgacttcaaaggggtgtgagccaggcctcttcccacaccagacttcatgaaccatgcctggtattgtcatgtttttgtgagcagccgtgaatagggctgggggagagagatgttcagccaagaaagtctaaaatagaaagggaatgttcagttataacaaaacaaatttttgtaattagagtgctgggttgtgctcagcatcattggagttaaatgtggagcagtggcttacacttgtaatcccagcactttgagaaactgaggtgggcggatcccttgaggtcaggagttcgaggccaccctgggcaacatggtgaaactccatctctacaaaaaatagaaaaattagccggctgtggtggcaggtgcctgtggtcccagctaaggaggctaaggtgggagaatctcttgaaccctggaggcagaggttgcagtgagctgagatcacgccactgcactccagcctgggcaacagagcgagagaccctttctcaaaaaaaaaaaaaaaaaaaaaaaaagcggagcagcaaactaagtcccttttccatcgagggaggtctctgaagcagagctgagccagcctctcagctctgccctggtggggcaccccatagcgcccagaagcagtgagggctaaggcggcagagtgcagcatggccatgcatgattggagcgccgctactgtgttggtgtcagtttggcagccagcaacttctaagaacatagaatattttcatttagaacttaaaaacagtaaacccaaaaagtttagtttttaaaaattcattttgtttctccctaaagatttttattcttttgaaaatgaccacagtctagtttgaatgccattgtttttcagctgtttcttatttgcaattgctaaaagcaacaaggagcaagttaaatgtccatcacctgaatgggtagacagaagtgacagccacacaatggaatattcctgggcagtaaaaaaagaatgaagtgctggtacatgctacaacatgaataacccttttaaacattatgctaagtcatgggattcagtcatgaaagactgcatattacaaaattctgtctctctgaaatgtccagaataggccattccttagagacagaaagtagattggtggtttccaggggctgagggatcaggaggaatgcagagtgactgccagtggccatggagtttctttttgggctgacaaactattccaaaactagatagcagtgtcagttgcataactctgaatatactaaaaaccactgaattatacattttccatgggtaaattttatggtaagttacatttcaatagctgctatttaaagtacatagtgactcaacatgaaaggaaaaatatacagttttgtctctataattacccaattaagtgaaccaaaatagctgcaaagtttttaattcatttatcattggttgtaagaattttccctatcatactcccatttgtgggagaaaatttactgtatctactttctatcagagcatttctaagtatttgaaaggtcttatccaaatatttgaaagctgttaaaagttgctgaagtggcaccttcggaagaaggctggaatgttggaaaacagcgttgacattttaaatgatatggaaggtcaagctcgcaatgtaatcttggtggtggctggatggctctactcagactggtttttgagtaaatggcaggtgtgataatatagggattaatctgttaaccactgaatccactgcctgaaattcagacattcaaatgctcccatttgaatttccctttcttattttacatggttttcctgatttttgagtacataaaaaaattattgcaaacttttttcctgcagtgttctggccactgaaattaaatctggttcttttgtctaagactcaagggttgctctcctgtaatgtttgtggaggaactgatcttggacttttccctcctgtcttgggcttttattacagtttgaatttatgctgtaaaaagtgtgattgtagaggtaacctataagtttaaaatattcagaggaaatggatgcttcccaaaggaaaaattgcatacctatatttatttaccaaaatgaggaaaatacctgggaaataatttggccaaatattcagcaattatattcatagattagaagcaaaatacaaaatttgattgtcaacttggtacctttttcattccttacactcttagaaggcattttaagatgccattttgataaaattaaactgggaagactcagaaatcatgttttcccaactatattctgaaaaatcctagttccctgggatgctccgtggaaataacctgtgggcagaacaatctgtgaagtggagactgtggccccgtcttggactgccactgttggcatcaacatggcagacaggcaacagcctttcagctaaagaaggaagaaacagaaaaccccaccttaaccactgcagagttacgtgacctccaaacactgcccccacagcatatccccatttttgtccctttccctttcaaagccaaataatttcaaagaggactacatagctgctggcttgggatggtgtcaaaagccaggcaagatgattttaagtcatagaatgatcgagctggaagatgctcacagattaaatggtctccagccactcaatatcagcagcaagggagaggaacagggttggcctgagtgaggctggggccacccctgccgccaggcctgtgtgccaggctcaggtgctccagggaatgagcaaagaggatgttgggtttattttgttttaataaggcgaattgttactgagtttatttaaaaataaagcagcttggggtttaacaccttgcatgtcggttgcattggagtggtaacacctgtgctgtcgtgtgtctgcctggaggggtactttccttcttgggaaagtgaacacaggtgtgttgtcccttctccgtgaaaacactctacttgctggccttgaatagcattctagtgggttacttttctcctagtggtcagagagtatttattggacctctggttccattggcatgtgtcccctaaggagggagacccttcagggggtacttacacctctactgtccgatggcactggctgtgtcacacctggcctgtgggctttgaacctagcatttcagagtgggaaaaggcctcaagccatctagtccaaactctacctgcagatcaggtagaggcccagtggcaggaagtcatcagctaggggtcctcagattacagagctagctctcaaacccaggccctctgtctcccgtctcttgccttccagtgattcccaaatttggcctcctcaaaatcacttgtggaagtgacagcttcctgggctgcgggtgtttgaaaagcttctgtggggattctgatggtgaggctgatgtgggaagcactgtggtgtgtgatcactgaggcacacccatcttcattaatgtgtaagccactcggggataggaagggctaatgcctctctgtactcacagtgcccatcgaggtgcctggcacaccttgcagtagttaattggtatttgtggatcgaatgaacatgttaggtgcccactagcaggggttggtcctgtagtctgtggccatggaacattagaagaataaagctattgtggttcatcctgtagtatagtaagttcgagctgagctaacctgtaataacacaaatacaatttttttttttacgtttttaaaagttagagatgggttcttgctatgttgcccagggtagtctcaaactcctcgccttgagatcctcctgccttggctccccaaagtcctgcgattacaggcctgagccattatatttggccaacaaatagaattatttatttatttatttatttattttttgcgatggagtctcaccctgtcacctaggctggagtgcagtggcgtgatcttggctcattgcaacctccgcctcccaggttcaagcgattctctctcctcagcctcctgagtagctgggattacaggtgtgtgccaccacatttggctaatttttatatttttagtagagatggggttttaccatgttggccagcgctggtcttgaactcctgacatcaagtgatctgcctgccttggccccccagagtgctgtgattacaggtgtgagccactgcgcctggcctagacttttttaaagagtagattattaagcaaagggagagtataaacagtattggtttttcattagcttcatctgtaccgtcaaccacatggttctttttgtcttggtagtggtacaggagtaaagttaaacttaaatcaccaccaacacccccaagctaagcataacttttaaaagtttttaatattttggcaagcctgggagaaatattgcccttttttgggtagatcttggatgactaactgcttactatacacacacctgtactacacgtgattgcgttgccttcactgaacaccgtttttgataactgtgtaatctgaggggaattactaagacaataaaaactgcagaccacgcgctctttttctccagtctgcacatagtttggatatgtgtggtggtgtgtttaagcccatggacttgagttttttatgggacaatccttgtgtgtatcagaatcatacagtcccagtaccatcttattcctctggcattattgaagatacaagaaccagttggcattcaaatatgttgagttcactaaaaacagttgctgatgagggaaacctaacaccctgataataaaatggaaagttgggatttagatgtgttttctcaattgccaaagcctggtggtggtggtgctggtgctggtgctggtggtagtgctggtggtggttgtggtggttttgagtcttcgctgtatcacccaggctggagtgcagtggcgcgatcttgctcactgcaagctccgcctcccaggttcaagcaattctcctgcctcagcctcccaagaagctgggactatgtatgggcacgtggtaccacgcccggctaatttttgtatttttagtagagacggggcttcactgtgttggccaggccggtctcgaacgcctgacctctagtgagccacccaccttggcctcccaaagtgctgggattacaggcgtgaaccactgcatgtggccccaaagtctgttttttttccccaagcccttggataagtagacaaagtatgtatgtaaatggtcctgtcatctcagtgaatgtctcattttaaattttggtgaaagcttatgctgtattgtagcacattattttatctataacattgaaaataattggcctttctaaacatggaactgtttatcatgcagtagggtaaggcagtgccatgctgtggtacttaatctggggaggatctcctcccttttccccatagagcatttggaaatgtgtgtgtggatggggttgcttttagatgttccagtgactggggacactcagtcattggatggcttaaggatgctaaacgttcctgagtgcttgggatagtcttgcagaatgaatacttgtgctgtccagaatgacaagagcacccccagtgggaaacactagtagggtaatgactaatcaagtaacagacatgccctttaacttaaagcagctcattaacatagtattcatttacctgtttagattttgagtatcttctcttcaatctctatgtaaagatacagattgtagagcctgccctatgtatgaatatatatatatattaaaactgtgattctaagaaggggttcttaaggttctggtgtgtccccaaatcagaactggaaattattccttttaacagggccaatggattcctattgctggtcctagttttattactgcagtgccagaacaactccctgatcatcatttttatttttttaaaagaggatctcactctttcattcaggctggagtgcagtggctcgatcatagctcactgcactccagcctgaatgattttttgtagagagatggggtcttgacttgttgcccaggctggtctcaaattcctggactcaagtgatctgcctgccttggtttcccacagtgctgggattacaggcatgagccaatgggcctggcctccctgatctttagacttgcaataattgtttgaggttgcgtaccatagggaatgattgcccatgggtgttggagcataggtaaaaaattttgtggaatgatcggaccagctaagagttggcattgtgttggagctgctggtgctcagatgaagtccttttgttaggaggtgtagatttgttgactcatgcagaacttctcagtagcttacttttttttttttttgagatggagtcttgccctgttgcccaggctggagtgcagtggcccgatcttggctcactgcaagctccacctcccgggttgatgccattctcctgcctcagcctcccgagtagctgtgactacaggcgcccgcacacctggataatcttttctatttttagtagagatggggtttcatcgtgttagccaggatgatctccatctcctgacctcgtgatctgccctcctcggcctcccaaagtgctgggattacgtgagccactgtgcccagccaatttttaagttcactttctacacgctactgggttgttaaaaccaacctcagtaaaagtatccgttttacaagttacttgctttttcaggccaggcacagtcaggagtttgagaccagcctggccaacatggtgaaaccctgtctctactaaaattacaaaatttagctgggtgtagtggctggcatctgtaatcccagctgcttgggaggccgaggcaggagaatcgtttgaacccaggaggcagaggttgcagtgctgagatgatgccactgcactccaacctgggcgacagaggagactccatctcaaaaaaagaaaacaagttaattgctttttaaaagggttgtgtgaactttcagtcagatatgaaactgtttcagaaccaaaaataagttattctaaattcctgctagtcagtttgcaaaatgcttaatatctttttaatgttaattattagctttggtttcaggagatgtcattttcacactgtcttcaaacttagaagagactcaggtttagaatttggagtctgggccgggcgcggtggctcacgcctgtaatcccagcactttgggaggccgaggcaggcagatgacaagatcaggagattgagaccatcctggctaacacggtgaaaccctgtctctactaaaaatacaaaaaattagctgggtgttgtggcgggcacctgtagtcccagctactcgggaggctaaggcaggagaatggcaggaacctgggaggcggagcttgcagtgagccaagatcacaccactgcactccagcctgggcgacagagaaagactctgtctcaaaaaaaaaaaaaaaaaaaatggagtctgaaatctcgtgtgcatggactctggtcatttgtctttgtcctaaccagacagtggccttcagttctaattgtacttggggttcccacttctgaaccagtagatagcagagaaagaaaggtggcatatccagggttctgcatttgtgagcaaacgcccctccactttagttttagtgtgttatgtcattgttggcttctgtgtatgtagctggagctgcatttgttattgagatatttgacttggggctggttttcccatctctaatacatgcccttggaaccataattgagagaaatgcgtgcttttattttatgcttcataacagccattttgtgattttaaaaaaattaccagcaggaaatgaaagaaaagtaggtttttatattttagtatgattaaagactttaaaacatgtctcgttgcctcctagtaaacttgagttctttaacttctggacttggggattgtggagaaaacttttgaaacaagatctggaaaacgatacttctgtacttgttgtaccagtcggggagcctttaagggcatattggatgcatgttagaggatctctcagtcatagtcttaaatgttattgggacggggtgggagcggctggggagactaattatgttcctgaagtaggaagtgacatttggtgagtgcttaatatttctggttccctggctggataacgaaacctctgtcgccatatactggcacaggtaatacgtccttattacatttacacctgtgttaggaagaatccgggataggtatctctccagcttctgtatatttcacttgaaaaatggtgagaagcaagcatttcttaatattaagcattatagttgctatgtggctctgctgttttctttgggacagtgacataaagtagccagatttgagtgtttttcatacactttagtaaatctgggttttctcaagtgataaatttgaaaactgccttgatgtaagtgggttgttttgttgttgtggtggtgggttttttttgtttgtttgttttgagatggagtcttgctccggagccgaggctggaatgcagtggcacaatcttggctcactgcaacctccgcctcctgggttcaagcgattctcctgcctcagcctcccaagtagctgggactacaggcgtgcgccactatgcccagctaattttgtatttttaatagagatagggcttcaccatgttagccaggctggtcttgaactcctgacctcaagtggtccacctgcctcggcctcccgaagtgctgggattacaggtgtgtgagccaatgcgcccgacagtgttttgtttttttaaaacaactacatggcaacattagaaatattttaaggccctcccatctccacctcctcaattctgtgtctcaccatcctcatactatttccatttttacattttattttcatgtcttgtctaaacagagttcacatttgcattgagtgttgcttgtcgtattttttatttcagaagcaatttgcccagtttctactattttcgtaattataatttaatatcactacataatccatttttgatgtgtctttggacatttcaccatttctctctcactatggtttctaaggttgcttcaaaccttctgattcaaagctctttctctcttcccttctctgacttccttggtgccttgggagccctcctgcctcccttggctgtcgtaaggctcatatgagatggtgcatggaaaaataggttaaagtattgttttaacaaaaaagaaaaaaactgcttaggttgggcagggtggcccatgcctataatctcagcactatgggaggctgagatgggaggcttgcttgagcctaggagctcaagaccagcctaggcaacatagtgagaccccgtctctacaaaaagtaaaaaacaaaacgagctaggcatggtggcacctatagtgccagctactcaagaggctgaggtgggaggcgttcgtgtgagcctgggagatcatgactagtgagctgtgatcgtgccactgcactccagcttgggtgacagagcaagagcctgtctcaaagaaaagagaaaaactgcttagacctaagtgtcagtgtgctttattaaagcaaagaagctgcgtttggtttgcactgtgtgcctcctgagacatccccagccatctgcagtcaggagtggtgtgtggcttcctgactagcacaggaactgatgtcaggcatatgccgtcgccacactgaggagcagcttatgtagaaggtgcaggaggttattagaagaaaagaatactcagttaagcgtaatttgtttcattctgtttttcagatcaatgtccgagttaccaccatggatgcagagctggagtttgcaatccagccaaatacaactggaaaacagctttttgatcaggttggtctctgaacttgagagttaactccacctacaaaaaaaaactgttttgcaacatttcagttattttgtttgcgaagcatattaccttgttttactcacttgaggtaatagatgagaaggatcttttaaaaggtgaaagtatttcatgatagcattataaaatgcattaacagacaagtatatcatgcctaggaagtgaggtgtatgaaagcacacagctgtctgttgtataaagtcaggcggattcagtgtgttaccaggcatggaagcaaaggactgaaaagagagttattgtgcttgtcattgtaaggaggtgctggcctgtgtgtctctcaccctgtattagagacgcggcttcctacccgcagctgcctccacctccagagtagaacccctctcactgcgtggatgagtgagccttagttgtctcagttgctgcagcttctcatttctaagtgatcgtacctgaacatctatgaaaggaagaaatgaagatttagagaaataattcactttttaaaattggaagatttttttaaatcaagtatttattagtgatattactacttacttattaaatacttttttccccaataacagctgcttcaaatacagcgttgttttttttttttttctttgagactgaatctcactctgttgccccggctggagtgcaatggtgcaatctcagctcactgcaacctctgtctcacaggttcaagcaattctcctgcatcagctccccgaatagttgggattacaggcacatgctaccacgccctgctaatttttgtatttttaatagagacagggtttcgccatgtttgccaggctagtctcgaactcctgaactcaagtgatccacccgtcttggcctcccaaagtgctgggattacaagtgtgagccaccacgctcagcttgcagccttcccccatcccttttgggtgagtgggaagagggggaagaacaggtcagtcctgggcatttaataaacagacttctagagctttagggagcctctggcctccctgcacccttcagatgaagaaacaggcccagatcaggagttaatttggaattttaggatttactttaagcaaatgctctgtatacctgagttgtcatttctaatgtattcaaccctctttggcattaaatatgatagaagccatgtatttgaaggatggtagcattttttaaagtttaacattatatatcatgggattttaaattagacatctatgtatatgtaaatagtcgaacttgtctgggactcggtttagatgatgttcaacaaatgtccacagcaagttcgactatcactgcttttctgtttacaagacagtcgtgagactaagcagctcaggactcctgtaatgcacaacagaggcttgaaaatgtgaaatctttgctgtgacctagggtcgggattctacctttgctgtatcagaatgtcccatttctggaggtctataagatgcaggttcctctgggcacccctgtgcattgacacccttccgtcccagaagtctgccttgcctgttttcctgcctttcctaggatttctttgtccctgttcctagtaagtcagacccctgggccagctggctgagaggcagaggcaggcagccagaggaggctcaggtgtggcactggatgctttagtcttctgcatgagcacacctgaccggcagcgatgcacccaccgcactgttccctggggggctgtgggctcccatggttctgtgtgtgctggccataacccgccctgctgagtttcatgcaggagagcatcctggagtacaaaggagtaggagtgagattttctaagatttgaaggtagaaccctgaatctgctcaaatttatattaaaaataagtcgttcatggctttgagataatagcctcagttagtaacaagttatttgagtgcaaaaaaagatgttgcccagtggttggactgagcagatgtcctggtttcctggggactctgctagaccatgtgatgaacgacagccaaaagctgttgcccttttgagtgagtttctcatgagtgttgagcctctctctctctcacgcaggtggtaaagactatcggcctccgggaagtgtggtactttggcctccactatgtggataataaaggatttcctacctggctgaagctggataagaaggcaagtcaggattaactatttacaggctgtggattgggtgttggtctgcttcatcgataaggaaactggagcaactcaccctgtcttttgttttctgttcctttttgtttgtgtaaaagtttttacagacaaaaaggttgcaggtttccagtaaatggagatatcgattggaaatcagatctggcatttctccatagtgctcactcattggagcatatgatggttaattgcatagcttttagttgaccttagttttttcaatgagattgttaatcttataaactgtgaatcatccaccatcttgtaagaacctgttattgctttgtttgaacctgtgacagattatcttccaactttaaagagtggataattccattaaccaaccaaaaagaaaagtagtaagataaacattttcttcaaactctgaaaattatccttttttttttttttgaaacccccactgtcctcccaagtcacagcaacaagttaaaaagatgatgggaggtggggaagagtggaggagcaggaggaattcttaacagtaagtttcggggtccagggcccgattggcatgtggccccattccaggtcactggggtcatttccaaatttgagttctccaggattgatagcatcatcccatgaggactggggcttagtgaggcagtagctttgatttccagctgagcacaagagtgtgatagtacttgtttgttttttgttgttgttgttttgagatggagtcttgctctgtcgcccaggctggggtgcagtggcacgatcttggctcactgcaacctccacctcctgggttcaagtgattctcctgcctcagcctcccaagtagctgggactacagctgcatgccatcatgcccggctaatttttttgtatttttagtagagatggggtttcaccatgttggtcaggctagtctcgaactcctgacctcgtggtccgcccacctcagcctcccaaagtgctgggattacagtcgtgagccaccatgcctggcctgtttttttgtttttgtttgtttgttgttgttttttaagaagagacagggtcttgctctgtcacccaggctggagtgcagtggcgccatcatagctcactgcagtctcgaactcctgagctccagggttcctcctgctcagcttcttgagtaactgggactataagcatgcatcaccatccccagctaacttttttttaaaaaatgttgtagagatgggatctcttctacgttgcccaggctggtcttaaactcctgggctcaagtgatcctcctgccttggcctcccaaagcactgggattataggcatgagccaccatgtctggcctgtggtagcacttttgactaacctttttttgtctggagtgctaaaaagatgactttaagaataaatatctcctgaaaactggcttgagggccccattgagtcttggttagaagcctgtgttggggacagtgggccttcgtcttccggatttgtgtggagagtgtggcttgtttcgtgcaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaaggtgagcacaggatgacccggcctgggcaggagcagtcatgccgtcctcggcagggagaagtgattgccttagaagcacagtttaaaaacacaaggacttcgccagtgtcaagtgctccttcatgctagtcattaagtcactgaccagcgacctgaaacatagccagggaaggcgagctgccattcctcatggaaactaaagcgtggccgtgtcctgtgggacatggcatagcaaacttctcgacctgactgctcagctcctcctggggtatgataggttgcccctgtgaaatctgtttttatttagtaatggtcacaaaaattaccccatttggaagaagaggccacttaaaatacctcttagtttttccagcagaactgagttcttgttcaaaatgctaagtcttccagattaactgtcataaatagaaatgctgcacatcaggaaatagaaaccaaagctctttgggattgattgatttgaatggaaagtaagggtttgaatgtgggtggtaagtgggcctccttccttgcctgtcacattccttaaggatgacagtgctgtttccttttgcattccagagtgatggaccagcacaaacttaccagggaccagtgggaggaccggatccaggtgtggcatgcggaacaccgtgggatgctcaagtgagtgctgtgccctgctgttgggatcttgccatctccgtgcgctccagcatgtcttttcctgtgactctagttagtgctttaaagggctctgtgtcaggccttgtgaagaccttgagggaaccgagttaaaagtggggttttcttagggaagaggttttttttaaacaaagccaggtgtcttgcctggggaaagaagcagtttagctcaagccttcaggttctaaaagcttacaccctccctttgtagaaagtgttgtgtctaaacttcatcttagtcagaggggcattgttcacctgcaatcagcattattctgtcaaagagatgctggtttgctcattatatgaaggtacttgtcttacaaagtgtatataaatgaaaaaggatcccaagtgagaaatgctgatgtcagagaacctggacgtggggctgttaatgtaagacatggccgagccacctgattctgggtgttctcgtcctagagccttgtctctggcctagtcttgcgagtctgcattatttcagcctctgaagtttgtttgaggtttgagcctcagattttgtgcttcagggtttcctgtctggcccaaacatcctttatggaaggaaaacaactcaaagcctatgaggagggttgtgggaagacatgtgtgggcaagagaaaaaggaggattgtgctgagtgataaaacttaaaaacctgttagagaaaccagtgtgaatcagttcttcttcaaagtgtggggtttggtggtgaggctccagggcagcacggaccccaccccaggcatagcttctgggctgtatgggtcccctcctcaccggtcggctgcccggcccctgcctgcctgcacgcagcacacagcattgagcccatcctacacaaggcgccttaatttaaaaatactggaaaggttttactgttctagatattgagtgctaccagtgactctgcctgtttcactctccccaattagagataatgctatgttggaatacctgaagattgctcaggacctggaaatgtatggaatcaactatttcgagataaaaaacaagaaaggaacagacctttggcttggagttgatgcccttggactgaatatttatgagaaagatgataagtgagttgaagttcacagttatcttcagtaggtagggtggtgggcctggaaacaatggcaaaatggcaaatttgtgggttatttttgaagtatttatttagcaacttactatcccaaagtaggaaactttttaaagggcttttggactgctgtggccctctcaaagggtggtccagaggtgtgggttatcctctctcatggtgggcggggccgatagtgggctcagtcctggtagaggaaggcagaatagagcagaggctgcctctcctccccgctgcctctgagattccaccccagctgcctgcaggtaccagcacatccatccatagctacttcgcaggcagcccagccagtgctcgactcctggctcgaggtttgtgctaatccaaccaagaatattgatggtgtgatgagagacttgaaaagctgtaaacaatagcctgtacgtgtagacacttgagctaaatgctgggagtctgcaggagatatcttaattgcctcgcattagttacgttgtttgttgagtgagggcctgtaagcaagctgggtagagcagcagagccaggcctctccacagggacaggcagttccgctttcacatacagggcatttgccttctttctgctgaggataaacagggaaagtcatcctagttcatgagggcaagtttcccatggtgagtctgcgacatcagcataatcctagattctggattgatctgatcagaagctacctgaatttaagaggcagaaggaaactacctctggaaagagaagggagaggctcctgactgcctcctgactaccgtctctgccctgattgtccacagtcagcctgattgctctgcagggctccccgaaacaaatcatctgatggccaccaggttcaggggcctggcagagaaggtgccagggcaagaatgctcctggggtctttttgccaagccctgccttttggcctgggttcctgctttccacgtaaagagcagagtggcccagagttcctggatgtaccggtttccttcccagcctcatgctgttccttgaaatgacagctctccccatttcccacttgaggctcacccatctcatctgttctcagatatttttgttctcagcatccccacatctcaggttcccccaaaaccctctctggagttctcaaagggagtggtgctgctttccacaaatgacctgcatgagtccatctccatttgcaaccacgcggattcctgccagaccccagggcacagatctatttcacttgggcaagtcagggacctgtgccagctgtgcccaacctcctctcacctccggggcccacgtggtgatactgcacagggagggaggcaggcgctgtcacaggagctcctcagagaacctggaaatgagatattgaggactctcggttcgctcctactccaagtgtgctggatgcagcattggtaaagaagcacggaaaagccaggcacagcggctcacacctggaatcccagcactctgggaggccgaggcaggcgaatcccttgagctcaggagtcttgcccagcctggggaacatggcgaaaccccgtctctaccaaaatttaaaaaattagctggctatggtggtgcacgcctgtggtctcagtcaggtggctgaggtgggaggatcacttgagcctgggaggcagaggttgtagtaagccaagattgcgccactgcactctagcctgggtgacagagcgagaccgtgtctcaaaaaaaattttaaagaagtggggaaagtgggtacttggaaccaggacaccatctttccgggagaccctagagctgaagccgtggctattaagacagccatgccaaggagcagtgcacaaagtcctcgtgggaacgtatgtgggaaactgcctctgccttggaaatctcttcaatgaccagattttgtaacgtggccaggccagggctgtccaaacaggtttttcaacctgcaggaaaacagccatgggcaggaacttgctgatgtcagcttgtaactgccccagcccacgtaagtgtccatttcttccaagtaaaaacgtgagctgtgtgccctatttagtgctgtttttgcgctctgctccccctcccccaccattgagcgatgaacgtggcaactctctcagatggttctttccccacagagcatgctggggtgttgggcaggctcactttctgcctctcttctccccattcctgaaggcacacccctctcttcatgaaaaaagcatttatgtagatattcagtcatttaataggcccaaattctttcccttttgaacaaatattgacaacttggtagcagcataagcaggagactgtcctgaagtctgaggagtgctgagaactcgccagctgttgcgctgttacctctctcggtagaactaggagaattagatatgcctgaaacattgttcaggtgagaaagctgatctattgaatatggaaattgagctctaagagatttatactctgcaagtaaagtctctattaaaacacctgttttagtattaaatagggtctggctgggaaatctgtctcttggggttcccttttcattgtacacataagcattaagtgggagcatgtaggactatttgtcatctttctttaaacccttagcttggaataggtgggagtataaagagggcaaaaacaggtaagcgccctcctgacaggcattgtaagcttgtgaacagaggaagttcagtttagctgggttacaatttgaaacctgacactcggaccaaaaacaaaaactaacaaaaactagaggaacctgatctttagtcctgtaaaagcactttttctcccttagcttcatccctctttgggcagatttcatcatagaagtccttctgtaggtaggagtttctggaaatgcactaggtccagggcttccaccttaaagggaaagggtgcacggggagcttggggactgaaacaggagccacagaacatgtctcttctttaaattccttgcggataggtactcagggcttcgcttgctttctcacgtctctttccgtatgcactccactgtcaccctctggccctctaacacatttccaagaaaactgcaggcatccatatccttcctcaaaatgaaagtgcatatgatatactagaggttggttatgttttgttcttttgatgtaaaatttaaatacaatgaaatgtaatcttaagtgttcatttgttgagttctgacaaatatgcctgaaaaatgcaaaatcttaagacatgtagaacattatcacactcagctacatattttggatttacattttttaatcattcttggttttttttttttttttgatatggaatctcactgtgtcacccagggtggagtgcaatggcacattctcagctcactgtaacctctgcctcctgggttcaagcggttctcctgcctcagcctcccgagtagccaggattacaggcacatgccaccactcctggctaatttttgtatttttagtagagatggggtttcactgtgttggccaggctggtctcaaactcctgacctcaaatgatctgcccaccttggcttcccaaagtgctgggatacaggtgtaagccaccatgcctggcccattcttgcattttaaagtcatttcaggctgggcatggtggctcatacctgtaatcccagcactttgggaggctaaaacaggtagatcccttgagctcaggagttcaagaccagcctgggctggtctttgccaacatggcaaaaccccgtctccaccaaaagtacaaaaaattagctgggcgtggtggtgcatgcctgtggtcctagctacttgggaggctgaggtgggaggatcacttgagcccgggaggcggaggctgcagtgagccaagattgtgccactgcactctagcctgggtgacagagtaagaccccatctcaatttaaaatatatatattatttcaaactttaaaaagattctaaaaatagtacaaataattcccatatacccttcacttagcttcctcaaacattaacaccttatgtaaccgtagtccaaataccaagataagaaaattaacattagcagtctctagacctcattcccattttaatcagttgtctcactgatgtcctatttctgccccgggaccctctctggagccacacagttagttgtcagacctccctgtctccttcgatgtgggatagttccagtctttttttgtcatgaccttggtatttttgaagagtactggccattgactttggaaagcccttcagcttggattgtctggtgttttctcattatttggagttttacatttttggtaagaataaagtgctgttttgcccttccaggacctctttcaaggtggcacatgtggtcggtatatcttatcttaggtggtgctaattttgattattagttaaggtggtgtctgccacgtttctccactgtaaaatcactatccttccctttacaattggtcagtatatttgggggagataattttaaactatgtagatgtcctagttctagctaccattgatgagattactgtggtatttgagaaattgtgatttttaaaaactttttacgtgtattaattggaattctataaggagccaatttctgttctccatttattcagttatattaatatggactcatggatatgtgtttcggtctttgggttatgatctatgagtatgtatcttcttgctcaggttgtttgagatttggcctttaggagcaccttgaagtgtgagccctgcattctttgcaggcttccttgctgcctggctcctcgagatgcaccaggttcatcctttgtgttccctgttctagtcctggaatcagccatttctccaaaggcctctgtctggtccctgttattggagaatcacgcttttttaatgtgtggcctaagcaaggacacttataaaccctgtggccaccttctctgtagaccctgttcatgtcctatatgtgatctcttaggaaaaaggaaatccttgggctttaattttccaactttggtcaagaattaaaagttctttaactcaaaagtgagtcataattttcatgtttaacctttttgttttgatactgcagttatgcttatgagtggctatgaattgttatatgaggtttcaaagtcctaagaggaaaaactttctaggcacaccagagagccggaggcctaaattttctaaggtcagaacctgttttgagagtcctgtgtagagacaggagccggagaggggatcccagccccttgaagtttcaggatgcggcacgctggctcacagtgctatgtgctgtgggcggagcctccggagcttggatcctagcttctctgttggtgccagcaggctgctcttgtgttttgggagaaagtgctccagaagcaacacatgcctacctggtgccactttcacagcctttcaatgtaaggaggacataggctgaagtcagtagcagggcaaggtggtatctggagttcccctttaatgctctgaaacctgtaaagaaaattacatctcgaagataaaagaacaaactcattgcatgtctgtttgaatgccaggtgtgtttttttttaatggggattggtgattctagagcatagcactgtaaaagaaaggatgtatacaaaagctttgacatttagaaccatggtctggccagtgtcctgccatcattcctgcaggcacaccatgactgactgcgctaattccccagaagggccatgtcaggcttacatgtttgccctcagcctacagagtccaccccactgccttgatctagttgatgtgatcataacgaaacctgtattgctcatcagtattgaagctgttggtaggccatagattgcttgaccttcctgctacttctaaaatgaaggtttttgtgggatgttggaaaggactgctttggagggcagcattgttggatggtggttttgaggatttgtcgttatttccagaatggcattatccctggtaaaatgtgttggaagaatagggtgggaagtgtcaggtgagcagagcaatgtggtcttgaagtcacatgatgaacttgggaatgctaataaaagccagagtctggccagtcatggcattgcattggttaagtaggattagccctgtggggccttcattagggcggttagtttgaaggctgtcctggaagttggagagtgacatgggaagatgtctgtccagccaggagaacacacactggaatgagaaccagaggagcagaatgcatagcaaggcctctgtccgtttctcttggcaagctctgttgagtatggcacgtctaggaacgtgatgggatcttggccctccctgttggtttcatagaactaaatgatcagtaacttaaataacattcaacagtctgtagcagaagagcctgtatgttaagagaggcctcaagggaaagggaggcagccctggggaactgtgtgttgaaaggtgggtctgaaccgtggagtttggggctggatttgacagctcttggatgctgagttaaggactgtgttgacatgggaggagaggaaattaatcagatcagcagactgaaagtagggctgctccagcacacagcttgagagtgggctctggcaggatgagaggtaggtgagtgtggtgatgtgatgtgggaatgaacagcagaagatacctgagggggagggtcaaggtacctgggtaggaatttcagttgacctcgagatcaccagcctgggtaatcataggtgccctagactgaggaaaaaccaaaggaaatgggaacagattaaggttgcagatgccttgcagccaaccacttggcttaacctaggacaggtgggaactatttgataatagcatataacacattgtgcctcttgggttagcttcatattattttaattgaactaataagaattgatttgcgaatctctcttagccaatccaagaacatatgtatacatctaaccatccacttcttctttttaacctcaggttaaccccaaagattggctttccttggagtgaaatcaggaacatctctttcaatgacaaaaagtttgtcattaaacccatcgacaagaaggcacctgtaagttccaaaggattctattcaggggctactgtttttcattcttatacttgtcagggtaacggacaagttatactgtgacgagtagccagtgatagtccaaactcctcatgaggttacattgagggccagagatcctgtgggccaggcaattgctgcaggggagaccacttaacttttcaaatgattctcattccttatgaagaaaagggcagttctgagccattggccaaatgataagcatttcccaaaatgctgtgtttttggtgtggagagccagcctgtccccttgaccacctgggtgcagggactctccccggcacctgacggacagtgggacctgcgagtctcaagggccagatttgcctttcagagctgtcctggaacttacccaagatagggacagtcagacttgcacccaagcattgctggtgcccaaggtttcatcggggcttcacccacttctgttgtcagaggtgtgcatcctcacacaggtgacactggcaggcagtcattttgggaggacatggtaagaaggcgacactttatgtcctgaaatctgatagtattgattgtaatagctgcaaagaccagtgcattatgtaaatttggttttatttattctgctgacatttaaacttttgttaactcagaatatttgagacatacgcacataactgtagcattgtagaatgggtaaggattttgttatctaatcagaaatctagttctctaaaaaattgccacctgaagaaattctgttaccaccttagagcctgttctgaattttacgaaaattatagattggaaaggactttgtgttctcatgtaattttggttccttagttacagtgttaagcttggagaggcaaacatgggctgtggtccataccttggttgtcttgttaacccttttgggactgggtactgcttagcaatggtaaatccacttagaacagtatgtggtgttattgtcctgttacttctccccacatacaggtttgtctagcataatttaaaatcagcaggtcttgacaattttgtgaaagtattttcttctttgttaaaaacgtcttggccaggctcagtggctcacgcctgtaatcccaggaccttgggaggctgagatggccgaatcacgaggtcaggagttcgagaccagcctggccaacacagtgaaaaccccatctctactaaaaatacaaaaattatctgggcgtggtggtgggcgcctgtaatctcagctgctcgggaggctgaggcaggagaatcgcttgaacccaggaagcagaggttgcagtgagctgagatcgccactgcactcaagcctgggtgacagagctagactccgtctcaaaaaaaaaaaaaaaaaagggctcctgctgtttgcaaactcttggctgctactctgtgggtagttgcacggttatttaaaattaaacgcgtattgaatgcagactctaaggctccatggcagcagttcatattatgcaacagcatgaatggagggtcatagcgtcttcatgtcacttgggtagtaagattggcacagtttagaagagcaagaaaatgctgaaatctcttcatcagtaggctactacgtactctgtgacgctactgccttttcagaacacttattaaaaatttgactagagcagcagctctggactagactgtttcagaatgtttgtgcgtgtgtgtgtgtgtgtgtgtgtgtgtgtgtgtgtgtgtgtgtttgatgataagtccatctcttgaaaagctgaagaatattttcataataagccccaagcagaagccattgtaacgcatctcgtgcatgtgcctttattatagagtagcctcatgtgaagccatctcgtaagcaaaagaaacattcgctggtggcacgctgtcccaggcactcttccagggctgtgtgcaccatcaacaaggcaaagctcctaccctggtgagcctacatttacgtgaaggaaagggttaaaaaggcaactgagatgcttcctggtagtaaatttaacagtacagctgtgattaaaaactaagccggatcagaagatgggggtgagattcctttaggcaggttgggcaggagccacactgaggaggcagcatttgccttgagtgggcactgctggtttgaggaggtggagttctgtcacccccacagcaccccagggctgctcgaggcactgccccacctcagtctgtaaactttgggcagaagaagttcaagttttcgacatcgaactttcttgtaaaaaagaagaggcccaaagtttgaggcggtgggattccttatcttgtgttgactttcacgggtcatcttcaccccaggcggtttctgctgtgaactcacaaatgagtctttgtccagttctcacccaacaactggcgtctcctttttaaaagccagcttctcttccctgccaaggtgcatacagcagtttggggccacactttggctctttagatgggaccttgtatacagctgacacggcctgcccaggtgacactatgaggggctgaggcggctgccttttccctttcaaaagggcgttttgttcctgtggccttgtggaaaaggcagaaggctctgaggcatctgaaatttggagaaagtaagcagcgtttccgctctgactcctcggacgcttcccccacgtgaccttcccaggagccccgctgcctttttgcctcccgcggctgcctcctgccatctctgcggccagatgagccttgggattggcctcttgtgggagagtttcctggcatcctggggacttgaaaaggggctcttttaccttctctccttctgtatttgtagggtcttgggtttatttttcttgaactttccttgtgcctggtttgcatttttaccttgctggtcctcggccagtttaaaaaccctgctccaggtcttgtcgtgttgtggttctgcatcaggaagctgcatcctgcatcaggttagggacttggatttagaaacatttcagtatgagtctttgttttaacttgaagtgagaaaccggcttccttcaaaggcactgggagagatttcctgccaggcaccatcctccctcacccactggcagtggactccccaaattctggttcccgttgctggcaggacctgtcttctgcagggaaagggagagagggagacattgttatgttaaccattgaggtttttcattgatccccccacccatgcacccccacaaccccataaaggggagttggtgctaatcagcgttttctgagtcagggcctatttggtagagtcctccaaagctgtaatgcaggattgtttcctcttgtgtaataagggataggtgggtcataaaaatgccgattgctcccagctccacagactcctccctgggaaacccaatgacttaacagcaagggtgtgaaaccccaaagacagccccacccaggaagttcatgggctctcagggcttggcatcacctctcaccctaggatttctggaacagatgaaaagactgaagctaaatagattcttctcggatgtgttgatgagcccgctcagccggttcctcgttaggtctcagaagttgctgtgggatatatcgcactgtttttttgttttagccaccctgtccctctgttccaaatggtcagaagctggatgctgggggccctgaggttaagaggaagccaacagagtcactgaaaaataacttttcatgggagtttctaaaccatattcttctgtcttgtaagctaatcacagcagtagcaaggagttgggaccaagattgtcagctgtgtcccaaatgtttccagtcatggtcacgagtttcccgaaggctgtgattctgccttgttttccaggaggctcctctggttgtggtcttgcaaggcactagcaattggagtgaccgctgtgtgtgtcagccagctcttcctgcgccgagcacctcctgaacgtcaccgataaggcggggacgccagcatctaatgggactgctgggaggattgagtcccatatctgaagtcccttgagataccggcatccctgccttatggttgaaggcactgagcctggtgaagggatgtgctcaaggctgtggagctcgcacgtggctgtctgtgctgcacgagctggcagtgcctggcaggtactgcacacctcaaataccctgggaagataagagatgagtgaatgtgtggcccctgcccttgggagctgatggcctcataggagtgagatgctgaaaggagtcactggagtgaagtgacagtgccactgcggcgagtacctgtagctggtgtggcaggagcagggctggatagctttgaggagagagaaccgagtgcacagcggaggctgggcccagagctggaaggtctctgtgtgggttgggcccaggccctggagctcatcctggagctcccaggctggcagtgatgggtcggggtggtgacccagtcagtgtagcaataacagtgtgggaggggaggctgtggcagaggagacaggaagcccaaatagcagcagaggcagtccaggcaagcatcggggatggggagcagcagtgaggctggagaggacatcatgaaaggtggctacctggaagagcaggcagctctgagacttgaaaggtttcccaaggctgagagttctcaccttggaaaagctttgcagttaacgtgcagtggcatttcagtgtgcatgcaggatgtccctacccacacacaactgcacacacacgcggcacctgcccttcctccacccgtcccagagaatgcactttcccagtgctacatacccacacataaccgcacacacacgcggcacgtgcccttcctccatctgtcctggagaatgcacattcctagtgccgagatgctgccatccctgttctgctacatttgttcttttagaaaagttctggacctttgtgaaggatggtttggagaagaaaaccaaacgaaggagcttgagtccaggtggccctgttctgttttgtaggactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggtgagcgcgtgaggccagagtggggggggcctgtgttctcccaactcagccactggcagccagtgcctgtcaggtgactgtggagctgatggggagagtgtggtggaatggaacccagtcaccacgctgggatcttcgaggcctttgtctctgggcggttgctgtggtgctgagcctgttgtcagccctggagcggctgctccgtcaggcagctcaggctggcagcaggctagggtggccctcaggataccaagtccatcctggagcttcaagtacccgtgaagtgtgttgacccctcactttcctgccagagtctaaatctccctgtgcctctttttccctgcaccaggcaacagctggaaacagagaagaaaaggagagaaaccgtggagagagagaaagagcagatgatgcgcgagaaggaggagttgatgctgcggctgcaggactatgaggagaagacaaagaaggcagagagaggtcaggcgccctggggctggcactctacactgggtcatgcatttccacagagtagcaggggccacacccacccacccactcaccaggaaggaaaccaagaacgtgtcccacagcgcagactcacagccgaaatgataaaatggttatttggtttggaaaacagttctgtacttatttaactttgatgctagttgttctaagactttgtattttaaaatttccctagtcttttgcggtaagtgctcaatcacccagtttccccgatgaggacagtaaggtttggtgcggtacagtgatttgcccacagtcccccagcccatgactgacagggccatgctgcactgccctcgacctctagactaaaacccaaaggcgtgttcagagccagacttcccagcacagctccagtcaacaaccccagcagctgggccgattacacaaggcgccacagatgctgtattcactggcagcccttacagcacacatgggaagggtgttctgtgttctgagtggagtgtggaccaccagcacagcgggcggctgacctggggagagtagcgccaagagggttgagtcaggcatgccagagagagggcgcctggctggcgttggacgggtttctagccatcttgaggaagttgtcatggatacagcagcaatgagctctgtgaagtgctttcctccagggtcactggaagacatcccctcaacctgtgacttggtctagggctctgtggctttgggggtgggaatggaaagcgagggctcctaggtccctgggctgagggtttgaatggctctggctttgtgtctttgcagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggtaggaatggcctgagtttcaagatgctgaattatagagaggctgcttctgaggatggaaaatgtgacacctgccttgtaataattgtcatgactggaagctgtaaactgatctgctggggggctgaaggcagctggtggggaaggggctgggctgttgccagggtcacccattgaaggtgggtgtgggcatccaggaagagatgccgggggtgcacaatggaccctgctggccatggagtgggggtggcggggactcaggtgtcacgttggagactgcttgccaacacacatgaacactcattcacaactggactccgttgaaaggatatcagaactgacgtgagcttggcattcccttcccaggctgcggagcttgcagaatacactgccaagattgccctcctggaagaggcgcggaggcgcaaggaggatgaagttgaagagtggcagcacagggtgagtctgcacgggggacacctccgcacggccacagcacctgttgcccaattgcctgcggtggggcccttctgcaggtgggtgggttgggggagaggtctggctcaagctgccacatcccactggaagcttctgggatgtctcatgatcctctgccaataccagctgtactactgaagtagacatccccaaagagatgggtttgactttgtacacgagtcagtgcagctgctggattcatagagggaggacctctgattgactttcacccactttgctccctccaccccgaactgttcagtgctgatctgacagcccccggtcaggaactggttttaaatctaattatatatgtgccccttgcaatggggtcgcagtgcctgaaacacgacctcctgcagctagtatatacagcgggcaccatggaaagatccagctccttggacgtctccaggctggagtgagagctgggctctgctgctcatcagctatttgggggctagtagcatcacttcttcaagcctcattttcctcattgtagaatgggggcaatacccaactcataaggttgctctgcagatgcgaggtcccatgcccaggacctagcacagaggtttagtcagctgtagctctcattgtgggacgcacacagagcttgtcgctccgtctgggatcccctgtgccctccaggaaggcacagcccctgagaagctctggggatggttcccactggagactgcacaccaggctttaagcagctcctctccttcacagacccgctggcccgtccttcccccactgtggcttctccatctgtggaggtgccttctggggacgtgtctcccggctctccagggctgctgctgcctagtacctccttgcctctgttccagcccccattcccgctgccgatctgtattaggctgttctcacaacggctataaagaacaagctgagactgggtagttaaagaaaagaggtttaattgactcacagtcccacatggctgggggaggcctcaggaaatttacaatcgtggcagaaggcgaaggggaagcaggcacctcttacatgagggcagaagagagaaaagcaaaggggggtaatgccaaacactgaaaccatcagctcttgctcagaacccacccactagcacgagaacagcataggggaaaccaccccgtaatccagtcacctcccaccaggtaatgccccccacccccagcatggggggattacaggtggagatgagatttgggtggggacacagccatatcaccatcccaagttgcaagcggaagactttggttcttaggtttttggagaaagtacctgttaagtgaggagagctggctacaaagcagatccacactaagctcaactctagggctggctgggatggaggcgggcgggactgggtgtgtgtgaagctgttggaaggactgcaagtggcgagcaggagagcacttgataatgactgtggcatgaagggaggctaggaacagagcccgttactcatgctaacaggattttttttctaaaaattatataatgtctagagttacaggtaaaaaaagaaatggtagttttaaaactgcccaggttccggcatcacagttcctcttcctgtcttggacgcagagggttgtaaaccccccatgcaccctgagggtgctcctcttcgaagccacagcccagcacagttcagtgctgccttagcctgccaggacagagggaggtgacagtctgttctcatagccaggaggataggacttctgggtgagaagtcctcttattaatttgctttccaaaggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctggtgaggcccaaggggctctgtctccagggagcctgcctcgcttttggagcagacaggcttggggagggcagtgatgtgagccagccccacccagcacccctcttgcccttcctgttttcctaggggacgggccgggccatatggggaggaagggactagaccaatgctgcttaatgttacagacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacg

SEQ ID NO: 37008 - DNA, 53622 bp, Homo sapiens; identical to SEQ ID NO: 37007

SEQ ID NO: 37009 - DNA, 19921 bp, Homo sapiens
tcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcggtgaggaccggacagggacgggggtggggccctcgggcagcccagcagcggaaccgttagccggagctgggcgagccggcgggcgcgcggccggtgggcaccgactccgcggcgcgcggccgcccatcccccccgtccccccctcactccctctcgcggggacccgcccggcaggcgcgcgcgcactgcctcccgcgccccctgtggaccccgcgcggccgcgcgcccctccccctgcggccgcgcgccgccgaccgcgtgtgcgacggggtcccctccccgccgaccggcctcgtgcgctcgggcccgcacgccgttgttcgcgtcacccccacccagctcccttccgcgtgtgctcggagggcgcggcgcaccgcctacgcaggccggagcggcttccccttccctcacgtgctctccgtccgcggcctgcgcacacacccatcctggggcccgcgccccgggcctgccctggagcgccccgcgcttcagactcacccacgtgtgcggcggcggcggcgactgcgtggccccgcacccgggcggtggagagaaagggctgtcaggtggccgcggcggccggcgtgcgagggaccggatgcccaagccgggcggatttggaaaaggatagctggtaatcgtggcttgttttgctttgttttcttttccagcaacgaaggttttgggaacagtaaaatggttcaatgtaaggaacggatatggtttcatcaacaggtgagctgccgggctctgaagcctccatcccaccttcttgcttgcttcctgctctgtcggcttctcggggcttgggaagccccaatccacagctctgttctgaaaggcgtttactacctctggtgtattagtatgattttttgttgttgttgttttccttgattagggattagtggatctagagaatgcctttgttttgcagctaaatattaatttgaagctaacttaaaaggcttcgtcacagtacaaagcaattcaaaaggcaagcggagtgaatgagccattccttaacagggtaaacgggaaactacggtccagtacatttttatccttgtcatctttttctactttattgaactcggtatttgagaatgtgatccactgacatcggatatttatacattgttaacgttttagggtaagaggatttgactatatgaggttttgtcatctttaccgagaggttgtattgcctttgtttcacgtttcattttaatacctgagataaattttgtcttagcacagctttgaccagagagaactgtttttatttgctcatccagtaaataatatatttacaagaaagtggttttttttccttcttccgttcttatttttcattcttccttgtcctagaatcataactggttaagtcgatttctgttagatccctggctgtagcttattagagtggccatagtcactggtaacttgacatttttcttcctgtttgaaggcaaagctgcagacacgtctttaggacttacccttcgggttgtttgtaggagtggtggtggtaacgtgcagtagacgcactgtattccatgggctcccttgtaagccgggcatcattttcaagatggctgccaaggctagtagtgctagttacatgggtgcagagcactgggtatgccagtagcaatcttggcctcacaggtatggtacttagtgccatctcagcattgtcttgcttgcttactgtagaagacctaagcagatgattaaaagaacaatgtggaatggacaacaaatgggcaaaatcaagcttaaggacagaatcattgcctgatgaaaaactgttcattaatcaatcatagagtattgtggaaacactcagagtaagagataagcatttggtgatctattctctacttttgcaattgtgggaaaatattttgtttcttccaaaatcttaggattttccatcttgttatatactgtttgctttcctggctggccgaaactacgtttttcattaattttttgataatggcttactagcaagaaggaagggaatgcttatatataattggcatactgatagctttttaactgatctctctgaactttctagtgttttagtttgtatttctgtcttactctgattatcgttactagtctaacccttaaaccagtggttttcaaatttaagtgtgcttaccttgggagggtgtgatgtaagtggtgagttcctccttctgagccttggattcattaggtctgggtacatttttaacaggaatgataatggtcttcgggccataccttcaaaatcactgcttttaacccttgacccaatgtaatggtaactctggtgtgcaaatttgcagccttttcagcggatagattgcaggttttgtatgtgttgaagaagttttagcatgtgccttgtttcgctgcattttttttaagtaggcataggttatgacattttttgaaatcaacagttttgtccagaataagagtaatatctttacattttttaagtatttagtccatgagatactgttcattgaatatctctattctgaattggaatcaactcaattggtcatcctccagggcaagttatgaattggcttttgatggtcctttgtttggactatcctaacctcaattattttgtcaaattaactggttaaaatgttctttatgcttctgaactggttttaatgattctgggacttttttaataagatgctgtaaaatctgactccaattaaatacagggaagatttgctttaattaaggaaaatgtatgtgataaaagaaatcactttggaagctagcagttggttctatatgtagttcgtgtagtggaacaaatagacttggctggaggcacctgtctcttatgagggagggagacagactgacacataacgtgctgttttctgtataaaggagagggtgcagtgttcgggatgactattgtgacgacttttaattggggtttttggatgcgctggattatatatgctaggattgtaaggaatttttataattacaatattgtatgtaaattttctgcctttaaagacataatttcattgtaaatgtgtttattccagcctgaattaccacctgatgaattgttacaaccttgttagaattaattcatgaaagggcttctccctgatggttatattgtgaagaaggtgctaagtaacatgagcatagagcttttaaaaatagcagaagttttggctttattttgttagactgtgtaatctagaaattctaagaaattcattgagttattcttttgtgaactgtgtctacaaaacataatcggagaatgtgactagaggggtttattagctccccccagattactgttgaattttgttagtggttgagtattgatccatattcaccaaagattaccatgaattggcaacagtttatagtgaccagaataggaatatttttctgtttccagagtacttaaaatgtttaaattaataattcttaatgttttgaggtgaaagaatttggagcagaggtcacaaatttgtgaccttctggctaaaactactcccagatgctttgattagacagtacagtattttttaaaggaattgggattaattactaacatttataattcaggagataacaccaagtaatccagattattatatttttaagatctgaactttagctggctttgggggcctgtatttccacataagtaaaaaccacctggccatattgtcaccacatttaggtggggtatactttttttacgacagccttcacgcctggcctctgtgtatgcatttgagtttattacccatggtctaggaagatgtaataaaccaagccagggaaaggtttggctatctctctttagtcacgcctatcaggtttagtctccctttggggtgggggctcccttgtggggattccatatgtacataactgataggtgacttccaacacatgttggtgaaaatagatacagctaacaagtatttatactagggtctatagtaagtgcttaaaatgagccaatttacttaatctttaaaaacctttgaggcgtaggtactgtcattctgaggcacaaaggagttgttacttgtccccataagcataggtgataagtggcaggattggaactgttttttgactctggagttagtgttcaccaactgctcttatgctgtctctgaaatagaccctagccattttcaatttggttgttgtccacatagttacagataatttcttagggtgattatttttagccgttgaaagactcttaaatgatccaagtatgtcactggggctcttgtctgctgacttgctaggtcctggatttgaaaagttttctgcctttcactatctactttgtgaagtttgggattgttaaaagttctagtttagcatgtaggtcagctatacaaataaaaggacttgcttaattcctgatactgggaggtgaagaattaaaggagagaatgttgcaccttatctcccttaatcttttttttttgtatggcctgcaaggtaagactgaatattgcctttttaaagggtgatttttcttgagatggagtttcactcttgtcacccaggctggagtgcaatggcacgatcttggctcactgcaactccgcctcccaggttcaagcgattctcctgcctcagcctcccgagtagctgggattacaggcgcccgccaccacacaggctaattttgtatttttagtggaaacagggtttctccatgttggccaggctggtctcaagctcctgacctcaggtgatccacccgcctaggcctcccaaagtgctgggattacaggtgtgagccactgcgcccggcctctaaagggtgatttttttttcttttttaaaggtggcggtgtaaagtacttactgtgtggttgttggttgtttgaagtggagtctctctgtgttgcccatatgggtcttgcactcctgggctcaagtgatcttccagcttcagcctcccaaatgtgtggttcttaatagaagtgtaaacctttggaaggatgtcattaccaaaaatctcttgggctgttaaagtcacactgatcttaacttgatcacagtagatccattgctaagccacataagtcatgggtagaccgtaacataactgacaaaatgttttggcactagggaaggtttaaagacttttctgcaggtgctgctaagggagagatgtcgaaggttccaaactggaaccctaaagacaaacatcaatgacatgtatgcaggagacattaggagagatttgtatgctggttatattaaccattgatcttaagctggcaagaagtcatccgtgttcaccaagtcactgatacgtgacttggagaatactagtaggtcccactccctgtgtcctcccaaagtacaatcctttactcttgaaatctaggatagagaactagtatccagtttgactcgtgaacaatgtgagtttgaaccacacaagtccacttacacacagattttttttgataaatatattggaaaaatgtttggagatttgcaacaacctgaaaacttcagatgaaccacatagccaagaagtatcccccaaaataaggaaaagttgagtatgttgtagatactagtctgttttattatttactaccataaaatgtacacaaatgcattagaaagttaatacagccatttgcagttgagaaatgtaaacaaacataaagattcaggcagcattaaatcataactgcacgacattcactgtagtaatattgtactattataatatgtagccactgcctattgctactgcagtgagccccttaaaatgccatgtgacgctaatcatcttcacatgaacagtttatctctccagtaaattgcatgtcagtaaaaagaacttgtagtacacaggtattgtggtttagtgcaatactgtaagtcttcaatagcaccatgggacccatgcaaagtggcgctagtgatgctgagaaaagtcatggcattgtaagaaaaagttcagttgctcgatatgtgctatagatgaggtctacagctggaattacctttcagacagatgtacacttaccgtatcgataagtgcagtactgtacatgtattttctcttacaactttcttagcattttcttttctgtagctttattgcaagaatacagtatataatacatataagacagaaaatgtgttaaggatttatgttaccagtaaggctttccagtcacgagtaagccattaaattttggaagagtcaaaagttacaggcagatttcaactgtgcagcaggttggcacctcaaacttctatccaccctcatagatactgagttattcaaggatacactgtattaccttcctgtccccctagtcctggggctgcagttgctgagtttgctaccctccagtcttagcccttggaaacatacagtttgtccgaaggcagaatcatagacaatatgtgggaaacagaagtgagtctgttgggtgtgaagggtgtttaatagagaagaaatacaaagataagtggacattattatcttacagtcatctacaaggcttggaaattggtatctggttgctttaggttatggagcatatagatggtaaatcctggagtttttataaccacaggattgtaaattagtgtatgcagttacgtgaattaaggtgttagactagtgtggtctggtgatctgcaacaaagtagtagtataagagcatttagttacggataaatttatgtataataagtcttatttaaggcaatactgtggattggcaaaaaagttttctaaaatttagcttattttttatgtagatatacagctaggataaagatagttatgttttaaaaggagtgggaggggggtcaaacatggtgaacatgctggagtagagtccgggagtttggatggattgggccatgaaaagcaaatgctagaattcctagttcctgtggcatggagaattatctggcaagctgtaattgtcttttgacttactaaaaagttttccagggaagttaaatttttttgcctttgttttcccattttgagttgcattttgtctatttttaagacccttaccaatctggataggccatagtataggagtggtagcaattagattttaatttagaaatctggctagtattagtgaatagtaaatgcccaataaatactaaaaagatttgagtacctaccttagtaatgtaagttattaagtgtttagtgtagtttttctcattttgcaggtaaaaaagccaatgaggcagctttcctaggttacacagctgttaatagttgagtcaagactaaaaatctagcagggcgtggtggtgcatacctgtaatcccagctactcatggctgaagtgcaagaacttgaaccccgaaggcagaggttgcagtgagccaagatcgctactgcactccagcctaggcaacaaagtgagactccatctcaaaaaaaaattgagtactgttatttctttttcttttctttttttttttttaagatctgcaaaggggtttaataatgcaaatatcacatatatttccatttttaacaccatatttaagttttccattttcttaacaatagaaagtgataaaaatgtttttcccaatgtaataatacaaatggaaaatattatagacagtcatacactaacccaatgaataagattcaccagaagcaaaatctattttgggggtcctatattgttacatatatacagggcaccagaaccacatttagactaatactttttatttctagttaaaacaatgcagggcactcctgtgacctgcaaatctaattgtacatatgtatgtgtcagactgtgcaggtggccaagaagaatagaaagaaagactttatccagctttggagttcagggcctgattgccccagctttagcccataggaacttgacagcttgttcatacctctcatctttagtcatagtttctctttctccaaccccttttctccctaactaccctgtgccatttagactggaaattctaacaggtagctttttctttctgaattatctttactactgtataatttttattttcagaatattccttatttctacatcttgaagacatttctttctagtagatgggggagctagagcttacattcactgccggaaaagggtcagttccagtgttaatttcccagcaaacacctgagagaaaaactgaacagaaaagaatagtgatggctggcagagagtgacacctgcacccagaaagctgcactgcagctgtctaatatttgagggtctcttttgttataactgccagtttaaactagagattctggctggttgcaaattcaaagcagatcaatacatttaaatcactggttcaacaaatcactctttttaatggtataatgtttttattgcaattgaggacgttttcagtaaataccttgagcttgaggccctggctaagtattccttttgcaatactgtttttactgtcatgacactggtcagtgaactgtgttagtttcacatatctatctatgtacccacaaaacacctccctgtctttgcaggagtgacattaccctgtgtgtaatggcagccttgtgctttctctgtgcagagacagggtcttgctctgttgcgcaggatggagtacagtggcatgattatagctcactgcaccctcatttccgggacttgaatggaggcccggctaattttttattttttatagatatagggtctcgccacgtaactacttttaattatttttattgccgggtatgatgatattgatatgtgaatacctgttgtaactacattagaaggcataacaaacagtcagagccaccacaaaatggattgataaagaaatgatgtattacccagataccatgagtagcattatcagtaatgaaaaattctccacagaagctgcatttttagtgaatttaatgcgtattaaaacagtacagaaatacatacatgactcagataacaataaacaaatttactttctataccaaatctttacatagtcttctagcaactaacacccaccacttccattaatgcagatagtgctccctatctttggaaaaaaattttatttttttattttttttgagatggaatctcactctgttgcccaggctggagtgcagcagctcactgtaacctccgcctcctagcttcaagcaattctcctgcctcaccccccagagtagctgggactataggcacacacagccacgcctggctaattttttgtaattttagtagagacgaggtttcacgatgttggccaggctgatcttgaactcttggcctcccaaagtgctgggattgcaggcgtgagccactgcacccggactggaaaaactttaaataccctgccaggggaagtattgcccctgttgaaaatcactattctagactttgcctgtatttgcctttcttactctaccagttttttattgtatttccccttagagccttagagtttgaaattcagtcatattggagagcagaactaataaatgatggctgtaatctgtttttgtggtgcctatggagttatggacagatggacattaggtacagccatcatttccctaggcaatcctaatcatctagcttgaaaggtcagttttcagtcacttgccttaagtcgcttttacagtttacctgttctgtttttttaattatcctgttcccatcaattaaaaatgttcttataataatccaagctataatttacaggtcagatttaaagttaattttatgtggatcctttgatgcatatgttgcccccagttcagcaagaagctaacagtcagtaagccagtttgtccagttcattgtaacctttgttccctttgtcattaaacgctagagctactactgagctttttctcactctgacctgacggagtaaagagggtgaggcaggccactgcaggcctggaaatccgtttccttctccagtggtgattcttgctcctcgtgttatcaccttaatcccaatatccaggctaaaaagtgagattattctctaccccctcgcttctgacatccagtcatccacaaagtttctcattttgcctcaaaaagagatctcaaatgtctttttatacatggctccgtggtctaaaccttcatcagtccttgtctggacttgtggagtagcttttataactgggcttttcttacattcaaacataccttatcacccaaaggtcacagttcccattaggtttcactctttgcgttatacattctgttggtggggaggggggttctcatttttatgatctcaaggaaagttggtagttgggagatgcaggataaggtgagaatgtaactactacttctgttggtaaccatgctctagaggtaagaggagggtgtgctagaacagttaatgtttaataggataaggaggggcagaatatattttgctagtcattgctaccctcttaattatggctcagtaggtcacactttaatttcttagacttttttttttttttgcctatcttacgggtaatgaggctacaactgtttgcaactgctgaagtcttgaaagcagagagcatggtggcttgtgttttttgatttttgccaaatttcctggtacctaattggcagccagagagtctctgggaaaattaatctttgacaacatgagatttatttcattttctaacttgttcaacttggttctgtcttgcaggaatgacaccaaggaagatgtatttgtacaccaggtgagtgcttgtgtagatatttgcacttctgattcaaggattgtaagaagaaaaggttagatatgttctcagcttttgttccttataaaaggttaagtccaaccaccagtttatttacttacgacaggagtagtagcatgcttaaaaatgtatacgtggaaatgtgttagagttgacttaattatcctagacatttcaaattggaattttgtcaacagctgtggctttctcaaatgttgagtcaaactcactgcattaaatatttatacctaatttcagatgaacagattattccatgattctaaagttgaacaaataatgttgctataaatacacagaaactttggcaagaagttttcaaaggcttttaggtgtacctgtagggacaaatctccataatcaagggtaaataagacagacctgcaaaacatagtaattgaagtgagtacttgaaaagtagcataaagagccttctgcttactttaaatcactttgaatgggtattgggttttttttttttttaaacctttggagagttttggctggcttggaaaatgaaaaaatttcactagtttaaggttaagtggggggaagtgtgacaaggttggcagctgctcattaaataatttttagattggcttccagtgatttgggaagagaaaactgttaacataggatgagtactgatgagtactgcatagtgaactttctccctaagtatcatttagggaaaatgtttgcacattcaggaattaagattattactaatgtaaaccactgccaagtgtatgttaatacttcaaatttagatatgctgtaggctacattgaatgtacttatcctcacagatacgaaatgagtaggaaaaaatatgtttgtgctatcagttttctcactaaggcttttgaaatattgtcaacttgtattaaaattagagaccataactacttttttgtactataatccagaaatcaaaagacctaaaagttaatatccatactcacatttaattagatactagcttttatggcagcatgtttcataggaagggctgtcataggttggtgctttgtagctcactgaagtgtcctacacagtatttgatgacaaggaggaagctatatcaatttctagtacacccaaacccaatcaggtagttcagggtcaaatgtaattatggaatcatttaaattctaaatgtaaataaatacaggactacttcagacaaaatgttgttttaaagtagatgttttataaaattggtattcttgtttggaagaacacagctcaactgttccttactccccttctgcatgttcaaaagaatgtgtagacttaggaacaagagacagcaaagtttctcggtcttgttgcctgttggcaacccttaagggttggggttggggcaggggtggagatgttgataaaaataaagagttgggattttaattatccataattctgctatcccctatgactgcaggtaattgatagttggctatatctgaaaggtatgaaaactatgtgacagtttagatgacagatgagatcaattatttgactcaactcacccagttgtactgattcacaaggtgccaccaatatgctttcatttttttggaagtggtttcaacatgtagttgtttcttgggactttggctgctcaggtcttagtggtgtatcagggagactgcagttctgggcagcttcacttaattggcctcagattcgttgattgtcctgtctcctctgcaatggaaatgcatgagtgatcctgtaatggatatagctgagatttggagtgaacatgggatttggagacccaatacctgggtttagaaagtctccttactaactgtgtgaccttgggcaagtcacctaactttaaagcctgttacattatctgtgtaatgggattaacaatactttcacatgtcctgtctcataatgagattgaatagatagtaagtgaaagaatgttgcaaaaaaatttcatagaaacgtgagatgttactcttcctcccttctcttaacagtctggagaaagtagaagcaacaagtctctaatacaagatttattgaattctggggaggtgataactaacaattccatgcagtcagatcatataaagaatgacatagttaatacacatgaattgcatttccactgatgtattatcagattggaagggattttggttgacatttgtaattgagtttgatacggtaacacaggggcaaagttggtttggtcagctttgaagcatgcaaaaccaaactcgcctgtcatctaaactgacgcagtgtggggccaccttctcctattaagtgcagtcctcaggggatagatggatatcctcatttgttaaaagttatatataatgcttttgcaaaaagcagtttttaaaatgatgtgtctgtcttgagtgttaaattacttgttttagttttgtaaatagtggtacaatgctggggccttgtatgattggagtgtttttgttgaagttggggatagtgtggtccccgctttcctaaatttattgatggtttggtcttatttaaagcaaatcttaagtgtatatccaagctaaaataatattgactctggtacattttaaatgaaaaagcacattattctcccctgttaatctatttttggaatgtgatattactagactgccataaagaagaataaccccaggaagtaccttcgcagtgtaggagatggagagactgtggagtttgatgttgttgaaggagaaaaggtgaggatgctttttgtgtaaaggtttgacttcagtatggaaatattttggaggtctcatccattaggatggtggctctaatgtggatggatgtgttcaggtgacctcatgaacacaggtgcatcaagcctaatgttctggctgcagttagagggcaatctcttcagaacagtgaggaactgatatttagtcatttctgtgcacccctggtcacgcagttgcgcccccccccccttttttttccttaactttgttgttttttgctttgtttgaaaatgttctgatttccttttgaaagtgttgaaagtgttctgatttcctttgtcactatcaatatgtaatggcttttgtagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggaggtaagtttcaccatcaacaacagcaatgtgataagttctggtaggactgtttagagctgttaattatatggaaagcaacttggattcctagtaagaaccaaaaggattaatttataatgtagtcacaattactagatggtctgttttgtttgttttttaactcttggatttatctggttgggtttttttattatattactgacccagtaggcttaatttccattgtctttttcagggtgctgacaaccagggtgcaggagaacaaggtagaccagtgaggcagaatatgtatcggggatatagaccacgattccgcaggtatggtccacgtaaacatgtttctattaaaatttcctcaaacccgtgttaggactcagcaatatcatgcctctcctgcagactcatttttctgttaacacttcacgttttctttcatcagatgcctaagaggtgaacctattaaaaacagcttgtatagatgaggtctgctttatacataaatttttttagaaaatgatgagggtttggaatttcaaattttctgtccttgaacaggtaagataatattttaaaccacaccttttaaacctgcctccttggtagggagaaaggaaagcattaggagtatctgaattgtaccatggcattagtgaagaatcaacagtgttatcacttgaaatggcatacattatcttccactaaacacttctcagtttagatatgtacccccttttttttggagttgggagttgtcagctcaaagttgcaaaatgaaattgctccaccaagaatttacattctgcggggggaaatccagtctgtcgttagacaactatctacttgagtgggtattagaaatcttattaatagatgtcattattagagtaatcgaggaaaaattccatgaaccaagcatattttagtccatgccgtagtatactttgaggcagtgttcccagtcccacggtggtaggataggatggtgtaatagttgtttctctaagggtttgatatcaaagcattgagttttcataggtgatccccaaaagctgacaggtacctctgaagaatcaaaccaatacagtaataacgcatcttaactgatcacttaaatcgcaacttttaaatccccaaatttttaagtgtcaagtttattattctagaagtatccaacatatccaaaatatactgtgagtctataagagggggtttctgtatataggtttttaaattttaccaaagttggagcacttagtgaagttttaggaactagggaatctagtcgaggttgtattacatgtatttatcagcacatgtacattgagagttttgcaagagcagctgatgtcatcatattttttgtattaatatgtcttgtcctgagttttcagttaaaagagctgaggtcctaactgatcactaccacaattgaagatctctgattcagttttctaccaggagattgtgttagccagatgctggatgttgaagatagatgggtttttatttttcagagtaggtctaaaatagcctctcatggcagtccatctgttaagtccatgggttccagcagcagaatctttggtttaccttttgttacactgaagagcttaaatgttttgcctagtttcattgatgtccttaaaaatagcataattttgtgtttgtattcagtgcttcagttcaccgttgagtaaattgtttgtctttatattgacaaacaagcttgcggttgatttgtctcttagaaaggtatctttgtccattgttacccctccagtgcagaggtttttgccttttggtttaagttagacttaatgtctacgtgtttcaatgtttagaatgctcagtcctgccagatagttgcagaagtaacataaaattgcttggaagttatcaatgaatgctagactttccaaactgtgcaggaatcttttgttcaaatgagagtaaatgaaacatgctgcccctaatgcatggaatggtgtgaaattctgactggtgtgggttcaagagcaaactgaaagggaaatcttaagacagagtatagtacaagtgttgctgaaaatgagactaatagtagtaaggggaaaatggggggtcaaaaagggaggttttttgttgagaaataacatttataggctgaaatgcaatccaggataacagttgatggcaggaaagtgactgctggaactgttttctttctcagagagggtagggttttgcccacaggtgaaaatgttgaccttttgttaggaacctgccgttttcctgtgtaagaaacaagaatacatgggcacgcatgtgttaatgggaagacatggaagcctttggttgctaaattgagacgaaagtaaagaggaagtttgaaaagtttggggcaaagaaccctctagaacagaaaatagagatggtaaatttataagtaataggataacgatcataaattagaagtgagttcacccagcttgactctgtgtttctagccatttgggcatcaggctcaggttgggcagagagttggatttatccagatttggtttatccagatctggtttgatttatccagatctggtttatccagatgaagacactggggtagggattggtcatatgattagtggtagactttatacttggataaagaggggagaaaaggggaaaatgagggttgtttttttttttttaaattgttttgtagaaatggagttgcactgtgttactcaagcagtcttgaactcctgccctcaagtgatcctccccaagtgctaggattacaggtgtgagccactgtgcccaaccttggagtgagatgaataggtgatagaatcgctgtattacaggtcctagattaagaatgagaaaacaataaggaattacctaagaaaaataggaaggtacataattggaaagttgagtggtataattgaaaaaacccaggtagaaaacagctggactgggaggtcagtctgaaagcccaggttattagaagctgttacactcgaaccttagtaataactgcagtaagaaaaagatagtaaatggagcagaatccaaaataagatggaaagcctagtttttagaaactgggagagttgatttagaagccacaataaggttagaacagtcaccactgtagggttgcagagaaaagtcagaacaattttgttgaagattcatcatgagttccaaaagatgtggggaaagagttttagaatgtacaaaggtaaatgtgaatttattcccatgatgactcatggatactaaaggcctggggctttctggagtgctcagagtatgggcagaggaaaggccaggaatccatcatttctgagcactgggggaaagaaaatcccaaaatttagtatctttatcttggtgattaaaagactcaagcctgtaatcccagcactctttgggaggccaaggagggaggatagcttgaggtcaggaattcaagaccagccttggaaacatagcaacacatcgctactaaaaatcagacattaatgagacgtggggggcttgcctatagtcccagttactcaggagtctgaggtgggaagatcacttgagcctgggagattgaggccacagtgagctgtcatcattccatggcactttagtctgggcaacaaagcaagactcttccccctactcagcatccccccccccccaaaaaaaaaaacccatctctttacacaaattgcctacagaccacttgatacagaatgggccagacatggtgagttagttgtgaaccaactggttacactggtgggtgtgttgaagagagaaggttttatcattcttaagtttgacaccgttcattgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccgggtaagcaagcttggatggccatccatttatggcagtcgtgagtggtgaccatttcgttttattaatgcaagagtagaaaaacctcagttccatcagataatgaaagccatgttatttataatgtgttctgccctattcttaattacctaatatttcattttaggaatattgaatatcagagtcatatttggccacccttcagctagttctcaattctgacactggagacctgtattttcatgagtattttgaactattagtgctttctatcaacttttctgaatgaattttatgatttcactagtaaacagaggaaagttttgctagctgtattctgagaaatatgttaattacattattatttatgcattatttcaaaaaggaagtggggatagctgttagaattaacctagatggtgacaaatagagtctgtttggagaaagtggcaacattaatataatcttttaatcatttctaattgttttttttttttgttggtttatgttgttcccggaaaaagacgagagtgtttcgtgtctaaaaaactcctagaatgacacgtggtttatcatggtttatttaaactgcctgtagattaataataataattctctggcagaccacatgatacaattacgttcttgttactttagctcattagctcacttgtttttattacccttaattccaaaattaagggattctttttcatttcgctttttacatgatatcgagaggtacgtgattgttgttccctccaaaattagcattcaaccagtggtgcttttggttttttcccgtttactatttgctggatggcaagagatctgttaatgtctcccaatacacaagtaatgtaaactagggcatgtactacactaaatgaagatcaccatgaattctacatgatcatctttatttttttctttacagtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataatt

SEQ ID NO: 37010 - DNA, 19921 bp, Homo sapiens; identical to SEQ ID NO: 37009

SEQ ID NO: 37011 - DNA, 53981 bp, Homo sapiens
ccactgctgtcctcttcagctcaagatggtggcctgccgggcgattggcatcctcagccgcttttctgccttcaggatcctccgctcccgaggtgaggcctggccgagggcatcccagacctccgggcagaactcctgccgggactggggtggccccggagccgcgtctccctttcgctgccgcctgccccagcccggagacgcagccctctgtggggatactgccctgggacccggtttcccgtgaccttctgaagagactgtcacttcccctctcacgactcctgcggcgatttcaggcttcctaactccccaactttctgagtctggtgccactcgttctgtcacctttccgcgggtctcttgcgtcgcacttctgggctcacgcccctcatattttcttgatccggagttccaggagaatcgggatccattctgtcgcatctttgtggctccacagcaccttgccccgcaacaagagctgtcttaaaaacagcaccttaccccgcaacaagcgctgtcttgtatgggattaatcagccttgcagatcactgcccctccctgctccgttccctcaaaaccatttttgtgcttactaccccaatcaagtagggagctcaactcttgcagtttcagtaatgtcagtgtgaacgtatagtattttgaatttcagcgggaagttctgcaacttactggaagacacactttaaaaatacgctaatacctctaccttaagcaataaaatgttagatcgttctgagaacgatttgtaatctgatgattcccagtcagcctgtattagctagtgtttttccttttcaaactggcagtgaaagggttaaagtgggtggttgtaggaaacgttgcattttctttccatcccaaatctgtaaagtcaaaagtggacaacgttttattgcatgttgtgcttaataagttacttaactagaaattttaacttttaatttaatttgtaatatgaattacctctcttccctcttccggaaccgctgaagtagtatgctttttttagacaagtagctgaaatcccttactgtaaggggatttttttaatgattgaatatttttctgctcccttttttcaacagctgtttttagtctccacaaaactgtagcatgtatttgccaattataacataagcacattatagaacattgaaatgctgtaaggattgaggaaagagatgaaaaaaaaacgaatcacccattgtcttactactcatatgcttacctacggttagccttcggttatgtttccttacaggtttggtggtttttttcccctattttcacaacacttttgaaaagtaacgtgtaatttttatcttacccctgcattggtttgaaggtatttcttatggatcggcagctgatgtcactcggaagtggtagccagggcacgtggttctagtcactagctgtgttactttggacaaatgccttaaactaaatgggctttattttcctcatctgcaaaatgaatgattgagatgatggatttcctttgcatgagaagtagcatgacagagcaattaataaacattgtttgggccgggtgcggtggctcacgcctgtaatcccagcactttgggaggcccaggcgggcggatcacgaggtcgggagatcgagaccatcctggctaacacggtgaaaccccgtctctactaaaaatacaagaaattagccggacgtgttggtgggcgcctgtagtcccagctactcgggaggctgaggcaggagaatggcgtgagcccgggaggcggagcttgcagtgagccgagatcgcgccacagcactccagcctggtcctccgtctcaaaaacaaacaaacaaacaaaaaaaacattgtttggagtctgacttctgggtttggacctggctctgccttttaccctctgatgaccttgggcaattaatttctgtgtttgttttctcatttgtaaaatggggaataataccaccttgtgtgatgaaaaggagttattttagatatcaagcagtttttcatggagtaagcactcagtaaatattattaactccagcctggaagaaatacgattgtatatatctgagagtttttaaaagtaatttgtacatcttatgtgtgtaataaaaagctaccaacctaatttttctgttttctgtatagaaatatatagacacataaatatatactttgcattgtgttttcaccagtaagaaagtatcattcgttgtagttactgatcccttaatagcaatttataaattttgaaaaaaagtctggaaagtgaatttaaaatgacctgcacccttatattactatttagactcaatagatccttcacagtaaaagtctgtgcaaggctttgccaaacatttaatgagattatgacctttgctggtggatgataaaattctcttgaaaggggccaggcacggtggctcatgcctataatcccagtatattgggaggccaaggcgggcagatcacttgaggtctagcctggcccacatggtgaaaccccatctctaccaaaaaataccagaattggccaggtgtggtggcacacgtctgtaatcccaactactcgggaggctgaggtgggagaatcgcttgaacccaggaggtggaggttgcagtgagccaagatcacacctggaggacagaatgagaccatatctcaaaaaaaaaaaaattatcttgaaggagacttgtaattcttgaaattttaaagcattccttctctacaagtgctataattctgaatgtgaatatcaaatgaaaatcacttcttgaccagagtatgttgtctaattcccactcctatcctaaatctaaattcctaattaggtatttagtagtaaataggtattagtagtaaaataatttcacaggagatgaatttagaggcaaataccttaatagatggtttttttgtttgtttgttttttcggttttttttttggagacggagtctcactgtgtcacccagcctggagtgcaatggtgcgctcttggctcactgcaacctccgcctcccgggttcaagtgattctcctgtctcagcctccagagtagctgggattacaggctcctgccaccacgcccagctaactttttttttgtttttttttttttgttgttgttgttgtatttttagtagagacggggtttcgccatgtcagccaggctggtctctaactcccgacctcaggtgatccagccacctcagcctcccaaagtgctgggattacaggcgtgagccaccgcgcccggccatagattgtgtatttttaaatttgattctcacttccttaatctcgtcgcttctcccagtgttgaatcttgagaaaagctgttgattattacaaccaaagtaatgttttcaaatttgaaatttatgttagcataatccagctctcttcgctgactgtagtcttatgaggttttgtagttattcttgggttacattacaaagatgattaaaaagtggggcaaaggtttctctctactttgctggcacagtagatgtaggctaaagttcactcagctgccatagggtaagctctgcagttaggtagtgagtaaggctagactccaaaagcaaagctaccttgcagtgtgacttgatttggttgactctggtttggaattattttcgaagtatgttcatgtatatactggttttctatttgtttctatttgtcttgatcttggagaggttttgtgtatgagtgtgtgggcagcataggtaggttagtggacaggagttaaaatggtttaaactgttggctaatgaccactaacctgttatctcaaatatttgatctttaaaactgcaacccagtggggcatagtggcacatgcctgtaatcctagctactccggaagattacttgagcccaggagttcaagaccagcctgggcaacatagggagacctcgtctcaaagaaaaaaaatgtttttgaaatattgcaacccatgctcactctatttcctttttttgcttaggtgcttattttctaacatatttgtgtttcttggtttttccctctcaacctgcattcccaatcagttcattcccactctaatccactttaccctgttttgctagaattacctatccccttcttcccttcccactggaatttctactttgcaggaaaactttttctatgccaggcctattttcacttttcatttatcttcactgagtaggaactgattcttcccagatatcatatcccctgctgacctggaatgtaagctccaccaagacagggatttttgtcttttttgttcaccctgaatgtcctgctgtactccaagtgcctagaacagtgaatggcacatggaggtcacaatatatgtttttgttgaatgaataacagattatgttggaaaagattacaatgtggttggtgaaacacctgctacagatgcagcagttagaggacagaacattaaataataaaataaaaatgcaggcaaggaaaggaaggatcactgtagacagaatccgaagatgaggttttgtggaaaagagtggagtcatgatgcaaatataaagaaggaagagtggtaaatacagatgacacagatttcaaatgatggaaaagcaaagcaggaaacatactattagtcaagtagaggcactggggattgaggagatggctggcttctcccatcttaaaacactgaagttcacttgtaagagacttgttcacagtcacacagctagtaaataaacctgatggttgaacacaagtcctttgcctttgcactaagtcggctggcttggattgcttaaagaagaaatgcaggcagaacctgaaatcaccccattctgcttctggtgctaaccacagttttctttctttttttttttttaatgtgtcaccttgcctttccaaccagtataaagctgctattttttgtgccttctcttccctttccataaggaactgggggataaagagaaaatacggaggcagcaagagccttggcaacctactgatgatcctcccctattccactccaccttcactgggttctccagtcagtagttcccatgtgcctcttacattgctatctctttggttctctttgcttccctcttcccttttgtgattacactgggcccacctggataatccatgataaactttctttattaaggccaactgattagcaactttaatcccccctttgccgtgtaacctaacatattcacaggttctggggatgtatatccctttgtgggggccagtcttcctcttttagtatccaaataatcatctgacctaacaactgaaatggaaaaaatatggcagtagtcatatggcctagaatacattgtacagatttggggtttttgttgttgttattattgtaaattacagctttgttatatataaaaggtactacagaaattgtttcgcaaattaattttgaaatgtcttttcttacaggttatatatgccgcaattttacagggtcttctgctttgctgagtaagtttaatttctttttaatgtgtatgcttacattgctttttggatttatgttgcaataaatatgtttacaaataaatctttcttttctttttagccagaacccatattaactatggagtcaaaggggatgtggcagttgttcgaattaactctcccaattcaaaggtatctcatttaatttgcagtttttttctgctaaccgcattatgaatctagtcctgaatgggaaagatgtatcccatatttccccaaatctaccaatctggcagtaatcttacatgaatttacagttttgacagttatgttaaactttgacagattgccaagggagccagttttctaaagcagaggttcttgcgtaagaattcctcttgttgaccttaggtgccaccagcctcctggttatagtgtagaatgaggaggtgacttattagagaagaaccagagtacaagctttgtttataagactcaaaatttgcctacccatcttaaatatgaggttgttaatccattttcttcattacttgcctgacataagtcactattcatagtaagttggctgagtgaaatgtggatacttggctcttaagcttcctgagggatctgaatgactcaatgcaattcacatattggaaatcaagttctgttcgaattgaaacttcttttgtttttggcagcttcaataaagtgtgtaacagtaatccattcttttgccaagaagagctttattgtgagagtccatgcttttcccccatctaaatttggtgtattcttactttaaaaatcttgtagccaggctgggcactgtggctcacacctataatcccaacactggatggccgaggcaggaggatcacttcagcccaggagtttgagaccaccctgggcaacatagcaagaccttgtctctataaaaaataaaaaatagttgggtatggtgatgttcacctgtagtgctagctactctgaaggctgaggtggaaagatcacttaagcctaggaattcaaggttacagtgagctatgattgcaccactgcactccagcctgggccacagagcaagaccttgtctctctaaaaaacaacaacaacaaacttatagccagaggcttagatgtaataagacctagatggaagcagttgacaactatcacaaattaaggtaaataagagccattcccctttactagagtaaattttagcactcactaaccaatgattcaagcttaagatattttttcagaattttcttaggttggacatttttcctgaacacaaaagtaatatatgtcaatggtagaaaatttttcaactataaaaaattataaagaagaaaataataaacattcataattcaaacctaaagataaccacatctttttcttggtatcttccatgggataatcacatttaattcagtttcaatgaataatatttacaaaactaagatcatactatatggttttttttgaagatagggtctcattctgttgcctaggctggagtgcagtggcacagtcacaggttagtgcagcttcagcctccccaggctcaggtgatcctcccacctaagcctcctgagtagctgggactataggcgtgtgctgtcaggcccggctaatttttgtattttctgtagaggcaaggttccattatgttgcccaggctggtctcgaactcctgaactcaagtgatccgcccaccttggcctcccaaagtgcagggattacagggatgagccaccatgcctggcctatatgtcttatttgtatttcatttttttcttaacattatgcagattttttccatgccaataaatgtttgtagacctatttgtttatagcctacatatgattcaaactctgaggatgaccctgagtttctcctttgagaagacctatttttaaaggaaggggtgcttgtagtgggccaaagctgcctgaatagaaagctactgacttgctgggagaatgatatttcttactctcttctaacagtatatttctgccggataagtatatttcttataatcaaaatagcatttgatggtggtacgtacatccagtgcttcaaatttaaacccttacctgtatatatttccctttggcaggtaaatacactgagtaaagagctacattcagagttctcagaagttatgaatgaaatctgggctagtgatcaaatcagaagtgccgtccttatctcatcaaagccaggctgctttattgcaggtgctgatatcaagtaagttttaggaaacttgaagtcaccttttatcttggttaatagtgtgtttcttaggcctaataatttctccttttaaaagaaagtagaagtgctgggcacagtgacacaggcctgtaaaattgaaaatgtacgtatcaggctgggtgtggtggttcttgcctgtaatcccagcactttgggaggccgaggcaggtggatcacatgaggccaagagctcaagaccagcctggccaacatggtgaaaccctgtctccactaaaaatacaaaaattaggcatggtggcacacgcttgtaatctcagctactcaggaggctgtggcacgaaaatcccttgaacctgggaggcagaggttgcagtgagccgagatcacaccactgcactccagcctgggtgacagagtgagactgtcttaaaaaaaaaaagtatatacacacacacacacacacacacacacacacacacacacacagagtatatatatatatatatacacacacacacacacacacatcatgtgatctagagaaatctcaccccttgtttataagaaccagtgtacaaggatgtttggtcctgtgtagtgtgaaataatgaagaatttaaaaccaaatgtcagtcagtaggaaaatgggtaagtaaaatgtggactattcacacaatagaatactacaaaacaggtaaaaggaattaactagatccacaatatgatgttagaactcaaaaacataaggttaagttaaaagaaaagcaaattgcagaatgtttcatacagtatatagtttctataaatgttttaaaaccaaacatggaataattcttgatactatttatggacacaatcgtagttggtctggaaggagacactacaaacatgaagatggctgctttggggaaatgaagtgggtggtaggacttgattgttaaaggcagctttacagatgcagctagtattttcttttcctctgctaaatggtggaatgcatgcctacattaacttatttacaattgtttacacatacataaggaggggaaatgatattttagtgtcagtttaataggttaaaatgttaagttgtcaattccattaaaatatgggtatttgttatgttctttgtattttagacaatgatagccagcattgtaggtttagtaatttgtactgaaagtgtaattatttatgtgtagtaatcagtctcttgttaggcacaaataattcagctagaagaaaaaccacttgataagataattttgggtcttctaaaaaattaacattaaacagaacatttataaagtctaacaagacactgatgtacctggcagtagctacctatatccagaggaaaatacatgtagcttctatgaggccagctgagcaactctcagtgtataaaattacagaatatactagttatccttggtcaaaagtacaaaatccatatcctaagtgtgttcacaaaatagcaaatgaaacaaactgaaattaaaggacattgagtggaacatcattgcacctgatcatttttatttacttatttatttttgagacggagtctccctctgctgtccaggctggagtacagtggtgcgatctcggcccactgcaacctccacctcccaggttccagtgattctctcgcctcagcctcccgagtagccaggactacaggaatgcagcaccacgcccagctaatttttgtatttttagtagagacgcggtttcaccatgttgaccagcctggtctcgaactcctgacctcaggtgatccacctgccttggcctctcaaagtgctgggattacaggcatgagccaccatgcctggcctacctggtcatttttattcattagtgggatctgttaaaatgttttagatttctctaaacaacctggaagcttttcttttgcgtcatttttattgctgttaactacctgatagtgaaatgtttaatctgatagtgaagtaatttaccaaagatgattttcccttgtaccaagctttgtaatttaatgatttattacagaagtaaaaataaattatgcaacacatttatgttttctggatccagaatttttttttttttttttgagacagagtctcactctgtcgcccaggctggagtgcagtggcgcgatctcggctcactgcaagctccacctcccggtttcacactgttctcctgcctcagcctcccaagtagctgggactacaggcgcccgccactatgcccagctaattttttgtatttttagtagagacggggtttcaccgtgttagccgggatggtctcatggatccagaagtttaacactctttatggagaaatgatgttgctgctattgtgctatttgaagcaaaatcattcttaaccttctatttgaagatttgtcatcaaatattgatgcatgataggataagtgtatagtgaataagtattgaaccaaataaattatagttttatctttttctctgttctctacttttatggataatgcagcatgttagccgcttgcaagacccttcaagaagtaacacagctatcacaagaagcacagagaatagttgagaaacttgaaaagtccacaaagcctattgtggctgccatcaatggatcctgcctgggaggaggacttgaggtatagatattctaaagttattgagacactgtccaactcattggtggcattcatcagctgtaaacccttaggctactgctttgcctggaaaaagtttctggaggagaatccgctttgttttttgttttttgctttgagacggaattttgctcttgtctcccaggctggagagcaatggcacgatcttggctcactgcaacctctgcctcctggcttcaaacaattctcctgcttcagcctccccagtagctgggattacaggtgtgcatcaccatgcccagctaatttttgtatttttagtagagatggggtttcaccatgttggccaggctggtctcaaactcctgacctcaggtgatcctcccgcctcggcctcccaaagtgctgggattacaggtgtgagccactgtgcctaaatagctttgtttttagttatcaaacttctggataggtgttaatccttaatccacatgacacagagcaagtggcacaaagcaagtaaatgaaggtgtgatgttttcatttgaactgcatctctaatgtccttttcagctgtaaaaatcttgttcaagtttgcagggcaaagattcagaagtgtgatctaggctcttaagctacttaagtctggttgagacacataaagcataatataagtgctttgtcagtagtaaagacggtaaataatagaagatttgagagaagagatgcttactagacccgaacatgtaggaaagaaaagaaggggaaaaggaaacattcattgagcacttttcacatgctgaactctgtgccagacactttcacatatgcagtcatttaccacataacgtttcaatgaccaattgcacatacagcagtggttctataagactgtaacactacatttttctataccttttctgtgtttagatacagaaatgcttatcactgtgccacagttgcctacagtattcaatagtcacatgcagtccaggtttgtagccccttaggacaggggtccccagttcccaggccatagcctgttaggaactgggccccacagcaggaggtgagcagtgggcgagtgaacattaccacctgagttccgcctcctgtcatatcaacagtggcattagattctcataagagctggaaccctgttgtgaactgcacatgagagggatccaggttgcgcactccattggcctctattgcctgatgatttgaagtggaacagtttcatcctgaaaccactccctcccaccccacccccagttcttggaaaaattgcctttcacaaaacctgtccctggcgtcaaaaaggttggggactgctggactaggagcaataggctatcccatatagcctagatgtgtagcaggctctgccatctgggtttgtgtaagtacactctgcgatgttcacacaacaacaaaatttcctaatggtacatttctcagaacatatccccctcattatgtgacacatgactatattaattaagaaaacctgtgcctggtcctaaactataagcagaatttgattaaccagaatatggagggaaaaacaattccgcatatggtatggtgtgagcaaaggcaaaagcaaagccaactaggacactgtaagtagacgtgcttgattggagagtccggggctttttaacctggggtccatataaaattgtgtgtgcatttttctcttgagagcttctctagctttcagtagattttttaggagatctacggcccaaaaagaggttagtaaattagaggaaaagtatgaaaaaaaggctaaaaaggtaaattctagaaattattaaatgccagcctaaggaatttcagtttattctgtgagcacattcctgctttataaataatctttagacccttatccatctcaagttgctactaagttacattttctaacattctaattttctttcatttgttcaaaggttgccatttcatgccaatacagaatagcaacaaaagacagaaaaacagtattaggtacccctgaagttttgctgggggccttaccaggagcaggaggcacacaaaggctgcccaaaatggtgagtctaacatcccctttgtgaagctatatgccctctttagatctgttttcttgtataaaatgcataatatgggcattcattgtagaattaaaaaaccaaataaaatatgagtgtacaggatcagtgacagactttattcctggtacttattttttcaattccacagatttttttttttttttttttttgagacaaaatcttgctctgtagcccaggctagagtgcagtggtgtgatctcagctcactgcaaccttctcctcccaggttcaagcgattctcctgcctcagcctccccagtagctggaattacaggcgtgcaccactgcacccagctaattttttatattttttagtagagatggagtttcgccatgttggccaggctggtcttgaactcccgacctcaggtaatcctcccgcctcagcctcccaaagtgctaggactacaggcatgaaccaccatgcctggcctaattccacagaattattgatcaaggtcctttgttagtctctgaggaaggataaagataactaagatgcatgtcttgcatttctggagcttatggtttaattggttccttttccacataataccatcttaacagtttttcaaaaccatgagtcatattaatatttcattacaaatataagaggcagaccttttccctcattgtctgatttggatgttctcactgctgtgttgtatggaaccaaaagaggctcagcaggctttgaattccaaggagaagggaaggacagtcagacctggatgctgcagagcaatcttaatgtcaactcaagggcccactgaaccttatagcttctggcactgtagattcctcagtgaaaacaaggctcaacagaaatactctttgcagggaagttgatctcaattgagcacaaaagaaaacaaggtttatggtgttaattttctaataataataatgtgctttccttcataggaatgtcataaggatttattgaaagaatgaatatgcatatatgtgtatcaaaaatatttgctgagtttctttctttcttcttttttttttcttaaactatagctggtatttgaatgttgctagaagcctttcttctagtatgccatataagcagccctagctgagttctatttttgttaagcttaaaattctttttaaagactttgtcaaaactatcaggtttctcacagtcttctctagtttcaatatgagaattttattttattttatttttgggacagagtcacttttgttgttcaggctggagtacagtggcatgatctcggctcactgcaacctctgcctccggattcaagcaattcttgtgcctcagcctcccaagtagctggaatgacaggtgtgccccaccatgcccagctaattttttgtatttttagtaaagacagggtttcaccatgtcgggccaggctggtctcaaactcctaacctcaggtgacccgcctgccttggcctcccaaagtgctggaattacaggtgtgagccaccgtgcctggccagaattttacatattatatatatgatagaaaaaaacccctcagaataacagaaatgtacaattttaggaaacatgaaattctttaccttattagtataagaatcctatatattgaattaagagataaagacatttttgcttcagctagaggtatctaatccccaaagttacccaagtgtatatcagtatattaaatataacttatctatgctgttgacaaatagcataaacatatggcttgacttttctcattttaatatttgttcatttgatgatttgtaaactatataattatcaccctgatttttttccccctatattctcatccttgcttgcctgttaggtgggtgtgcctgctgctttggacatgatgctgactggtagaagcattcgtgcagacagggcaaagaaaatgggactggttgaccaactggtggaacccctgggtaagtgttagcacatctcagagtcagaccttataaagttacttattttcttaaagagttaacctcttaggccaggcacggtggctcacacctgtaatcccagcactttgggaggctgaggcgggaagatcacttgaggtcaggagtttgagaccagccttgccaacatggcgaaaccctgtctccactaaaaatgattagccgggtgtggtggtgcaaacctgtagttccagctacttgggaggctgaggcaggaggatcgcttgaacctggcggggctgaggttgcagtgagccaagatcatgccattgtgctccagcctgggcaacagagccagactcccatctcaaaagaaaaaacagttaacctcttgaatatcacaggaagcacagagagaagctcaaactcttaagaaatgagtcattattctaaggaaggaagttttataaaatagctaatactaaatcattttcaacatcaccctgatttttattttgctttataattagaacattaggagtacagaattcagtcaagtcattatttttggttcttaaattacctgtatcattatccatgcataaccttccttcagtttcttgtgtctgttttagtaatataataaatgaaacaaccaacctgagaatattaacaataattgatatctactgatgggctacttcctcccattcagtttctttgcctccctttatccaaagaagccactattctgacttgtgtgttcattaccctcttatatttattgaaaatcagcattattgagatattacttacataatagtaaatgtattaattttgtgtgtgtgtgtgtgtgtgtgtgtgcgcgcgcacacatgttggggtctcactctgttgctcagactggaatatggtggtgtgaatatagcttgttgcaacctcaactttttgggctcaaatgatcttcccacttgtgccccccgagtagctgagaccacaggcatacgctgctacaccagctaattttttattttttgtagaaacgagatctcactctgttttccaggctagtctcaaactccgggctcaagtaatcctcctccctcagccacccaaagtgccgagatttacaggtgtgagccactgtgtctggtgaaattgaccaacttttaatgtataatttgagttttgaaaatgtatatagctgtgtaaacactgccacaatccaaaaatagccgtgcatggtggctcacacctgtaatcatagcattttgggaggctgaggtgggagaattgcttgaggcctggaattcaagaccagcctggacaacagagcaagatcctatctcttaaaaaagaatttttttttttcaattagctgggtatcatagtgtatacctgtagtcccagctagtcaggaggctgagacaggaatattgtttgagcccagaagttcaaggctgtagtgagctatgatcacaccactgcactccagcctgagcaacagagtgagatgccatcttttaaacaaaaatttttaaacatttctggtatgtagtttgttttaatcttcgttcacttagcataatgcttttgagatgcatccatactgttgcatatatcagcagtttgtccttattgctgagtgttactccattgtagaaatgtaccatagtttgtttatccgttcaccaaatgatgagcatttgagttgtttctaatttagggctattctgaataaagctgctatgaacattcatctttaagtctttatgtgggcgtgactgggcgtggtggctcaagcctctaatcccagcactttgggaggctgaggcaggctgatcacctgaggtcaggaattcaacaccagcctgaccaacatggcgaaaccccatctctactaaaaatacaaaaattagctgggtgtagtggtgtgcacctgtggtcccagctacttgggaggctaaggtaggagaatcacttgaacccaggaggtggaggttgccgtgagccaagattgtgccactgcactccagcctgggtgacagagcgagactctgtctcaaaaaaaaaaaaagtctttatgtggacaaatgtttcatttctgttgggtaagtactgaagagtggattggctagtccatataacagatatatattagcttttgaaaaaaaaagtttggcctgagcaacatagcaagactctgtctcaacaaaataaaaagttttaactagttgggtgtggtggcacatgcctgtagtcctggctactagggaggctgaggcaggaggattgcttgaacccaggagtttgaagtcacatggagctatgatcaggccactgcactccagcctgggtgagagagggagaccttatctctgggaagaaaaaaaaaaaatttagagatgagactttgagtcttgctctgtcacccaggctggcctcagactcctgggctcaagcagtcttcctgcctcagcctcccaagaagccgggattacgaggcatatgccactagtatttgctaggtatgtgtttgcttttctgtcagactgttttcccaaagtggttatactcttttgcattcccaccagcagtgtatgagagttctaggtaccaaccactttgcatggtcaatctttttaattttagacattctaacaggaatgtagtaacagttcttttttctttttttttttttgagacaaagtctcgctctgttgcccaggctggagtgcagtggaacaattttggctcactgcaacctctgcctgccaggttcaagcgattctcctgcctcagcgtcccaagtagctgggactacaggcgcccaccaccatgtccaactaatttttgtatttttagtagagatcgggttttaccatgttgtcagggctggtctcaaactcctgacctcaagttatccccctgccttggcctcccaaagtgctgagattacaggcgtgtgccaccacacccagctggaattagtcatatttcattgtggtttttatattaccctaattaccaaagatattgaatatctgtatatcttatttgataaagaagcatctgttcaaattttttgcccattttcttggactgagtgtttttcctattatcgagttttcagagttctttatatattaggatatgagtcctttatcaaatatatgatttgcaaatatttcctcacagtctctggcttatcttttcactatataagagcagaaattcttaattttaatgaagtctggtttatcaagtttctcttttatggatcatgctattagtgtggtatctaaaaaatatttctctaactcaagatcactaagttttcctgtatactttcttctagaaattttctagttttagctcttacattttggtctgtgatccatttggagtatttatggatcatgctattagtgtgggatctaaaaagtatttttctaactcaatatcactaagatgttcctgtatactttcttctagaaattttctagttttagctcttacattttggtctgtgattcatttcaagtttgtatatggtgtgaggtaaggattgagggccttttcttccctttttgcatatgaatatccaaatgtcctggcaccatttgttgagaagactactatttcctcagtgaactactttgatcccttgatcaaaaatcaactgaccttatctgtttgggccaattggatttcctattcctagttatctatatgtctttttgttaaaccaataccacactgtcttgattattgtatttttatagggaatcctgaaattaagcagtatgagtcctccaactcaggtcccttctttcaaaattattttgctcatactagttcctttgcatttgtgtacaaattttataatcattttgtccatatctacaaaaatacctgctaggatttttattggaattgcattgagtcagtatataaatttggggagaattgacagcttaaaaatattgagtcatttcatccatgaacatggtaaagttctctgtttatttaggtctttaaatttctctcagcagtgtttggtacttttcagtgaatagatcttgaacacattttgttaaatttatgcctaggtatttcatacttgtaggctgttttacttttttaactttaatttctcactagaatatagaaatacaaagatttttggacatggaccttgtatcttgtggtttagctaaattcatttactagttctagtagccttttttattaatagattcctgaggattttctacatagataattatgttgtctgtaagtaaagacagtttgacttctttctttccaatatagatgtcatttgtttctttttcttgacttaccacaatgtctaagacctttgtacaatactggatagaagtcatgagaacaagtattgtcaacttgttcccagtcttaggaggaaagcattcagtattaagtatgatgttagttgtaggtttttcatatgtgctctttatcaggtttgctgagaatgagtattgaattttgtcatgccttttctccatctacagagataattgtggggttttcttcttttttagtctattaataatgtcagtcacattgatttttgaatattgaactagccttgcttcttggaataaactccattttgttgtcatatattataaaggatttttatgtcatcatgagggataaagtctcaaggataattttcttatgatatttttgcgtggtgttggcatcaggataatgctggcttcataaaatgaattgagaagtgttctctcctcttttttttttttttttgagatggagtctcaccctgtcgccaggctggagtggtgcagtggcgagatcttgggctaatttttgtatttttagtagaaacagtgtttcatcatgttggccaggatggtctcaatcttctgacctcatgatccacctacctgcctcagcctcccaaagtgctgggattacaggtgtgagccactgtgcctggcctcctcttatattttctggaagattttatgtagagttggtattatttcttaaatacttgatagaattaaccagtaattcctgggctcctagttttctttgttgggaaaatttttacttatgaattcaattaatagatatagggctattcaggttctccattctagagtaagctacgatagtagtttgtgtctttcaaataatttgttcatctattaacaatttgccaaatttattgcaataaagctgttcataatacttgtcattttaatgtttttatactctatactgatgtctcctcattcattcctgatattgatagtttatcagctgataggactttaatcacttataaaataccttcatagtaacatctaggttaatgtttattgaataactgggctgtagcctagccaagttaacatatctgaagactatcatactccaccccttgtctgtttgacacccatacacatctcctaaagccatacatagtcttcaaataaaggcaatgacaggagtcatactttatcctgacataatgcaattctcctttatacaaccaaaaatacactaatcctttccctagaagaggatgcagagtccttgggtgaaattcactcttctctcatattctgtaacataaatgctatgatataaagttaaccattatggatacatcttatattagatgataaggagatagagaagaaacacaaatatttggttaattatatatattcataacaaaataagaaatcctcataaatagtacagtattcattactgtattcagaaatgaatatttataatatttccagatcagtattcagctgatgtggaaagagaactgagctatcaaatatcagagtaaataattaaacaacccaaaaggaaagtaacagtggagcctttattcacttactttgatagtttacacaaaaggctaaaaaccaaagaaagtgccagctcctttttccccccagtaccgttttccccatggaatggtacactggttgaggatctggtagattagcatacaagtgggggacatctcactgttgtgaaagccctgaacaaaaggttcctgcggctttatggaccctgggtgaggagagtggagtagactgggagaagtgtctttaagatttcccattccggccaggtgcagtggctcatgcctgtaataccagcactttgggaggccaaggcgggcagatcacctgaggtcaggagttcgagaccagcctggccaatatggcaaaacctcatctccactaaaaatacgaaaattagccaggcgtggtggtacatgcctgcattcccagctactcaggaggctgaggcaggagaatcacttgaacccgggaggcagaggttgcagtgagccgagattgtaccattgcactccagcctgggcgacagagtgaaactccatctcaaaaaaataaataaataaataaaagatttccccttcctcctttgacaaggtctcagcagaggcacctgaagaaggcctcagccaaagtccccatataaaaagacctaggaatagaaggcatctaggctaggaatgcacatttgtgtaagagcttagccagccccagagacccaagtccttgactgcagctccctcagatgacaccgcagtgcactggctgtgtaccaggtttggtgtggaaagggtgatatttctactccccttttcatattccctttgccctcaggaagtacctcagtttgtcctagttctttgcctggtggggtgaccttcattcctaaaatgtcttctaggccactagcagtcccatgtgaactgggttgtgatcttctactgactaattagaggtcatgttagtactaagggacaccctaagagatctgccacatttgagacatactcttccttacctctgttgtatagtagcaacctaatatccccttggtaatcaggattaatcaccccagccagtacagtacccgccctctgctgcctgttgattccaaggcatgaggagcccaaagtggccagatggcagttttaactaacagttcagtagaatcattgttgtgtctcctggtggaagcattcctccctttggaactgagccctctagacaggcagagcccaaagttgcagggacaagaagcagaaattttgctggtagattagatcactaggggtaatagtgaactgggtaatttctgtttgctctccttgatttctggactcacgaatcctggctgtgggaaaagtagcaccctatactggaagctgacttaaaacatagcagcatcctggaggacattgactctgcaaaatactgccacttagctggcactgtgatggagtcttcagtagtccatcccaccattctgtcaaggcaactgcttcccggtgatgtagtaagatcagtgtttcgtgagcatggcccattgctgcacttcacttactgagaagtgaattccttgataagaagcagtgctttgtgggataccataatggtgtgggataccataaggtactctataagtccacaaataagtccacttaccacaaattggtaagtgaaagtccatattgcctaagcccatgcataacctccacacccaccatcatggccactgttcatgaagcagtgataagagtgactgcggaaagatgctgactgctatccatagaacgagtcatcccatccactttgatcattgaaatcctcggctgaggtcactctttgatgagcatttaatgggacacaagtgttttcacattatttgcctattcagagaggtctatccactgacctattccccaggtgtccttgtatattagtttgctagggctgccataacgaataccagactgagtggcttaaacaacagaaacttaacatgttttctcgcatttctggaaactggaagtctaagatcaggtgttagcaggtttggtttcttctgaggcatctctctttggcttgcagatggcactgctttcttactgtgtctgcacatccctggcatctcttttgtgtttccaaattttttcttctcataaggataccagtcagattagattagggtacaccctaatggcctcattttaacttaatcgcttctttaaaggccctatccccaattacagtcacattctgagatactggaggataggacttcaacatatgaatgaggtaggggggacacaattcagcccataacaccttgccaacagtttttcatctgtgttccctgtaagttccttaccacccaggcaaaccgtttgccacggcctatgaatcagagtagacccttagctcaggccatttttctttctagacaaaatgaacaaccgggtgcactgtcagaagtactgcccactgggaggctatcccttcaccactgtccttaagggatgtcccagaagggactgtagtgttacagctgtgcacttccaggtggtacctgcgtatcacacagaaatatctacaaaccaggcctgagtttttctttaccaatcaactggccatagagaactccccatgaggccataggtgcaggctggaagagacaaagaagaacagggccgtggggtattttggctacttcctcatgcagcttgtgcctttagggtctgtttaagcccagtcttacatataccacttccatttgataatggagtgctaccgtgtacaccccactttatggcttagtaggttagacaacatctgtttcatgatcagcagctcaggtcaccagtaacttgatgccccatggttaagctttgagtctctgtgaagtcccactaacaagccaaacactgtttcccaaaaggagagtagttattcacagaggatggtagggctttttctaaaatcctaagggtctgtgttgtgattcacctaatagagatctattaaagactccagacagcacctctgtctgctgccgacacttcaggcgccatcaggtttgaatcacgtggcccaaatggcagaacagcttctcttgttctgggtcccacttaaactagcagcttttttagttactcagtaaatgggctggaatagcaacccaaatgagtaatatgttgtctccaaaatctgaagcagcccaccaggtgttctccgtgtttttttgtggtaggaggggccacgtgcaacacttaccctttgccatagaagggatgtctttgtatgccccagaccactggatccccagaaatttcactaacatgggaggccctgaattttggagggatttatttcccaccttctgacagacacatgtcttacccccagtatgtctagagtagttaatacttcttgctcaccagatccattcagcataatatcacagtgtaatgaaccagcatgatatcttgtggaaggacaaggtaatcaggctctctgtggactaaattatgatatatggttgaaaacaatacacccacccctaaggtaagacattgaaggtatattgctgaaagcaaactgcttctggtggtctttactaacagataccaagaaaaaaaagcttttgtcagatcagtcactgcataccaggtccaaggatgtatgttaatttgttcaagcaataaaacgacatctggaacaccagttagaattgcagttgccacctgattagatgtacagtaatccactgtcattctataggatccatctgttttctgcactgtccagagtaggcaagttgaatgagaatgaagtgggaatcaccacccctaccgctttcagtccttgatggtgacactaatctctgcagtccctccaggattgtggtgttgctttggtttactcttttctaggtagaggcagttttagtggcttttacttggcctttcccaccatagtagcccttactctacaagtcagagcatatagtgatattactcattgctgagtatgtctgctccaattgtacattctgaaactgggaaaataaccgcaggatgggctcagggacctgctaggcccactgagacagacctgagctaaaactccattgatcacttgacttcataagcccctactctgactgctggaccacagcgaagtttgggtcccctagaattagtgttagttcagaagccagtgtctagtaatccccaaaaaatcattgtttccccttctgcaaggcaaatagccataggtcctttggggaagggtaggagaaagataaacaggaaagtctcctcaagaggacacagcttccctttcattaaggagattctgggtctgtaaactagctcatttctgggaattgcttaaggggccatgactctcttcaggtgattcaagttatacttctgtttaccagacctagaattcttctgcttatacagatcaagtaagagttagtagactgcccatctatttcttttttagggacaccatgatcaaccacccaatgctataggtctcagcaagtcagactattctgattactgctttggctccactatttattatggtaactatgcccaccttgatttggcatggtgctgctacttgggccctgccaccccgggattcctttatccccattgcatttagggatcccagttgatggtagcagttcccactgtaatttctgacctacaaagagaagcaaccacagagcaaagatgctgggcctcacctcacaaattgatttctcacagtggtggtgaagggtgcgtcctctaacccttccagggtgacctgtcagttctttgctccttttttcttcttcctgctttcttttggattaataattttttattggccgggcacagtggctcacgcctgtaatcccagcacttcgggaggccgaggtggacaaatcacgaggtcaggagatggagaccgtcctggctaacatggtgaaaccccatctctactaaaaatacaaaaaattagcctggcctggtggcacatctgtaatcccagctacttgggaggctgaggcagaagaatcactagaacctgggaggtggaggttgcagtgagccgagatcacaccactgcactccagcctgggcaacagagcgagactccatctcaaaaaaatatatatattttttgtcttcattactggccttttactttgcttttcccttttaatggttgctctggggttttacagtatacatttttaacccatcacagtctattttctttctttctttttttttttttttttgagacggagtcttgctctgttgcccaggctggagtgcaatggtgtgatcttgactcactgcaatctctgcctcccaggttcaatcaattctcttgcctcagcctcctgagtagctgggattacaggtgcacaccaccacacccagctaatttttgtatattagtagagatggggtttcactatcttggccaggctggtctcaaactcctgtcttcaagtgatctgcctgccttggcctcccaaagtgctggattacaggtgtgagccaccacacctggccggttttcaattgataatattttcctgtggtgtcagaaccttaaaagagtatgcatttattttgtatactccccatttttgctattgttgttatacattttactgctacatacattataaattcttgtatatattggtatatttgttttagataattatctcttaaggagaataaaaaattagaaaagatcttttttatagttgcccacatagttaccatttttagtgctttttatcctttgtataggtagatccagattcccatctgatttggttttcttgcaacctgaagaacttcctttagtgttttctgtagtgtaggtctgttcttaccttttgatttgtctgacaaagtctatttcccacttcatttttaaacatatttttcctagattgctaatgtttcttttctctctctttttttttttgagacagagtctcacccttttgcccaggctggagtgcagtggcacaatctcagctcactgaaacttccacctcccgggttcaaatgattctcctatctcagcctcctggatagctggaattacagtcacccactaccacacctggttaatttttgtacttttaatagagtttctccatgttggccaggctggtcttgaactcctgacctcaagtgatctgcccaccgcggactcccaaagtgctgggattacatgagccaccacacctggccggctaatgtttttcttttggtactttataaatgtctccattgtgtttggcttgcataatttctgatgaaaagtctgttgtcacttttatcttggcacttttttgtttgtttgtttctttttgagacagggtcttgctctgttgcccaggttaaagtgcagtggtatgatcataactcactgaagccccgaacttctgggctcaagcaatctttccacgtcagcctctcgagtagctgggactacagtcatgcaccaccatgcccagctaattaaaaaaaaaattctttttgtagagacaaggtcttaccatgttgcccacactggtctcaaacccctgggctcacgtgatcctcccacctcagcctcccaaagcactggaattacaggcatgagccactgtgcccagctgtcattcttttctttatacttctatatatgatgtgcctttcccttcctctgtctgctttcagattttccttttatgactggttttagcaatttgattatgatgtgccttggtttgttgggattttttttaaagttattatgtctgggattcattgagcatcttggacatatgggcttatagttttcgtaaaaattggagacttctttggctattatttcttcaaatatttttctgtctccctcccctttttggagattccaatttcacattgttaggtcatttgatattgcccaaaaatgaagctctgggttgtttgttttaggtcttctttcattctggttatttctactgccatgtgttcaagtttcctgatgtttccctcttctgtgtatccctgctgttaatccaatcccatgtgattcactttttttttttcagacggggtcttgccgagtctggtccttgagctactgggctcaagtgatcctctcacctcagtctcctaagtagctggggttgattcacttttatatcttcagtttctcttcattatcgtcctgttttcctctaccttctgtaacatacagcatgaatttacagtagtcttgaacatcacgtctgctccttctatcatttttttcatttctgaatctgtgtctatttattgatctgtctcctggctatgggtcattctttccttgcttcatttcatgccttttatggtggttctttcctcagctgcagatagtttcccctcatgcacatgcagaacaatactcggccagagtttcaaggaccgctctttagagctctggagctctcctgttgtgcagcagctgctctccagcatttcacgtcacagattccagctgccctggcctccctcaggattatgactgtgttaggacttttctggacactgaacttttgtcactccaaagttttgggcttagttattattcctccttccccacacaggttcaaaataggccaaatggtccaggctcggtggctcacacctgtaatcctagcactttgggaggccgaggtgggcagatcatttgaggtcaggaattcaagaccagcttggccaacatggtgaaaccccatctctactaaaaatagaaaatttagctgggcacagtggcatgcacctgtaatcccaggtactcgggaggctgaggcaggagaatcgcttgaaactgggaggcagaggttgcagtgagccaagatcacactgctgcactccagcctaggttacagagtgagactccatctcaaaaaaaaaaaaaaaaaaaaataggtcaaatgtcttaagggagagattggttgtatgtctgctatgggttccctcagttgggattttgtttcctaagtaccacagtactgcacaagattgccattttgaccccagccacctcctccaatgtggctcttacagacttttgattgagagcctggtaggtgtctgttttcacagcactataaattgtgttctttggattccttttaaatagaggtggggtctcactatgttgcccaggctggtcttgagcaatcctcctgtgtcagtcttccaaagtgctgggattataggcatgaaccactgtacttgttcttcagattttttgagcctagctctgtaacctcttgccccaagcaggttcaagatctggcagaggccttgcgtggaaaatcagttgcatattggtttcaggcccccttctccatagaagtaccttatctattaaacatcatgatactatgagagatttcactcaacctctctgagctagccccttcctccttgtgtaccatcttagactttcacaaatgttccttggggaaaactggctttgcacttggtttcttctagcttctaatctgttgtacatgaccaccaaaaactctgatggtttcactttccttctgcttgagtcaagtccagtcttcagtccatgcccaaaagcattacacatccctgaaaagaaaatgatcagcaatcatcagttcagctaagataggctcttgctctctagaattttagttcatgttgtccttgttacttccatagctccccagtgtctttacaaatgatttcatgatttcttcttttttctttccagttttgcagcaagaatgcaggttgcagtagacataatgcattccttttgtgtgtgttacatactacattctactcagaagtggaaaccaaatgaaacagttaaagaccgcgttttctacctagagcatattgtttctcctctattcattgtgatttcccttctttgacttcttggtttatgactttgccacctaccagtctccagtctgaaatggaacgctgtgctagggcctttggctttggcaagtctgggtttttcactacctgggactggtctaagcctgatttgcattccagtgttgcattcatttttataggaccaggactaaaacctccagaggaacggacaatagaatacctagaagaagttgcaattacttttgccaaaggactagctgataagaagatctctccaaagagagacaagggattggtggaaagtgagtatcattgttaaagaacaaaggcaaagcttctttcctgagaatttaattttatttgctgtagattcaaaatgaggaagtggtaaatgcattatttactcaaagcataaagtcagccttaggtaggagatgtaacaactcctcaactttacactatccagttaaagccaatttttaaaaccttttttttccttatgatgacccttgagtcatagaaaacttttcattttagaaaatgttaagcatgaacacaaaaagactagataacagtgttataaacactcatgtacccaaggcccagctttaacattcatcacttagcatgtttaaggtagtgcttaggttgaaatttatattgtgtgtatcagaataaagagcagttcttgcagatagctagaattacttcatttttatagagtttagagcataaactaacaagggaatctaggctctttatagtaaatatctaaaagcattttattttacagaattgacagcgtatgccatgactattccatttgtcaggcaacaggtttacaaaaaagtggaagaaaaagtgcgaaagcagactaaaggcctttatcctgcacctctgaaaataattgatgtgagtcttacccaatattcccacttttctcatatttccttcctttatatagatcactcctccttattgccattctggaccatgtatgttgagtactaaatttcttaattctgctattaaagtatttaccaaaaataagggaagggcatagcaagctgtaaggactcatataaagtgatatatttggggaaaatcagtgctggacttactcattgattgatgcagttaaatgtatcagtaacaaaccagaaaaccaggaaaggaacctaagtcatatcagtatcacaaagccattagagtgtcaggcactaaccaaaaagtagttgaaacaaaattgatggctctgttctattcttggtcaacatcattgtcagtacctaaaatccctcaaggacttcttcattgctgtaattataaaaaagatgtaatgatgtagagaagctctgcaaaagatcaatgagaataattaaaatgatcacaggattcaagaaatctccaacagtagactttaaaacttagaacttttcagtgtggaaagtccaagattaagagagtatataaccaaagacttcagaattggtgaatgggtcagtcagcaagtatatcttgagtagaaggcaccaaagcacataaaatatgaaacatgcccccacctgccttcgtctcacaggctggactggggaagttagatatatatatgtgttaaggtggatagcctttaagagatataaggcagcataagattaatgccagatgagtgggacagaggaggcaacaattaccatgagacaaagagatcagtaagtgcctcatgggatctgaccccaaccctgaaagctgggtggaggataggtgaaggagggaaagtattgccaaggagggtgggcatttagagcaaagttatggaagctggaaaacaagctcttcaaggaacattagtgagaccagtatttgtgggggataatgagatgttagtctgaagaaaggcagattgaagctggattttagaaggttggtaataatgaattgagaaattttacctttgtccgataaagattctagagagccattttcatggtagtgggtaaaaatggtttcgaaggagagacaaagtagagcagtgaattagcaaaactgtcctgataatccaggcttgagctttgaataaggccctgagatagaatagtaaaaataggaaagcagcaacaggcttgccaaagagaggttatgagttaggttcagatatattgagttcagatattttgggaaattcaagcaacagtagtttagacagagaagtcagagttagagatgtcaatttgcttatttctaaaaatttgtcattctcataaattatgatagtgagtaagtacagggttatttttttcatcttttatatttgccattgtacttaggatagtacttaccccaaatgttacattgaattttgtagagttcattaatgtgataaactaggtcatgcatctgagggagaaagtgtagagagtgaaaagggctgaaagtggaagttgaggatctgcctacatttgaagatcaggagagaagccggaagagtaattcaagctttgtctttccttctcatggccatgttatgctagatttagcagtagcctcaaagatggagaattaagtcagtcgagagcagccagatcctcagtcctcttctctttctcattccagtctagacttttgacttactctttgaggactaacaacactggcaattttattcagcattattgtacatctcgccaatctattccaacgctgagcaagtgctttatatgttttttaggtggtaaagactggaattgagcaagggagtgatgccggttatctctgtgaatctcaggtaaacttatttcctttcaatgttttattatcagttaaaggaaaactaaagatccaatcctctgtataaagctgaaaaaggaaaaaaatatccaaagcctagtaaaaatttttttcttccagtgcttatcatctcttatgattaatctcagtgagcaagtggatgctaagaataccctaatggggccaggcgtggtggtttacccctgtaatcccaacattctgggaggccgaggtgggcagatcgtttgagctcaggagttcaagaccagcatgtgcaacatggcaaaaccccatctttacaaaaactacaaaagttagccaggcatggtggcatgcacccacagtcccagctacttgcagggctgaggcaggagaattgtttgagtccaggaggtcagggctgcagtgagctaagtaagatcgcaccactgcattccagcctgggtgacaaagtgagaccctgtctccaaaaaaaaagaaaaaaaagaaaaaaccctatggtctgcagatgtttgaacttacttttagtaataaggttgtctctacgaagggcaggaacagagttctaatcctttcaaaacaagtcacttgggtgttttttgttccgcacttgggcaggttttattgagacaaaatgaatacaaagacagaaaaatatttttcttacatgttaaggcctagagatgatgaaattgaattttttggtaaattggaaaaggaaaggaagtatcttgtacccactaaaagacgaagacagaagagatgtatgtaccagctttacctgtgtacttttctagcaacttggtgatgttgcagatttaagtgatttgtgtttgtttttaagttttaaacgatcatcgaagaatggttgctcttttataaagttgaatatctcttatccaaaatgtttgggactagaaacatttcagatttcagactttgtcagatagtggaatatttgcatatatatgatgagagatcttgggaatgggatcagagtctaaacatgaaattaatttcatatacaccttatacacatagcctgatggtaatatcatacattatttttaataatttttcacataaaacagttttgactgcagctcataacatgtgtaatatcttgcccatgacatcatgttggcactcaaaaagttggattttggagcattttggattttggattttcagattagggatgctcaacctgtaaaaggacaaaaaaaaaaatctgaagagctcaggacaagtaccagaaaaacacttctggtactagatgtctcattgggcatttctgattttttaaaaatataaccaagtgcacataaacatacgtacagaaaaattgaggaataagtttcacgaatcagtaactgtcctgtgtgcattgtgctcagtattttctgtgtattccgctttttatatatgtaatgcttattggcacccactaaatttctgaccattgatgaatcttttgcccatgtttgaaaatcactggtttattagataaaacatcctgtatcaagattagtaaagcattgattgtgttgtcattttatgttcttttgggtcatgaaagcaactttattagagggattcttttgaaatgctctttgtaaccatgcaatcttaccattatatcctagtgatattaataatagctaaccttgagaccctggtcattttactagtgttctcatttaatcccccagaacaatactgtaaaatgggtattgtttttcccatttttaaggatgaagaaagcttcacaatggggcagtggcagagacaggatctgtcaaatcctagatattatgcctttaaccaccaagttgagactttttctccataaattaagctacttttaaaagtggtaagtcccacgtgggcagcctgctacagtggaaaaagaaccggagttcgaggcgaggcacggtggctcacgcctgtaatcccagcactttggaaggccaaggcgggcagatcacgaggtcaggagatcgagaccatcctggctaacacggtgaaaccccatctctactacagatacaaaaaattagccaggcgtggtggtgggcacctgtagcgcagctactcaggaggctgaggcaggagaatggcgtgaacctgggaggcggagcttgcagtgagccgagatcgtgccactgcactccagcctgggtgacagtgcgagactccatctcaaaaaaaaagaactggagttcagagtcatactgtcttggttcaagttccatttctgccactttgaggcagtatagccttgagcaaagtcactccatttctttggacctcctcttcccaatctgtaaaatgagagggttggtttgagatgattgtggaggctcattttggccctgagactctagttttatgaaaaaggttaccacacctctggtgtaaagaatctgagagcttagttatatccaaaactttcttcaacacagtagttggaaagtgctccagataagacaagtaaagacaagacacatcagtgagagacagacttctgcagcactgaacccccaaactcccccgcatccccagggactcaggcttcacatgcattacctctgctcttcagaggaacctgaactgaaggaatccatataacctagactgtgaagttctaccttttctcattcccctttacttttcagaaatttggagagcttgtaatgaccaaagaatcaaaggccttgatgggactctaccatggtcaggtcctgtgcaagaagaataaatttggagctccacagaaggatgttaagtaagttaaactctacgtaggaagcccttgtgaattttactgtgtgcaaagttcacagaggctttgaagatctacagagctagatctgtatcttaattcagtcttgccctcaacttctttcctgagcacatttgagcccttatgtctactaaaaactttttggctttcaaagttctgcctgttctgagttttttccaaacccctctggtcattcctatagaggctttcttgtcacatattgatgttgcctagaagtctggtttaggtcccccttcccaaaccacacactccctctgcactgttcaatgatcatctctctccctgtgatttgagatgtcatctctgggaactcacacttcttcctcattaaaaaacataaaacctcattgtaattgttaaaatcttgtccttcttttagcttacaacctaagtattggaaagtctgtttgcctctttcatgtgtattgccataagccagcctttttccatattacgctgcctaatagctcttcagagtctatgtttaatgatgcaacttgtagctctgtggttctcagcgtggacaattttgcctcccagggggacatttgacaatgcctgggaacatttttggttgtcacaactagggagggagggatgctactggcatctgtgggtggaggccagggatgctgctaaccatcctataatgcacagatagtccccaccataaagaaatatccagttcgaaatgtcagtagtcctgaggttcagctgttctagctgaactgctgtgggggatttaagagaagcagctaatgatactgccttctccatcctctcacctttaatgagattacaaatacaaaatacaaaataaaatggataagaagtccgggtgaaacaggtaagattctaaccaagagggctgatttccaattagaatctgaaatacaaccttaactgcttctctcaaacatttagtgactgctatcaatcccatctgaagagccaattgcatttgttccacctaaccttgatagtaccttgcattcgatgagcagggtaaattacttccatgttgcaggaggaaaattatggccacttaaacctgtatctctttacacattctacaaaaatcaacagattaataaggaaaacaaagccacccattccctgtgcacggcataaatagaaggcagagaagcatcctgcaaaattacaaaacctagatacaccaacttctacccctccccaccgtatccctccatgtacacaaagaatgctgtcaattaaagaaactgcactttgcaacagaagagggtactcttaaattaaaaaacctagtgtcttaatttattaactccagactcctcctgcctgagcatttattgtcgtatggaggtagtatacatctccatgtaacaataaaataccccttggaaaaggtggtattgtgtagtcagtatgcaaaaaagaaagacagcacccacaaaaagctaatataagaaaaaaagagaaaatgagaatcagaatactgaagtttatgaaaattctgtcccccaaaaaacaaccacaatgcagaagaagactataacagaacttgatttaaatattcttaaatcagcatttgcaaatcagaaaaaaaactgccttgaatcaaaaattcaaaaactcagaactaaatgggcagaaaaacaggataaatataggagttgacctaacttgggaaagacattgaagaaaaagttagcatcatcttagaaatgaagaataagctataagatacccaaggcaaaatatgttaaactgaaaattgaataatgaacattgtagatagggtgtcccccttcctgctttcccagttatcagtaattcttccactattatttctctaggccccttcccccttgccttggatgataactggaattccttatctattgtctctttacaaattaatctttcatatgaataacgcattccatcagttctaataagtgaagagcagtacttatgaaaaaaaatactgagctacaaattagtatacagacaaggtaccatgttatgcattcctcaaatcacaacatttctgtgtaatcaaccctcaaaagttcatgtcacccagcagttggcttataaagcatcgtgcaccatagatgttagcctgctgggtaattacacaagtgggtcatttcaagggtgctgaagatgtttattagaaggattccgtagattgtgaagtgtgttaatttaactctacattgttgtagacaaatattaaacaactataaagccatcatgaaaattttggtgttaatgaagcggagcataacagttaagaaatgagtaatattttagctgtggattctgttataccaaaaaagctttaaacacagttttagattttactattattgttattaacagctaaagttaacattccagcaaatgccctcccaccaaaaaaaaaaaaaaaaacctactaaataatgcattctttttctcctttcaaaaaaattatcataaataagattataagatactcttttgtgtttatgggattttttttgttaggggaaaggggtgggtttgtttttttagagacagggtctcattctgtcaccccggctggagtgcgatggcataatcacagctcaccataaccttaaactcctgggctcaagcagtcttcccacctctgtctcctgagtagctgagactacaggcacataccaccacacccggctcattttcaaatattttgtagagatgagttcttgctaagttgcccaggctgatctcaaaattctggcctcaagcagtcctcctgcctcatcctcccaaagcactacgattataggcatgtgccaccatgcctggcctatacttatggtatgttttaacataaaaggaatccttctgtatggatcctgtagcttgcactttttactcagtgatatgacttggagatgtagattagtacatatcaggtaactccttccttttaatcccctgttgacgaattactggctgttacaatttttcattacaaacattattatatagctgttcatcacagcatgtcatcttgtgtataagtccatctctgtaaagtagataatgacgagtagaattactatgttatacagtatgcagttcttggttttaacaaaaccaaagaacccccccaaaagtaggacaaagtatacttccgtgaaccatgcatgaactaattttttgtacatcctaactgatactttaaaatttttggccaggtgtggtggcttacgcctgtaatcccagcactttgggattccgaggtgcgtggatcacctgaggtcaggagttcgagaccagcctggccaacatggtgaaaccccatctctactaaaaatacaaaaattagctgggtgtggtggtgggcacctgtaatcccagctcctcgggagtctgagacaggaggatcgtttgaacctgggaggcagaggttgcaatgagctgagatcgcaccgttgtactccaccctgggcggcaagagtgaaactccatcttaaaaaaaaaaaaaaaaaaattgccagtctgatgcatctcattttaatttgcattgccccagttattagggaaattgaacatctttttattattattattattttcataatagagatgaggtctcactgtgttgcccaggctggtttcaaactcctgagctcaagcgatcctccctcctaggcctcccaaagtgttaggattacaggcatgagctaccgtgcctggctgaaattgagcatctttactgacaatttgttttgttcttttatgaattgctttatatcccttgcccattttatttcgttgtctttttaaattgatatatgcatgttctgtttttccagtagtatcctttgtctgctgtatatgtcacaaattcttcccattctatggttgtcttaattttgtgggttcatttgtcaaacagaatttttttttttaaaaaaaatggagtctcactctgtcacctaggctggaatgcagtggcacaatcagctcactgcaacctccgcctcccaggttgaagcaattttcctgcctcagcctcttgagtagctgggattacaggtgcacaccaccaaacccagctaatttttttatttttgtattttggtgaggttggtcttgaactcctgaccttgtgatctgcccgccttggcctctcaaagaaagagctgggattacaggcgtaagccactgtgcccagccaaaacagaaatttttaattttgatgtagcaaatgtatcagtcttttttttcagtccctattttttgtttctctactgtattttctcattgtcctgcaattacttatcactcaccatataaatatttgtaccattacaaagctgcatttagaagatgctcctaggacttgaagttagatttccttttcaggactttagtatgatttttgaacattacaatcagaatggttaagaatgaaactttatccctcatttcaactctaatttggataacagtgctgtaaacttgggcttcttttatgaagagattctttaaaaatttttcttagttatttactatgggaatatggcaaattattccagaactatagggaactaaaatgaataagcagatatgatctctggtcctcaaaaggcttagaatttaattgaggagacaaataatggacacgaagccattccaggatactctggggtaaatcaagtcgtcctgagaagttctagaggaattcaggggcaaaaaaaggtagcaatgtgcatatgtggaagtgtttaaggaagggataaggtctggaagcaaagagaccatggaggagactttgaattcatccagacgaggagtgataaaggcacagattttgggggaaatgaaagattacacgatggctcacacctgtaatcccatctctttgggaggctgatgtgggaggatcatttgaggccaggccaggagttcgagaccagcctgggcatcatagtgagaccctatctacaaaaaaacttaaaaattagccaggagtggtgatatgcacctttagtccgagctactcaggagactgaggcagaaggatcacttgtacccaggagttcaaggctgcagtaaacctaggattgcaccactgcactccagcctgggtaagggagcaaaaccatgtctctcaaaaaaagaaagaaagatgactggcagatagtcaaaatcactaacaaataagttgttcaataagaaaagaggttggtctttttgttcgaaaaacaaaaatactcatgttgacttaaatgtaaactggttgttttgatttcagtgatttcgaagcatgattgaagattagtataattctgtcttcttgggtagaccagttcttttagacctggtgggtttttgcacttaacttttaagatcaatcatttattaaagctgtgtttttaataaataaaaattatttgaaacaccttatagttgtgcctgcattagttggtttattgaataacttaggcaatcttccactttgactgaaatgattaagatcagtttaccgaaagtcatttcatccttgccttgcaggcatctggctattcttggtgcagggctgatgggagcaggcatcgcccaagtctccgtggataaggggctaaagactatacttaaagatgccaccctcactgcgctagaccgaggacagcaacaagtgttcaaagggtaagcctgctctctctctttgcaagagttagaatgtcctttgtttcttggttagttgttttttgtggtggcttggtgggtttttttgtttgtttgttcttgccatcacggattcctttttcctgaacataatgagttctagatactccgtagtgaagccaagtttcttttgatttttagaaatgccaattccttctttgacttcgttttgttatagatatcatagacaattaacatccttggagtctgtagtctttgaatgcagaagggaaaatcttatctagtagatacttgttaatgccattttacactttcgtatcaggcctgcggattttgatatagtttgcaggtaattgctctattgttaaggattattcaaacagcatgactgtctctgttgagaagactgagtgaggttaggatgtaaggaaatgggcagtaactgcagggggaaggcagggccgggatcaggactcttcagacttttatttcctgactggcattacagagagaagccatgaactgatccctccacagtgtctggggctttacagactatctccatcttacctctgaattaataaagggggaatattattccccttcctcaccacctgcctctctcaccatcacacacatgctgcctgttttgcagaggggaaggtggagcagcagcttggccaaatggagggttggtttgatcagttttctgctcacatttaatggacaagctggctgcacttaaagcatcctgcatgtgacttttagctgagtgagcttttttgtttcttaaatggattagatagcttaagcatgttgttatcccttttctgcagagaagctcacatattgctgccataatgctaaccaggacctggcaggtttcatcgtgttggcagattattgtaagataacaagttgtagtagaagattctgaccaaaaaaatgatgtgtgctagatagcagcagtgccctgaaactagcatgcaagcatcccaaacagcattccataccatcaccaaagtaagaaattgttgctctaaaatagtttcctcccccagtctctcttgaatagtgtcctgggttccccttttcgtcttagaaacatcaggttctggcgagtgccgctcaccacactgctgacttgggacaatagttcctgtcctctcttgggaatagtttaatcaggcattagaattagagcaactgataatgttttgaatgctgacaagtatcttgtttgctgactgctgtcatgattgtcaaaaacaaaagctttgagcccatacttttaagaccttatttgatgtttttgtttcttttgagacagtctcactctattaccgaggctagagcacaatggtgcaatcttggctcactgcaacctctgcctcccgggttcaagcgattctcatgcctcagcctcacgaatagctgagactacaggcatgcgccaccatgcacagctgatttttgtttttcttatagagacgggatttcaccatgttggttaggcttgtcttgaactcctggcctcaagtgatccgcctgctgcagcctcccaaagtgctgggattacagatgtgagccaccatgcccagcccttaagaccttctttgaatactcctttgtatttatcttgtggccttaattttgcttttggttaaggaaattagtgaatggggtttagcttcattcttcatttagaggaaaactgtaggtaatttattctgaaagtgtggtcagacggaatctaagagaacctgtttcccttggcgacgaaaaataatcagttgaatgtctgaataacaggaatccttttctgctccctatgggaaaaaagaaaccttgagttaatattttatgtaatcagtgcaatgtgctactaggtaatgagtgggaagtagatggagaatataggaaataatgcttggtctctgttctttagaagattacaaccacaggctgggcgcggtggctcacgcctataatcccaacactttgggaggctgaggcggatggaacacgaggtcaggagttcaagaccagcctggccaagatggtgaaaccccatctctactaaaaaaaaaaaaaaaaaaattagccaggcgtggtggtgggcgcctgtaatcccagctactcaggaggctgaggcagagaattgcttgaacccaggagacaagaggttgcagtgagctgagatcacgccactgcactccagcctgggcaacagagcgagactccgtctcaaaaaataaataaaaaaaaaaaaagattacaactacagaataacataaaattatatatttgcgataagcaaatataaaccatgtggtctcagacacactttggctgcttcccctgtcataggtagagaattaccagaactcctcttttgttttgccattctagtattcatgttatttactcctcttggcaaatttaactggtttaagagtgatttagtttacgtaaattgggcatttggaggcattctatggtagaaagaatgtgtacttgggagttaacatgtctttgaatgctagcaccctcccttatcaagctatttgaccacaggtccctctaagactaaacaacttgaaagtctccctcaaaatgggagtaatagaataactacctcacagagttggtgaaaaacacaggtgtgctctggcccatggacattcaataaacgttagtttccttttcttcccatctaactaggaatgtgttttttctagattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtaagcaaggggctgttgtacttgaatcctagtgtagtgaacagaaaacacagagattttttttttaaaggagctataggaaactcatgattgcttttataaaaaggactattcaaaggctgggcatggtggctcacgcctataatcccagtagtttgggaggctgaggtgggcggatcacgaggtaaggagttcgagaccagactggccgatatgatgaaaccccatctctactagaaaatacaaaaattagccgggcatggtggcacacacctgtagtcccagctatttgggaggctgaagcaggagaatcactggaacctgggaggcagaggttgcagtgagccgagatcacgccactgcactccagtctgggtgacagagcgagactccatctccaaaaaaaaaaaaaagactttttgttatcaaacgttaagtttttatgtgtgctcatgcacactgcatatgttataaaggtcaaatctaaattctaaaggaagaaaatgagggtgcgttcaccttattcatgtaggagctctgtcacccaaacatacagataacctcacagagtatagccagatgctttgagattttttggttagccgaaagccaaaaacaaacctcttcaggtctaaggctgcaaaggaaatagggaagacagttcgtccagatgcttgttctgtggaaatgctgctttggcccagctcccaaatgttctccataggcacttcttgagatgggctgacatgaacaaaacaagtacttgaagtggggagtaggaagagtaagccccgagaaggagtaatagcagtaattcagggatgaggtaggaccaaggcctaagctagtctacagttggataaacagaatgtgggttactgaaaggtgaacatgaaatgattctgacttggcaacatgctggatataatgagcagtgagctcattacaaaaaataagagtaccacagagcaaaactccgtctcaaaataaataaataaacaaacaaacaaacattatcttctcttattgcccatagagctaacaaaacccattccttggacaatcttccacaggcatgatctctagaccaccccgtttcggttgtcctctctagtatcttcctcatgtctccgtgttctactgctgtgtttacaactatcttttcacaattctgcaatctgggcagggctctgcagagacagtggtgcttaagtccattgatttcaaggctggggtcactcctgggctgcattccgcaggaagctcggttggggcacctcactgcttcccccacatctctcatagtccatcctcacttagtcgtctcaccacaacttctttgtagcgtggctgcaggcttccaagagaacaaaagcagaagctactgagcttcctaagtttattgtcaggaagaaaaaaagataaataatttaaaaaataaaaaaagaggctaccgggccccacaggtctaggtaggcctggaactggcagggtaacttctgctgcattgtgttgataaaaacaagtcacaagaccagcccagattcaaggagaagggaaacagactctacttctagctgggagaaaagacatacatgtccaaggaagggaagaatgtttgccagccagctttggagacattagtttgctcttcagaaaggatttcaccaccagcattagacactatattactaagaaagtaacctgacactacgtaagctttctgacagtcatgctgtactgtcaattcattccacttttgttttgtttttttgttgttagagacagggtctcactctgtcacccaggctggagtgcagtggcatgatcacagctcactgtaaccttgaactcctgggctcaagcgagcctctcacttcagcctcctgagtaactaggactatgggtatgtaccaccatgcctggctagttttttaaagttattttttgtagggccgggcactgtggctcacacctgtaatcccagcactttgggatgctgaggcgggtggatcacgaggtcaggagttcaagaccagcctggccaagatgatgaaaccctgtctttactaaaaactacaaaaaaattagccaggcatggtggcaggtgcctgtaatcccagctactcgggaggctgaggcaggagaattgcttgaacccaggcggcaaagcttgcggtgagctgagattgcaccactgcactctagcctgggcgaaaaagcaagactttgtctccaaaaaaaaaaaaaaagttatgttttgtagatatagggtctcactatgatgccgaggttggtcttgaactcctggcctcaagtaatcctccatccttggcctcctgaagtgttgggattatagttgtttagccaccatgcccaccctccactcttgattaactaaaatcatgggatctttatcacaaatactgccaagccaggtcttgtccttcaagtacctatacagttcttttctttccttttttttttaaatcttaaggcagtactttacttttattgcattataatcttattttgtactcagcttttcagtgtgttgaatgtgtcttcctccttgattctcatctctgttaggattctgcctgttccagatttgcacacatttgacaggtgtcccttccacgtttctcatccaaccatctgaataaaaacatgaataactgggaggcggaggttgcagcgagcctagattgcaccactacactccagcctgggcaacagagcgagactctgtctttaaaaaaaaaaaacaaaaaaaaaacatgaataagttgggatcgtggccagaatgcggagacaatctgcattagagactattctccaggtggataaagctaatagttaatagtatttgtgtactgtagctgcaactatagtggtatgccgttttttagtaacacactgtataaaatgagacaagcatgcacattttggcttgttcttataaaggtgaagcggggagtgattcagggcagatccaaacaaaagaggaggtgacacccatgctgggtgttgaaatcaatgaattgcaattcaaggccgtcttttcagtgttgttctaagctgttttattgacccaactgctgagatgtagtctccaggtcaggataaggtgaccttatgatgggccataactagaggaaggcagaatgggaaaaggaacaaggtcaacatattccccgacacaaaaccccctaggtgatccgtcaatgtctgggtgagtgacatctactgtctgagcagttgtgggggacagagtgggctgggcccaggtgtcactcattagctttgatgtggcctctaatcatctcccaggcctacctgacacattgttaaatgcttttcccctgcaggtgattccagatcactgtatctttgccagtaacacatctgctctcccaatcagtgaaatcgctgctgtcagcaaaagacctgagaaggtaaactcggaacagagaaaaaccctgagatgttttattgcttcagattcactgataaaggcttacagcttgagtacagaagagacagtggattacggagtggatgcgggtggttcctaaacactggacacaataaatgctaataccatgactagtgtgagatgcaggagtaagttaagtacaacaaaaaatatccttttcaaggatcccaaatgggcattatttttcaggttcaggatataaagcccacctgtatcctagaattaggcattgaaggataggccttaagaaaggatgctccaaaataccagtttggctacagagcagagtcagtgactgtttagaacaggtttggttccacctccagatcagggaatggcaggaatggtgggatgtgtctgcccgtgggtttgcttacaccttctaccccgggacatgaaagggctgggtatagaagcactttctgtgagtatttggaatgatgcccagaaatttatttttgctctcaaccagagtaattaaggggaagtgaaatcattcaaagagaagtaaaacaactcacttctctggaggataccagttagcctctgctaaccagaaccagccgaaggtaggcaggaattataaaagaactttaagcagctgaaagtgttaatacaaattctatgtactgaaaacacaaaagcctatttattcctactcttctagcttgctaatgcaaggtaatctagtttcctagcacacagcagattagaagtgatgcggggacctgacagaggcaggctcaatgatggcaggctaaaggtcatagggagaagttgcagccgatagtctacagatggacagtctggccatgtcatatcactcaagacatctgtgtggcatctaaaatcagtacaggcgatgccgttgctgttcatttgatggtaacctctccccgccatcggagcagagcaagcatcacactttgcagttctgccctccaagtatctaggacagcttttctcacctgcttgccttttgtcattcatttaaaagtaaggccaaaaagacaaaatagggtgaccaaccatcttggtttgcccgggagcaagggatacaggaccctcagtgccacaaattgggaaatccccagccatccaggatgagttggtcatctttggcacaactttctgagtgatgtaaatatattttgcttgggttagtgattatatggatgtatatacagttgtcaaaactcattgatgtgaacacttcaagatctgtgcattttattatatagaaattctacatcaataaaggctaattccttttgctcaggagtactgagtctgaatcaggtcctaagtatttcagatgtaagtaaaagaacactttaggggttagaaacaacttttggattgataagtttacataacatttacttgatctgtgtattacataatggcattggagatagacagacctgtgatggaatcccaccccgtcatatgctgactgactctgtactactaacctcttgataccttttttcctcatctagataattaggctgaccagttcatagggttgtaatggattaaatgtaaggaataagtggtaaatgtattgaagagcaggtagataatgagcagccaaaaattacagatatcacttgttgtaccttatagctaaagtgagagggagaaagcaaaactataaattaatgaattagacttctttcaccacagttctgttgggaagactatgtaactgttagctcaatgaggggtttctctgaaaccttagcacgcatcagaatcaccaggagggattattaaaacaaatctgggccccacccatggagtttctgattcagtagggctgggctaggcctgagaatgtgcaggcctaacgctcccaggtgatgacagtgcttgttgggtccgggtactacacttggagaactgctggtttaatgagtcttaagtgcatctgactgttgaggagtgttagttaaacctagtatcctggtggtgagacccatctgtgtaaaatgcaaatacttctctgacagcccaacacattaattcttctgcctgccccacccccgcccaaaaaaactggatcctcttatctaaaccatcagtatcattaatataagtggaaccttcatccgtcgttccccaataaatctagtttggcctcgagctgtggttttggcactgattgttgggaggatcagatgtctgtagtgaaaaaccttagaagcaaatggaagaggaggattccaatgtgctctccctaaacatactaaacttttatcaaagacccatggaaccaaaccactcagctatgtcaagcagtattcctatatcacagccacctttctttctagtgttttcctagcagagaaggaatgctctcaggttcctcacccgcattctccgatctgttggcttttggttccccttgccaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggtaaggggctgtataacagagctgcagagtttttgaaaagttctaataagactccttttacctccaggcttgtttataaatattctggggcaaatgaccagactttgatatgattttcccctgggttgtctccaggatggacggtggtattgactgtcccactgagtcaaggtgggagtggggagtatctaggatgtggcagggttctcccagccatcccagaccttgaaggtgaccatgaaactatctgctgtactgtttgattcaagccaggctacccctagtacggcttcccctgcaatttcatttttaaggattctgattgagattttaagtcaccttaagttttacagtgactttcaaatgactttgaagtgaccctgggaaaggtagagtgtttcagactcagtcccagcagcagggccagggagctcatgttctcttccttggcaggatggacctggcttctatactaccaggtgtcttgcgcccatgatgtctgaagtcatccgaatcctccaggttggtattgctctccagagtgtttgcggcatcttccactccttcagtcactctaaaactcatgatgtcaagataaggaccaagcttccttctgatacaccaactcctgctcttgtctaggaaggtccctggtgccctctctctgcacagcagtcggaagttgggcttatactgcactgaaaggggcagagctttccctctgccccacagcctcctcactgttccagcaagctaaaggcaccccaccccccagcatgtcttctatgctgtttctgcacctctctgaggcagggaccatccagaacagggcccgcttggttcaactggtgctgcatctgtttccacagcacacagacctctccagtagccatcgaggtcattctggcaggaaaggagagggatcctcctcgctgggcacttacccagacttggggatcacagggctctgagtgctcctctttgatgatgtttcttctgttggtcatgacacactcagccgtctgtcatgcaatctccttattattgagattcagaaatgcaaacaagaagaaaatgaagaatttagtcatctctaaacgtccttaaagtgctgtagattagagaaggctcagactttccacttgtggccccaaacttctttgtgcttccctgaatgaaatagcaccagtcctgggcctggtcaggtgacactcagaagtgggttttacacaaggcagtgtttggagccagtacagggagccctttggggggatttgggctgcccttcccctgaggtccctgcatcgcttcctgttcaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtgagtagcctcaaggaaacataactagcaccattagttacaaagttctaagcagttcctgagaccaaagagttacagaagccctcgtggaagaaagttttctaaacacagagcccttatcactggcgatttcaaaaatgattttatgagtcaggtgcggtagcaaccacttatggtcttagctgcttaggaggctgaggtgggaggatcgcttgagcccagaagtgtgaggccagcctgggcaacatggcgaggccccttctcaaaaaaaaaaaaaaaaaaagatgtcatgtgaaccttctaagggctaggactatagattatggacaaaaggcagagttctacccttctggggctctagcatcacctggtccaagttatgccagatggacaagcatttttatcccccagagatgaaatctgcaatagtgcagaagcaagctctgcatccgggctttaccatgctgtctggccacctgtgaggagaatgtataagctcaccatacacagtatacagttgaggcccacagagaagtgactttctgtcttggcaaaacagcaaaatcagcattacaacctgggtgttctaggacccggtgctgcatatggggatgttaaaactcacccaggtggcctttctcatccatgtacacagatgcccaagctccgggtcacaagatcttctttccttctctgcccactcttctgacaaagactaatttgctagggttagctagacatacaaattcaggaattcagaagaggccagagctttataatagaccaacagagacaagaattctcaggtcagggtcttttttgtttgttttttgtttttttttgagacagagtctcacactgttgcccaggctggagtgcagtggcataatctcgtctccacctcccgggttcaagcgatcctcctgcttcgcccagctaatttttgtatttttagtagagatggggtttcaccatgttggccaggctggtctcaaactcctgacctcaaatgatcctccgcctcggcctcccaaagtgctgggattacaggcgtgagccaccacgcctggccaggccagggttctgagaacaaatagtaacactccctccctgagaacaaatagtaacactcccttttcttgcctgttttaggtcgtaaatctgggaagggcttttacatctatcaggagggtgtgaagaggaaggatttgaattctgacatggatagtattttagcgagtctgaagctgcctcctaagtctgaagtgtaagtccgtttgagtggctaatgcctggaaattgactttctctgacagcccaaagcttcccagcccctcttccatttttttttttttttaatactttaagtcctgggatacatgtgcaggtttgttacataggtatacacgtgccatggtgctgtcttccattttctttgtgaccaccatacctgaacaggaggaccactcctgatgctggcatggtgctttccaagtggaaggccctcgcacgtgctccttggtctctgcccagcatctaggtgagaaccaggccacgtctggtgaaggccctcccctgctccagccttctctggcaagttcccagagagccgctggaaggacagattctccttggccccttcaccctcccagatctttattatcatttgtgagcagctgactgttgctgatgtcaaagagatactgattatcttctcggcaccaggccctgttctaggtgctcagtttcatgttaattagggcaagttactctccactttttccatgggaaagtttggttcacccaggcagcatcttctctgagggccagcaccaaccggcccacagagctccccatgcacccatcccgacttccattctgcatctgcggctctggctttcctccccttttcctcttcttctacctaaacatctctttctgttggcagctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggaggttggtctcgcaggttgggaaggaagctcactttagcctggagcccgtgttgcgtctccttcaacgaagtcctctttctctattcagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctgttggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 37012 - DNA, 43203 bp, Homo sapiens
agatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcggtaaggacgggcctgcggcagtgggcgggggcgactgcccctgctgctggggagagtcgttgctctcatcggctgggttactcggggacaggctccactttcttttatagctcctacctgcccttttccatggctctcatttgcagttacattaatgagcgctgtgctgcgtggtttacgtggatcatttacattaatactcaaaactgctcgattaagcaggtgctgttcttatcgccattttgcatatgatgagaaagggtaaggtcacccagctagtatttggctcacagcaggccttaagacttggtttgtgtgactcatcagtccacgctcctaaaaccactaagttgttctaccctttaatgttgaattaacattggatagtgttcaagtttagatgggtgggtgagggcccaaggacctttcaaactcagatctcttatttaataacctggtcccagatccattcctctgtcgaagaggaagtcatccttcagtggctattcattgtggggttaagagcgcagactatgaattcagtctttttgggtcccagtttgccagaccttgagtgagtgccccgagtttacttacttgtaaaggtaggtggaggtaatataattaaataaacttaaaaaactaattaaaaacaaaacaaatgaactaaggtcttaggatatctggcgtctattttgcgccaaatacacataatgtctattgttgtgtgttggactataggattgtcctttaacagggaaggttttatttctgtaatcaagtctgtcaatattatgaccatgttgataatagctacctttaattgagggcttaccatgtgccaagtactaggtgaagtttttacctctgttttcactgtgccagtcactgacttgtctaccagggtgaaattgttcatatttaaagaaggaataaactgagcaggtaggatgttaggagttggcagaggctagagtcccggtgttcttcattttatttcgaagtttgtactaatctctgctctcttttgtatttcagtcacattagcagtaataggaaggtgttttcagcgacagtggggatgttgtggcagagagggaaatatttgaagtccctaaatgtggaggtccagtttaaaacttgtcaagattaaaaaaactgtttagagtgagaccgggcgcggtggctcatgcctgtaatccgaacactttgggaggctgaggtgggaggatagcttgagcccaggagtttcacaccagcttgggcaagatagtaagaccctcgtctccataagaaaaaaaaaaaattagccgagtgtggtggcacacacctgtaaccctacctacttggaagggtaaggtgggaggatcgcttaagctcaaggaagttgaggctgcggtgagctatatcacgatactgcataccatccagcctgggtaacagagacccccatctctaaacagtaaaaagaaaactaaggctgacttaaaacaaacaaaaaaaacagaaaattgtaaggtctgctaactcgctcagagttcacctgctggatatggcaaacttgtttacctggtgtgagaccattggagtatgggttctcgggccgtgtcaggaaatggcatgtatgcagactgattttgcagttctgcacatgcgtagctttgccatagatccctcaaaagatagaaggtaaccagtccttttggtcagtgttggaactggtttagagtggtctgttcaaagcaattgataagtaagtttatttttgtactctattcccagatgtatgttaaggatttggttctccaactgtgaattctcaactaatttttctggggctcctctttaagccactaacatacattcattagtcagttgcaataaatgccttaagtttatttcttagcagtaggtgaaagcttgtgacaacttaaaataaaacaaacaaacaggtatttaaggaattttactgctatgtccttcactttgaatatgttggttagtggaattaactctgattacccaacaagatgatacagaattctatagtagtttgaccaaagcaagtatttgtcattgttaacatttcaaatgggctgggtggctataatcccagcactttgggaggctgaggcaggccgattacttgagcccaggagttcgagaccctgtcctacaaaaaaataaatgagccgggcgtggtggcacgcacctgtagtcccagctgtgaagaggctgaggcaggggaggaggaagagcacttaaacccagaagttcgaggttgcagtgagccacgatcactccactgcactctagcctgggtggcagagtgagaccccgtctcaaaacaagaaaacttctgtaaaaactcatgtaggccgggtgcggtggctcacgcctgtaatcccagcactttgggaggccgaggcaggtggatcatctgagttcaggagtttgagaccagcctggccaacatggtgaagccccgtctctactaaaagtacaaaaaattagtccggcgtggtggtgcgcacctgtaatcccagctactcggggggctgaggcaggagaatcccttgaaaccgggaggcggaggttgcagtaagccaagattgcaccattgcactccagcccgtctaaaaaaacaaaaactcatgtaaaggccctttgttagattttacaaataacacatatgtgccttgaggcagcattcttttttttttgtttaatgtgtgtgttagaaagcttgaccatgtttgccaccgccagtgtctgcttttctggcttctgctgtgcgtgttcgtttagcaaggaaggatgggctttgtagccaaatccatgcttcttcactagccataatccactgcttgcatttaggaacaaattaaaaggcaggatatgtggagattaaaaggttaggaaactggatattggctgatttttaaagttgaaactaagctgccttaggaacgtaacagctaagaccagtgctactacagcagatactcaggagctctgatgcagtgacttcacgatgagatggttgctctaacaaaagggtacactcaagctccgcataatcccataaaaagatttctgcagtatctcataagctgaacacttcatatacttgattctgctgggaatcattgaaaggacctcttgaattacagagtactgagttgaggggaaaacaagcgtaaggtgaaaagatagtttatcttttgtcaaggtgaaaagagcaagagttttcagtattcaaatatttaagtcactttttttctcccccttttctacctcgtggaagaaagccctttggtttctattctgtaaactgtcattaatggccatttgcttcctagctacatgattaatttctttgagattttgttccagtggctggcttaaatttgcccttcatttgtacacaggaaatatgtaaatttggctaccaggattttcttgatctttccggctagagtcgcataccacagtttctttgcctgggctaattgcctgaacatttatataacattccttttcttgattatattcctacagcttcattccagtagtgttaataggtatttctgagaacatgcagcagtaaatatcctgtgaatatagctcagaggagagaaggtgggttagaaagtggggaaagtcatttagagggagcaaagaaagagaggcaagagagaaggtaggccgtttatgggcaggcagtggactctggccaggaaccaggctcttgtcccatccccctgggccgatagaactgccagggaggttaagggaaggtcaggtattatgaggcagttattttgaggttggtggtatgaagcactgccctggcattcttcctgttattctggtaccagaaaccaggttactagtggtaatctgccttgaagaatgcctctgagctgtaaatggacctggagattttaatggctttgaaaattgaggtgatttgaagccttcagtaaaaccacttagagaaattaaaagaatttcagggcccgttggctggattccttggtttatatggcttcattggaagtctagtgggtgctcttgacaggaacgctttggatttattaatgataggctttcaaatcatagtaaaactgtgtgtcagccactatggtaggcattttacagaagttttctttcttaatcctcatgattctatgaggaagtatggtagaatattagtcctgtttcacagaaaagaaaatagaggcttagcagtgttaagagtgatttgtccaagtaaatttttatgaagtcctaggcggtatttttcaataagctttgtataatcacacttagcaagcagataacttactggcatgtgcatcattcctgataccacctctctcttcctttcattcagaattactaatttcagctggattcaatttgttgtcagttgattctgtagtaaggccatatgttgcccctctggaggtgcttgtcaactactctggatgatgggtaagcaacttgcttgtgattacagcatgaatcagcagcagaaacttgctgactggtattctgacctctaggccgagccacctgttagaactagagctagaaatgaagatgccaagtaatttaactgtgaaaaacttgtggcccttaatttggtaatggggggaggctgagatatacctactgctacttggtggagacctttccattagggaaatgtggaacaactgagaagctgggttaagtttttaagtcatttatttgtcgactctggagcctgagtttagtggtcttgtccattttggaatgtgtcttgacagtagttcttggcagttgttctcagtggtggctgtgcatcagaatctcctcaggaacttttttttttccctcaagacagtcttgctctgtcacccaggctggagttcagtggcgcgatctcagctcactttaacctctgccttcccggtttaagcaattcttctgcctcagcctcctgagtagctggattgcaggtgtccaccaccacaccggcctaatttttgtatttttagtagagatgggtttcgccatgttggccaggctggtctcaaactcctgacctcatgaggaacttaaaaaaaaaaaaaataggggtgtgtggggccccttcctaggaatttattatcttttttttttttgtagagatgggggtctcaccatgttgcccaggctggtctcaaattcctggcttcaaatgatcctcccaccttagcctcccaaagtgctggggttacaggcataagccactgtgcctggcctttttctgattctttaagcctagattgaacccgtgggtcctgggcattcataatttaaaaagtctgtgcaagtgattctggtgtgcagccaggattgagaaccaccactctgagatttaaaacttcacccatagttccttctcccaggaacttgatattttttgttttccaaaatctaaagtggatcatcttatcactcctgttctaccctcgagtttttcccatgtatatcctggcaagttgtccacaaaacatttcaaaaataatactctgaattttatctctgggtcccaggcctgatggtaccttcaacctttagctgccttttgcctgggtctagagataagagccagtctctcacttgacatatctgtcttcatacccttaggtaactggaagacgagaaacgagttgattttggcaactaaaatcactaatcatgatgtggtcagttgttatgtgttttggaaatgagcagtttactgtcttatcagtgagcatttctgtaagcattatgaaactgtttccttgccagtgtggtaataagtgaagaaatgaagacagccttcttgctgagtgccagtttactttctttttttttttttttttgagacagagttttgctcttgttgcccaggctggagtgtagtggtgcagtctcggccttgccgcaacctccacctcccgggttcaagctattctcctgcctcagcccccggagtagctgggattacaggcatgcgccaccatgcccagctaattttttgtatttttagtagagacggggtttctccatgttggtcaggctggtctcgaactcccgacctcaggtgatccgcccgcctcggcctcccaaagcattgggattataggcatgagccaccgtgtctggccattttactttcttaataagcccttgccatgtagaatctggctttacctaaatctatgcaaaccgtgaggtgcatcttgaaagcagcagttagggtcaaacaggtagggtccaggatcatctgaaacagtcttggataatgaggttggaggatatgtgttttctttatatacctatcctcgtagaatctcctttgcttgaggtgatgtgaaatggagttaaggaaagcaaagcaagagaatgtggctgagttagctggggttctgcatcccctgagttttcctttttttttttttttgagacggagtctcactctgtcgcccagactggaatgcagtggcacgatctccgctcactgctagccccgcctcccgggttcacgccattctcctgcctcagcctcccgagcagctgggactacaggcgcccgccaccaagcctggctaattttttgtatttttagtagagatggggtttcaccatgttagccaggatggtctctatctcctgacttcgtgatccacctgccttggcctcccaaagtgctgggattacaagcatgagccatcgtgcctggcttttttttttttagagacaagctctcgctctgtcacttaggctggcatgcagtggtgcaaacataactgactgaaaccttgaactccttggcttaagagatccttgaactcttgaaccactgtgcctggtttatctttttctttttttttttgagatggagtctcactgtgtctcccaggctggagtgcagtggtgcaatcttggctcactgcaagccccgcctcccaggttcacaccgttctcctgcctcagcctcctgagtagctgggactacaggctcccgccaccacgcctggttaattttttgtatttttagtagagacagggtttcaccatgttagccaggatggtcttgatctcctgacctcgtgatccacccgcctcagcatcccaaagtgctgggattacaggcgtgagccaccgtgcctggcctttttctttttttgagacagaggctcactctgtagcccagggtggagagcagtggtgccatcatagcacaccgcagcctcaaccttggcttaagcaatccttccaactcagcctctcagctaggactgcaggtgtgtgccaccacattgggctaatttttaaattttttgtagagatggggtcttgctatgttgcccaggctggtcgcaaactcgtggactcaagtgatcctcttgctttggcttcccaaagtgttgagacaaccggcatgagccaccaagtccagcgctgaaactttgctttctaattgttactactagtgccatgtttgacactaactgttgctaactgaagtaataggtaaaagtttagtttttaagttctaactttatttatttgttttttgagacagagtctcactctgctgcccaggctggagtgcagtggcgtgatttcagctcactgcaacctctgcctcccgggttcaaatgattctcatgccttagcctcccaagtagctgggattacaggcgtgtggcaccacacctggctaatgtttgtatttctagtaaagatggggcttcaccatgttggccaggctggtctcgaacttctggcctcatgtgatctgcctgccttggcctcccaaagtgctgggattacagggagccaccatgcctggccttaaattgtaactaaggtaagggtcactgtccgtaagcaggatttaagggtaactggtaggagtgaacctagcctgtttctgtgactgttctgtttacattgctgccatttcacatggtttagattgactcccaggttttaggtggtcaggtttggagagaatgacatctcatttatacagtgaggttgacagactatgggcgtgaagtggttgctttcaaaatttggtctctgatttattaacttacattttcttctttctgaggcattgtttaaccttgaatttatttagcctgctataaaaagctggtgattgtacttaccaagaaataattttttctaagtttaaaaaaaattactcagataatattacaggtctgcagacaggtactttagtatagttatatcagaatcttagagggtgaggcctgagcataggaattccgtaaaagctcatctgtgtgattcctatgaactggcaagattgagaatcattgtaataagataaaagtggggccagaccccatggctcatgcttataatcccagcactttgggaggctgaggtgggaagatcacctgagcctggaggatcgcctgagcccaggagtttgagaccagcctgggcaacatagtgagacccccgtctgcacaaaaaaatttaaaaattaggtcgggcctgatggctcacgcctgtaatcccagcactttgggaggctgaggctggtggatcgcttgagctcaggagtttgagacccatctgggcaacatggcaaaaccccgtctatatcaaaaatataaattaagccaagaatggtgtatatgcctggagtcccagctacttggggggctgaggcaggaggattgcttgaacccaggagttggaggctgcagtaagccgagatcatgccactgcactccagcctgggtgacaaaagtaagatcctgtctcaaaataaatttaaaaattagctgggtgtggtggtgcacacctgcagtcctagctgggaggctgagttggaaagatgctaagctgaggttgaggctgcagtgtgctatgatggcaccactgctttccaccctgggggaataaaacatgctgggcatggtggctcatgcctgtaatcccagtactttgggaggccgaggtgagtggatcacttgaggtcaggaggtcgagaccagcctggccaatgtggcgaaactccatctctactaaaaatacagaattagccaggcgtggtggctcatgcctgtaatcctagctacttgggaggccaaggcaggagaattgctggaacccgggaggtagaggttgcagtgagccgagattgcgccactgcactccagcctgggcaatagagtgagactgttaaaaacaaaaaaaagataaaccaggcatggtggttcatgcctttaatcctaacagtttggaaggccgaggcaggattgcttgagtccaggagttggaaaccaatcagggtaacaaagtgagaccccaactctacaaaaaaaaaaaaaaaaattggctgggagtgttggctcatgcctataataccagcactttgggaggccgagcagatggatcacttgagctctggagtttaagaccagcctgggcaacaaaggcaaacctcgtctctacaaaaaacacaaaaatcagctggacatggtggtgagtgcctgtagtctcagctgctcaggaggctgaagtgggagggtggcttgagcctgagaggtggaggttgtagtgaacgagattgtgccactgcactctagcctgggtgacagagcaaaaccttgtctctaaataaataaagtgcataagtaattattatgttgttagagtataaataaatcggtgtaacggttctagaaagcaacctagggatgtgtaaatggctttaatgaccatattttatctgtcagttccactttttgagaatttgacataatcacctaagcctctgtgtaaagagactcccaatggtattatattaaactaacaaaaaattagaagccacctaaatatacaacaatgggggattggttacattattctgtaagtatgtggccaagaagggtacagcaattaatcatgcttctgaagactagggatgcataaaaatgctcacagagtagtaagcagaaaacaatatatcttctatgcttgtcattttatataagatttgtgacacgtatgtaaaatggagattaaaaggaaaacactgttaatgagttagtgctctgtgggtactggcaactttaaattattctacactattttcagaattgaacacatattataattgaagagaaaaacaagaaacatttttattttttattttttgagacggagtctcgccctgtcacccaggctggagtgcagtggcacgatctcagctcactgcaagctctgcctcctggggttcacgccgttctcctgcctcagcctcccgagtagctgggactacaggtgcccgccaccatgcccggctaatttttttttttttttttggatttttagtagagacaggatttcactgtgttagccaggatggtctcaatctcctgacctcgtgatccgcccacctcggcctcccaaagtgctaggattacaggcatgagccaccgcgcctggccatttttaaaaaggatatgactcaatctgatccaatatgcttttatttatttaattaaatttttttttgagataatcttgctctttgcccaggctagagtgctgtggcacgatctcggctcactgcaacctctgcctcccaggttcaagcagttctcctgcctcagcctcccaagtatctgggattataggtgcccgccaccatgcgcggctaattttttgtatttttaatagacatggggtttcaccatgttggccaggctggtctcaaactcctgacctcaggtgatccacctgcctcggccttccaaagtgctgggattacaggcgtgagccattgcgcccagcccccagtatgcttttagagctcaacttcttttgttctgtcaatttaacagcttctgaatttgacctctagagcttctgtaaacacagttttgctgttaatgccttttgaatatatttgctaaggcctaggacaaccccttgtagtatagaatctggttatgttatagtaatttaaaaaggaatctcttctgtcctgttaccaggtaaaatacttttccttaatacagaatgcctgtttcatttcctgtaactttatctgactgaacttttacaaggacagtggttaagctgtgtaaagtaaagacattatggattgagaatccatgtggtttgatctacgctgtgtttgttttgagggaggggacccgttaggcttcattattgcaagaaaaaaacactctactatgtgttgtcttgctcaaagcactcatgctctggcccaaacccagattcctgaaggtggtcaaagggcctattcacccttattttttgctgggaggtggagggcagttggctaagtgaatgtatcagcttcttaagacgttcttttgtgtttcttgctttcagatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtatggaatttgagaatgtcctttctagagcataagcatgagatctgatcccatcccccgtcccccagtttatcagtagttgagaaggggaacaagaggtagaggaatagataatcaaagcagtcttgagtaggcgagagggttaaccaggtttgaaaccttgcctccttttttcccctgaaggttatgaaaatttctttggaggaaggaaaatttcctttatgacaaatttggggttccttaatttgtatggtctttctgttatcactcttgaattagaggtactttttggaatatttaggtaataaaatgacattaatgacatttgcctttgtaatctagcaaaatgtaaaatgcatatatctatagtctcaaattttttttaggagtttcttagctatgcttctgtaagtgcataaagacatttatgtacaagggtattcactgctttgtttgtagttgcgaaattgggaaataacctaaatgcctatctacaagagactgatagagtaaattacgtttcataccatgcaattatgatagaataagacagataaaaaaaatatagactgagggaagtaaagggatagagagtaacaaggaaaacagttttagaaggtgctttaaagacaccttctctgaggaggtggattttgagagagacctaaaagaagcaagggagcacactatatggttgttttaagatggtcttgctctgttttaagatggtcttgctctgtagtacattggcatgatcatggctcactgcagccttgacctcctgggctcaagtgatcctcccacctcagctttgagtagctggaaatacaggtgcatgccaccatgcctggctaatttttttctttttcttttttagagagtggatcttactatgttgtctaggctgctcttgaactcctggccttaagcaatcctctcatcttggcctcccaaagtgctgggattacaggcatgagccaccacacctggccatgttacatggttttgaggaagagtgtcttagcctgaaggaatagcacatgcaagggacgggaggtggtagtgcgtttattggtttgaggtaaagcaagtaggctaccgtaagtggaggaggagaggtaggaaatgtacccaaagactaggaaagggatcagatcatgtggggctttgaaggactttggcttttgttcagagagatgagaagccattgaaaggtttaaggagaaaagtaaggtaacctgatgcggagttttaaaggggaagagtggaagcaggaagactaagagactacaaagatattcttggtgagagtgatggaagctttgaaagagggtgagtgatggaggtggtgagagacgttaagatttgagatattacttccatatagagccaagactttttgttagatgtggggtctgagcagagaaaaggatgagtaatgtttttggcataagcccaattcaggtaccttttgctggaatggagaacattctttcaagaagagcacaaagtttttttgggagaggggaatagggttgagataaagaacttcagtttggaaatgttatatgtacattgaaattcctatttgataaatataagcagaatataagtagaggtaggtagttaactgtgaatcagcagtcaaggaagagacccaggttagagagctgtcagcatacagttggtgcttaaagctgtggaactaagtgagatagattaaggagtgagtgttccaaaaacggattaggttcaagaactgaacctctgagtctggataagaaaccagcagaagagagcacagtcagggcgggaggaaaattgctgaaaggtgttgcagaaggtgatcagttttgtcaagtgttgctgataggttaagaataggactgaaagttgaccattcgatttgaaaatggcatgtagattggagagaataggaggatgggaagaagaaacagcaaatttacacagtacttttcagtggctttgctctaaaggggagcagagatgtgaggcggtgcttgaagggaatatgagcttgagggattttttttctttcttttttttttttttttgagatggagtctcgctctgtccccccaggctggagagcagtggcgcaatctcggctcactgcaacctccgctcttgggttcacgccattctcctgcctcagtctcccgagtagctgggactacagctgggactattagcccaccaccacgcccggctaattttttttgtatttttagtagagacggggtttcaccgtgttagccacggtggtctcgatcttctgaccttgtgatccgcccgcttcggcctcccaaagtgctgggattacaggcatgagccaccgcgcccggctgagggattttaagattagggaaatgataacatgtctgtgctcatgggatggtcctggtgagaggcaaagtgatgtggggaaaagggagagaattgctgagcaatgtccttgagtccttgagatctagtgagaagtggagcagttgtcttagataggaactctaccagttcatccccagtaacaaaaggaaggcctggtgatggaggtgggttcggaggtagttggaattcttttctgattgttctaattttctcagtggaatatctaaggtgagccaagaggagatttggaagcctgaggagtgaaggagttgtctgggaaagtgagggaatgaatggactgcagaagcgtactaggattgtagtacttccaggcacatgagggtctactgtggtgaggctggttgctgtggttgtatttgttagccctgtttgtctgctgcagggctgatgtggaataggaaaagagttgaattaatcaggggaaggttttgccaggtgaatacagcagatatatgaagaagtgggtgatggggccgggcgcagtggctcacagctgtaatcccagcactttgggaggccaaggagggtggatctcctgaggccaggagtttgagacgggcctggctaatgtggcaaaactctgtctctactaaaaatacaaaaattaaccgggcgtgatggcaggtgcctgtaattccagttacttgggaggctgaggcaggagaattgcttgaacccagaaggtgaaaggtgcagtgacctgagatcgcaccactgcactccagcttgggcgacagagcaagactccatctccaaataaataagtgaataaataaataataaataaaaatttaaaaaaggaagtgggcagtggaccacaggatctaagccaaatctgaggggttggatcattgatttggaggtcctagtgggggtaaagaattgttggagtcaggactaaacctggggaaggagtgtattccggtctggacaacagaatgctcaaagttaagatagtggaagaggttgtggttgttggtctagactatagaacactcctgtctaatagatcaagccatgtgtgtaatcatacattttctagctgcctgcgctagagaagtaaaaagtccattttaatatgtttaatatattaaattcaatatatctaaaatctaaaagtttaccacgtggtacagccacatttcaagtgcttagtagctacatgtagctactggctgctgtgttggacattacagctgtagaacggaaacctgtaggtgtggttggctgagatgggaggggcaagctaattggaagagaggaggtcaaggacctggagttcagggtattgcgaggataatcaggaagtatgagtggcgtcagagaaagtgacagtgggccagctaggacaagctgaagatgataaaaggttgagaatgtggaggattttgttgactgagcacaagctcttagatctaagtttggggcattaagggtggaagaccgtttgattaaagagatcagagccatgtggagatgaaaaataagggatgacctggaagtcttgggcttcctgtgttgcacaagcaaacagaatgtggagaatgtggcgtttttttgttttttgtttgcttttttttttttggacgaagtctcgctctgtcgtccaggctagagtgcagtggcgtgatctcggctcactgccagctctgcctcctggattcacggcattctcctgcctcagcctcccgagtagctgggactataggtgcccgccaccatgcccagctaattttttgtatttttagtagagacagggtttcactgtgttagccagggtggtctcgatctcctgacctcgtgatccgcccgcctcagcctcccaaagtgctgggattacaggcatgagccaccacacccggcccagaatgcggcgttatttttaagcttggttgttaatataaaaaaggaagttatctgactggatggtataccaccagttgtatttaattatttttaatttattatttttgagacagggtcttgtggtgtcgcccaggctggagtgcagtggcatgattgtggcccactgcagccttgacctactgggctcaaattatcctcccacctcagccttccaagtagatgggaccacaggcatgcatcactaagcctggctaatttttaaattttttgtagagacatgggatccctgtgttgtctagactggtctcaaactcctggcctcaaatgatcctccctccttggcctcctaaagcactgggattatagatgtgagccactgcgcccatcctagtgttttttttttttttttttttttgaaatggagttttgctcttgatgccaggctggagtgcaatggtgtgatcttggctcactgcaacctctgcctctcgggttcaagcgattctcctgcctcagcctcccgagtagctggtatttcaggcacctgccactgcacccggctagtttttttttttattttcagtagagatggggtttcaccatattgcccaggctggtcttgaactcctgacctcaggtgatccgcctacctcagcctcccaaagagctgggattacaggcatgagctactattcctggtcacccatcctgattttatttttaaattttagattttattttttagacacagaatctcaccctgttgcccaggctggagtgcagtggctatttgcaggtgtatcatagtgcactgcaaccttgaattcctgggctcaagtgcccctcttcagcctcctgagtggctgagagtgcaggtgtgcattaccgttgcctagctttgtatttatttttaaagactgtattactccattctctcattgctattaagaactacctgagactgggtaatttatgaaaaagagtggcttaattgactcacagttctgcaggctgtacaggaaacatggctggggagccctcagggaacttacagcgggagaacgggaagcaggcacatcttaggaggaagactgcataagaggaaatgctacatacttttttttttttttgagctgaggtcgcgccactgcactccagcctgggtgacagagtgagactctgtctcaaaaaaaaaaaaaaaaaattcctcttcctggccgggcgaggtggctcatgcctgtaatcccagcactttgggaggctgaggtgagtggatcacctgaggtcaagagttggagaccagcatggtcaacatggcgaaaccctgtctctactaaaaatacaaaaatcagctgggtgtggtttaatcccacacgcctgtaatcccagctactcaggaggctgaggcaggagagtcacttgaacctgggaggcagaggttgcagtgagccaagatcgtgccattgcactccagcctggatgacagagtaagactccgtctcaaaaaaaaaagctgtgtaaaaggagggttttttttgggtttctgctataaatcagtgtcatcctaatctgaaatactgattcattctcattctctctaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaagtgagtattgctacccctcagaggaaagggaaagtaggactctccggatagctgtggtgcctctgtgagaggctttttttaagctattgtgggaaagaagcagaaagggaattggtctcgttctttttctgttcaccactgccccgcccttcctttcttttacccactttccaggtggatgtttttggtacttaatataatgcttaaataacttagtatcatgataaggtagaaaacatgtttggaattggacctagatttgaatcttgtttcggcctttgaccttaagtaacttaacagctttgagatttagcctctcctttataaggaagaggaaaggtttttttttttttttttttttttttttttttttttttttttttttttttttttttttttttttgagatgtagtctcgctctgccacccaggctagagtgcggtggcgtgatctcggctcactgcaacctctgcctcccgggtttaagtgatttttttgcctcagcctcccgaatagctgggactacaggtgcataccaccacccccgtctaatttttttatttttatttttgatagagacggggtttcaccatattggccaggctggtctcaaactcctgacctcgtgatccacctgcctcggcctcccaaagtgctgggattacaagcatgagccaccatgcccagccaggaagaggaattctttttttttttttttttttgagacaaagtcttgctctgtcacccaggctggagtgcagtggcacgatctcagctcgctgcaagctccacctcccggagcttcatgccattctcctgcctcagcctcccgagtagctgggactacaggcgcccaccccctggctaattttgtttttgtatttttagtagagatggtgttgcaccgtattagccaggatggtcttgatctcctgacttcatgatccacccgcctcggcctcccaaagtgctgggattacaggcgtgagccacggcacccaaccaggaagagaaaatttcttaagagacaattgaatgacaagttgaagtgcttggcatacatttgctcaaatatgatccccttttgtttccttttgtgtggccctagtcataattgaagatttgactttggatctagactgaagtaaccgttttgtactttatatgaactgatgaactggtttcaaatactaatgacagtcttctgttttttttttttttttggtgacagagtctccctctgtcgcccaggctggagtgtagtggcgtgatctcggctccctgcagcttctgcctctcaggttcaagtgattctcctgccttagcctcctaagtagctgggactacaggcgcgtgtcaccatgcccggctaattttttttgtatttttagtagaacggggtttcaccgtgttagccaggatggtcttgatctcctgacctcgtgattcacctgcctcggcctcccaaagtgctgggattacaggtgtgagccaccatgcctggcctaatttttctatttttagtagagatggggtttcaccctgttggccaggctggtctctaactcctgacctcaagtgatccacccaccttggcctccccaagtgctgggattacaagtgtgagccactgtgcctggccgagaacagtcttttcaactgccttgaagactagccattttctggggttctaaggggtgagagaggaaatctggcttactgctgtttgatggagtcacggtctaggttaattttagttcaagggatgcctttggggaatttggctggacttgaagcagaagaaaacagttcatggatttagacttctgcctgctgagtctttgggttctttccagagctggagctcagaactgaggctgaggtcctagtgcagtgcctcatgaaccagggctgctaatggcctgcatttgatttctaagtgaatagatgacaatttctgctgagggtttattggtagatcctgacagtctagctttttcctgtctttcctatttctagctgccaatttgtggtgtctgaagaccaagactacacagctcattttgctgatcctgatacattagttaactgggactttgtggaacaagtggtgagtagctcagccaagcccataagctatgaatgggagcactaaataaaggcactgtggtgacgcagcagctgttggctgtgtgcactgcttgatacccttttctgcctggcctttctatagatgtttcccagaggtcagttcctggttcttcctggagtccattttgtgactaattggctctggcctgtagggatggtgtatgaaaggctctgatctgaagatgtgtaagctgggaagtagtaaccccttaccctcctgatctgggttgggctcattacagggccattgcttcattggcagccattcgtagcaatcactatcaaagtaggcctcagccttgtggcagggaggcacatgaatgagccacacagttgtacttttcttttttgagaaagagtctcactctgttgcccaggctggagtacagtggtgtgatcttggctcactgcaacctctgcctccagggttcaagcaattctcatgcctcagcctcctgagtagctgggattacaggcacccgccaccacgcctggctaatttttgtatttttagtagagacggggtttcaccttgttggccaggctgtttttgaactcctgactgcaagtgatccacccaccttggcctcccaaagtgttggggttacaggcgtgagccactctatctggcccagttgtacttttttttttttttgagacggagtttcgctcttgttgcccaggctggagtacagtggtgcaatcttggctcactgcaacctctgcctgccaggttcaagcgattctcctgcctcagcctcccgagtaactgggactacaggcacgcaccaccactcccagctaatttttttttgtatttttttttagtagagatggggtttctccatgttggtcaggctggtcttgaattcctgacctcaggtgatcctcccgacttggcctcccaaagtggtgggattacaggcatgagccatcgtacctggcctctttttttttttgagacagtcttgctctgtcgccccagctggagtgcagtggcgcgatgttggctcactgtaacctccacctcttgggttcaagcaattctcatgcctcagcctcctgagtagctgggattacaggcgtgcaccactatgcctggctaatttttgtattttcattagagacggggttccaccgtgttgtccaggcttgtctcaaactcccagcttcaagtgatcaacctgtctcggcctcccaaagtgttgggattacaggcgtgagccaccacgcccagcttcagttgcactttcaaagccactgatgtgttttctactgaagttataaactctaggtatccccttgttggtcctagtagggtatctgttgaagaataataatttcaaaatgatgggcactttttctttatgagcaggggcttttgaccttaaagcttgaactctcgccgggcgcggtggctcacgcctataatcccagcactttgggaggctgaggcgggcggatcacggggtcaggagatcgagaccatcctggctaacacggtgaaaccccgtctctactaaaaaaaaaaattagcccggcgcagtggcgggtacctgtagtcacagctacttgggaggctgaggcaggagaatggcgtgaacccgggagatggagcttgcagtgagccgagatggcgccactgcactccagcctgggtgacagagtgagactccgtctcaaaaaaaaaaaaaaaaaaaaaaaaaaagcttgaactctcactactgtgaaaatgtataaaatcatctgagaatgacatagcataaaaacttaagttttattaaaaaaaaatgaagtctttttaatgcgttctttgttggaagttactggtagattacttctagaccctttttaggcctttatgcatacatattaagtttttttataaatgggaatatagtgatttgtcacttttttctatttaatgtagaacccccaacatacctgttgtgtattagttttattatatttaacggttattatggtttccttgatgctttgcttaaagagctatcatacaaagccaggcgcggtggctcacgccggtaattccaggactttgggaggccgaggcgggcggatcacaaggtcaggagatcaagaccatcctggctaacacagtgaaaccccgtctctactaaaaaattagctgagcgtggtggcaggcgcctgtagtcccagctactccagaggctgaggcaggagaatggcgtgaaccaaggagatggaccgtctcaaaaaaaaaaaaaaaagaaaaaaatgatcatacatgtacctacgttgtaaacaattttagaaagatatgttgagtataaggatgtacggggatagagatgagagagatgcggatgagagagtagagaggcctaaaactttgacagtccctaatcagttcttcaagcagtgaaccttctggtggcattttgtttcagcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagaggtgagattgagacatttactcagttagatcccaatctcttcactccttgccctgctacatatgagtgtccatgtttcagtgttgttgccacagagtcacatcagtatgttgttggtgataccattacgatgcagctgatgaagagggagaaaggggtgttggtggctttgcccaaatccaaatggatgaatgtagaccatcccattcatctaggaggtgagttctttaaattttggggacaaataatcctgggtacattctttaaggtgattgaatatatctaagcatcagaaagtgaagcctttgggcagggcacatctggcatgttcatattagtcataggattccagtaggttagggtggggtttgtagagagtagattaattattggtttcaagtttgtttaatctatacatcctaatttttcattttacaaggttttattacatagtgtctttcactgtgcccaatcttagaggttctgtggtcagccagtcttggtgcctgtcgtcaagaaactcagtagtccgatagaagagacagactggtagactggccattaggataaagagtgtgataagtgctcacaatgaatgccagagatgtattccctgtgtttcatgcagaaatgagcatttgattaaaatagcatttcagtctctggggaaaagatagatttctcaataaatggtattgaaacaattgattctccctaaggaaaaaataaaattagattcctatttcataccattcatgaaattaattccagatagattgaagaagtaaatgtaaaaaatccaaaagttttaacctttttatttaaaagaaaatataggacaatttctttataaatcctcagatgtgcatctgtctgaaggattgtgtgttctcatttgggtggtaaatgtgtgtgtgtaatatttttttcctagtgattttgactgtttaaatgtttagcaacttaaaacattaaaaatgtgtattaattaaaaaaaaatcctcagatatgggtggatttttgaaccaggctgaaatgatagatgctgtaaaagactgataaattttatttttattttatttatagatatataatataatatgtatatatatatttttttttgagacagagtctggctctgtcacccaggctggagtgcagtggcatgatcttggctcactgcaacctctgcctcccgggtttgagcgattctcgtgcctcagcctcccgagtagctgggactacaggcgcccgccaccatgcctggctgattttttttgtatttttagtagagacggggtttcaccatgttggcaggctagtctcgaactcccgagctcaagtgatctgcccgccttacctcccaaagtgctgggattacaggcgtgagccactgtgaccggccaagaaaaccacttttagtgtccacagaattttcgttaatgaacataccatcatgtcattaaccctttatttgagatggaatctcactttgtcgcctgggctggagtgcagtggcaataattacttttaattaattaaattcattaaaataattaaaattaatttaattaattaaattaacttttaattttaaattattttttttattttaaaaaattaactgggcatgcaggtatagttaattttttatttttatttttagcagagatgaggtcttgctatgttgataggctggtcttgaactactctttttttttttttttttttttttgagacggagtcttgctgtgtttcccaggctggagtgcaatggtgtgatctcggctcactgcaacctccacctcctcggttcaaacgattttccttcctcagcttcctgagtagctggcatttcaggcacctgccaccacgcccggctaatttttgttttttttgtgtgtgtgtgttgtgctttttttgtttttgtttttgttttgagatggagtctcactctgttgccaggctggaatgcagtggtgcaatcccggctcactgcaatctccgcctcccaggttcaagagattctcctgcctcagcgtcctgagtagctgagattacaggcacgcaccaccacacctggctagtttttgtatttttagtagagacggggtttcaccatgttggccagcatggtctcaatctcttgatcttgtgatccgcctacctcagcctcccaaagtgctgggattacaggtgtgagccaccgtactccgcctggtgttatttttttttaattttattttttgaggcagagttttgcacttgttgcccaggctggagtgcaatggtgcgatcttggctcactgaaacctctgcctcctgggttcaagcgattttcttactccagcctccctagtagctgggattataggcgcccgtcaccacgcccagctaattttttgtatttttaatagaaacagggtatctctatgttggccaggctggtttcgaactcctaacttcaggtgatccacctgcctcagcctcccaaagtgctgaacgtgagccaccacacccagctggcttggtcttaaacttctaaactcaagcaatcttcctgtcttggcctctcaaagtactgggattataggtgtgagccactgcgctggtccaccatttctttattctttattgttggttttactggttggtttgagcttttctttttctgtgtgtggttttttttgttttttttttttttgagacagagtttcgcttttgttgcccaagctggaatgcagtggcatgatcttggctcactgcgacctctgcctcctgggttcaagcgattctcctgcctcagcctcccaagtagctgggattacaggcatgccctaccaggcccgactaacttttttgtatctttagtagagacggggtttcaccatgttggtcaggctggtctcgaactcttgatctcaagtgatccacccgccttgacctcccaaagtgctgggattacaggtgtgagccatggtgcctggctggtttgagcttttctgatattacatacaatgctgtaacaataaacgcgtgactaaagttttgactacatctctgggtttcttagatttcttatatcaagagcagagctacagaccttattttaagaccattgttaaattattttctaggaaatcatgctaaattaccccattttcaccccagagaaaaggctgtatttgaaaattcctatttagctacaccatcgtgagctttgaatgttgcatttctttgatcttgctggcattcttatagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaaggtgagaggatgcattggagatgctaaaccttttcactttctcggcgttctgtggtgaaaaccagaaatgctaaaccttttcactctgtcgggggtgagatgatggacgctggggattaagttagttccattccacatttaagacaataagcagagaatggctaaaaaagccaatttgttttgggctttgtttgatgacagtagagaaggtttaacctagggcttttaaagctctttctagagctgaaaggagcaagtcaaaatgattttataactaattgtgacagtggagttttttagattagctatgttcttaaagcaagttagagttctttgttttctgggaaaatacttaagattctattctagaggtgttttgaaagacattgtggagaaagtattatggcctgcccagtatgccttaggagtacctgaaacggcaagaattacacaagaacagaattccctgggtcttttatcttccacaacagagattcttgaagcatcacaaccactggttgttaggtcccactttgagatattgattgcataggttaagctcagtaggctcagtaatttgcatataacaagttctagggtgattctgatggctgctcatccccagaccacactcctggaaccactgatctagcttagagcaatagaagcccatatttattgagtgatcagcatttgataggacttgtgctatacacatttatctcacttaagcttctagtgtggtagatagaactatcccctttcatggatgaggaaactgaatcctgggttgggtaatttgctagtaagggatgcagctggtatttgaattcccttctccctgactcccaagggctccttgggtagagtcctgtgtatttaacttttgctttctttctataatacgttgcagccgtatttgttcaaatgccattacaggcataagaaaggctacatagaattagagctgtccaggctgaggtggagttagctaaatccttcctactactctggacctctgtctgagcatagtttgtaaaaactaggttagtttcatgttcttagatttctgttctggaagttttttgtatagtgttgtttgtgtcagattctcttttattttttttaacttttaagttcaggggtacaaatgcaggttgttacatggtaaacctgtgtcatgggggtttgttatacagattttcacccaggtattaagcttagtacccattggttatttttcctgatcccctccctcctcccactctccaccctctgataggcctcagtgtgtgttcccctctatgtgtccatgtttcatcatttagctcccacttagaagtgagaacatgtgtgcgatatttggtttttctttttctttctttcttttttttttttttttttttgagacagagttttgctctcgttgcccaggctggagtgcagtggcgtgatctcggctcatcacaacctctgcctccaaggttcaagtgattctcctgcctcagcctcctgagtagcaggaattacaggcatgccccaccatgcctgggttattttgtatttttagtagagatggggtttctccatgttggtcagggtggtcttgaacttccaacctcaggtgatccgcccacctcagtctcccaaagtgctgggattacaggcatgagccaccacacctggccgtatgtgtctttacagtagaatgatttatattcctttggctatatacccagtaatgggattgctgggtgaaattttatttctgtctttaggtctttgaggaatcaccacactgtcttccacaatgattgaactaatttacactccccagtgtcagattctaagcagattccaatccttagtgggtattgcatgctttttgcttcctgtttccctcaaagttgagatatttaagcacctaattccttcccattgggtctcattgccttttaacttttggtcctgttgagaggccattctaagcccttgcccttcaagctaagtgtgtgtctggaaacttaaccttctctggtgttctctctggccacgttagactcgggaagaggctctgtcgggattggccggaagcagaagggaggtcactggtgttgtggctgctctggaacaactggtgctgatggctcccttggcgaaggagtctgtttttcaacccaggaaggttagtgtgttcctgttactaagtggctgccgttcctcaaatgctgtcattgagctggtaggcattactgtgagatctaaaccttctcaagagaagaggggacaatgagtattttctgtatgcttgttattagttctttccccaggggtgttaaatcagtgaacacgacagctaagataaacatctagggagcttggctcttaggtctgcatttgccacattgctttcggaaagcaggagatatcctttctgttgacttagagtttgctgcaacagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaaggtgagggtgccggaagagagggctgggttgccgcagaggtgtttcagaggtgacccggtgctctaagcagaggagcgccactagatcctgtggcttgggtggcttgagcccttgggcatggggaggggtggggagcctcctggggactggccaagactggtgtgtgatagagccccttgtcctcagcggaagatggacagcatatgttcctgcaccctgtgaatgtgcgctgcctcgtgcgggagtacggcagcctggagaggagccccgagaagatctcagcaactgtggtggagattgctggctactccatgtctgaggtgaggccttcctgtagaaatggagggtcaggcagcagtattaacctaatctctttgaggtaggcctagccatcctaagttcacaaaccttcaaggcctttagtttttgtatttttagtctttctgtcagtgatggtgctgtgaattctttgtaagtgaagtgtcccctcagcatgccagggttctgttaaatcagttaatgctgttccctgcttctctggttcattgattgtagtttggggatatagatatttcttttatttaagatggagtttatttttgtttcttatcctccttattgcttgggagaaatgtcacaaatttgttgtaagatttaaaattagactctttgagtactataaatttttcatcaaacatatgcagaaaaagaatagaaatgaaaataaatgggctggatgtggtagctcacacctgtaatcccagcacttttgggaggcctactcaggcagattgcttgaggctaggagtttcagaccagccagggcatttctacaaaaaatacaaaaaaaaattagctgggtatgatgatgtgcacctgttgtcccagctcctcaggaggctgaggcagaaggatcacctgagctggggagatcaagtctgcagtgagctggcctgggcggcagagcaagaccatgtctcagaaaaaaaaaattgggcttcattttctactatttcaggccaagtgtctttcaatagggagatctgctttatcttccttcccagttatttattctgtcagtggttcccaggtttttttctgttctgtttttctgccaacaaataactttatcttctctgttcgtccccctcagctgtggggccttgaaaaaatcagaaacagctgatgggctttagattatttgttgctggactcagttcactcctttgcagtacaaaccaaaaataactggatttggttgcttattccaccttgctgtaggttgacagtttctctttggcttttcaaaatgaggataattgagcactactgtttccagccccagtgctggctgtgttatgtatatattgttggatatcggggttaggaccccctgctttcagagttaggcttgcttttgttgagtattggtcctttttccaatgtaggatgttcgacagcgtcacagatatctctctcacttgccactcacctgtgagttcagcatctgtgaactggctttgcaacctcctgtggtctctaaggaaaccctagagatgttctcaggtgagaatgcccctgctctgcttctctttatagtagggttcagggattcttgtggctagacacccagtgggggaggaaacttatggaactgtatcatgagtcttagtacctcctaaacacttcatctgttcatctagtccagctgggcctactgttgtgggtttagctgctaatactgggaggaggtaatgaccatgttgtcctgggtctacctctttacaacctgaccaatctgcagatgacattgagaagaggaaacgtcagcgccaaaagaaggctcgggaggaacgccgccgagagcgcaggattgagatagaggagaacaagaaacagggcaagtgtaagttcaggaactttcatctttgactagcactgctgtacgtcgttgtatagaactctgtgtctgggacctgggagccagaccttagccacttgttttcttcaacttttaaatgtgaatcatgagagcacctccttaataggcttgcttgcaaatataatgagttaatatgggtcaaagtgcctagcacatagtaaggattaagaggaaattcagccttggtaatagtgggtgatatacacctgttccagagatgggaattggggcttcgctaagaatgctgggggccatcgttccccatgctctctggatcactgaccttacctctgactctttattaaagggaccagctatacacagcaagtctgccaggtgggtctgataagatggaaattttgatagactaggaaatgcaggaagttggatttaagagatctttcgtagcagtaagcacagccttttgatctggttctccaaaataagtttcattgaatccaggggattagtgtgacctgaggtcccattatccactagaacacaaggaactgagtccttggcccagaaaaggacttcggtgttttgactccatatggcatggaaacatacattttatatctcaagtgggacaagtgtatacttggggtcccaacaccgtgtaggtgtttggcacatgtcctgaactttgagaaaactgatatttcaggaataggattttttgttttcacctttttattatggaaatatcaagacaagtagaacaatgtaattaacctgcatgtttgttacccagcctcaattatgaatagttagaacaaggttaactatattaaagacattatagaaggacagttattgtaaatttgggttttagcttttgtctgcatcctctagacctttgggggtacgcatgtgtgatgtcctcaactgttggaaactatttgaaaaattcaggccaggtgtggtggctcacgtctataatcccaacactttgggaggccaaggtgggcagatcacttgagctcaggagttcaagaccaggctggacaacatggtgaaacctcatctctttaaaaattcaaaaaattagctaggtgtggtggcacgtgcctgtggtcccggctactcgggaggctgaggtgggaggatcgcttgagcctgggaggcagaggatgcagtgaacagagatcgtaccactacactccagcctgggtgacagagtgagaccccatctcaaaaaaaaaaaaaaaaaattgaattctgtaaatgggtttacaagggttatctttcctttgcagacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcaggtaaacaggtgaaatttaatgaattcacccatcagttagaccttatgcaaagctttggtgtctgagtttacaaccccggcccactcagcatggtgtggacttcaggggcataaccttactttggtagtcctgaggtacatcaaattcttttattcatctttcccacttgctatactgactgctttaccctgccagcttctaagcacctcaaggagctctttaggcaggatagttgaaaatggagtcttccctttgacccacctatttttgtttctagtttttgtttgagatactcccctgtatgcctaaacatctttgtacatgtctctttattgtagcatcgttttaatagctcaaaaaaaaaaaacagtttagaaagcctaccaataagaaaatgactaaattatagtatttatactgtaaaatgtttcacaccagaaggccgggcgtggtggcttatgcctgtaatcccagcactttgggaggccaaggcgggtggatcacgaggtcaggaattcaagaccagcctgaccaacacagtgaaaccctatctctactgaaaatacaaaaattagcagggcatggtggcaggcgcctgtagtcccagctacttgggaggctgaggcaacagaattgcttgaacctgggaggcggaggtctcagtgagacaaggttgcgtcactgcattccagcctgggcgacagagcgagactttgtctcaaaaaaaaaaaaaaaaaatcacacctgttaaagaagggaatgtaattcttctattcacgtactaatgggaagataaaagtaatttgtagaacaagaataaatgttcgtgggttttaaaaaaacaccaccaccaccacaaaactaaagcatttcattatgggtgtgtgtgtgtgtgtgtgtgtatgtatatatatatatgtaaatgtatagaaaaacttctgttagaaggcaggggaggaaataaaaaaatattaaatgtatagaaaagaattgaaggccaggcacggtggctcacacctgtaatctcagcactttgggaggccaaggtgggcagattcccttgagctcaggagttcaagaccaaccaaattttgtctctacaaaaaatacgaaatttagccaggtgtggtagtgtgtacctgtagtcccagctacttgggaggctgaggtggggagatggcttgagcctaggaggcaaaggttgcagtgagcccagattgggccactgcactctagcctgggcaacacagccagaccctctcaaaaaaaaaaagaaaaatactgagacagatgtgttccaaattggtagtagtgttacattctaaggaatgagactggattgaaatgttcaaatgggcctttagccttcaaaaagtttgtcttatatataaagaatgtttaaagtgttatgaaattaaacatttattaaagagttactataatttcagagaactatcttttgtgatcttcatctgcctggcacatggtttattaatttcttttttttttttttgagatggagtctagctctgtcacccaggctggagtgcactggtgcaatctcagctaactgcaacctctgcctcccgggttcaagcgattcttctgcctcagcctcatgagtagctgggattacaggtgtgcgtcaccatgcctggctaatttttgtatttttaatagagacagggtctctccatgttggccaggctggtctcgaactcctggcctcaagtgttctgtctgcctcaacctcccaaagtgctgggattgcaggtgggagctactgtgcccagcctgtttgtttttaagagatagggtcttgctcagtgctgtgatgcattcattagctcactgcagtcttgaactcctgggctcaagtgatcctcctgcctgagcctcccagagtgctgggattccaggtgtgagccactgtacctggccaagaaagatactttttgatgcttacgtctgatttctcaggcattcttgttttgttttgttttgttttagatggagtttcgctcttgttgcccaggctggagtgcaatagtgcaatctcagcttactgcaacctctgcctcctgggttcaagcgattctcctgcctcagcctccaagtagtttggattacaggcatatgccaccatgcctggctaattttgtatttttagtagagacagggtttctccatgttggtcaggctagtctcaaactcctgacctcaggtgatccgccagctgacctcaggtaatccacctgccttggcctcccaaagtcctgggattacaggcatgagccactgtgcctggcctctgtcgggcattcttaacaaagtgtccatcattggaatatttaaaacttgtggtgaccattttgttcatatgcatatcattttgcagattaggaacctgtggctgaggcaggtacttagtggcaagaactgggattagaacctggttcttgaggactgcactactgtgacgctcttctgcttaactgaaaaaggagcatacgaaggactgtggcagatcattaaatacattatttgtgatatgcatctttttttttttgagacagggtctcgctctgtcgcccaaactggagtgcagtggcacaaggcacaatctcggctcactgcaacctctgcgtcccaggttgaagcaattcttgtgcctcagcctcccgagtagctgggattacaggcagcaccaccataccctgctaatttttgtatttttagtagagatggggtttcgccatgttggccaggttggtctcaaactcatggcttcaagtgatccgcctgcctcggcctcccagtgtgctgggattataggcctgagccactgtgcccagcctatctgtgataccgagattgtgttttcacatactgtcttttctgaaagctgctttttgttttgttttgttttggatggagtctgtctctctgtcgcccgggctggagtgcagtggtgcgattttggctcactgcaacttccccctcgcgggttcaagcgattctcctgccccagcctcctgagtagctgtgtagcgtgccaccatgcctggctaattttttgtatttttagtagagatggggtttcaccgtgttagccaggatggtctcgatctcctgagcttgtgatctgcctgcctcagcctcccaaagtgctgggattacaggcgtgagccaccacacccagccttttttttttttttttttttaagatggagttttgctctatcacccaggctggagcacaatggcacgatctcggttcactgcagcctccacttcccaggttcaagtgattgtcctgcctcagcctcccaagtagctgggattacaggtgcccgccaccatgcccagctaattttgtatttttagtagggatggggttttgccatgttggccagcctggtcttgaactcctgacctcaggtgatccacccacctcagcctcccaaagtgctgggattacagcgggagccaccgcacccggcttttctgaaagtttaagcttttaatgtatttaagcaagagcaattggttggtcctagtaataagagtactgaccatgtgagggcctgctgctgggggagagaatagggcccctctcgtccaacactgttcagggcagtggatagactcatctgtgggaagtgttcagctctagtcagaatggatagagaagtgtattacctagggagtattggggaaaagtttgcatccttgtgctggatcttgttgatgtgtcttggattctaattggatactcccaggtcatagtgtctactatcgggaatgtaaaagctgagctgattaaattttatctttttcttggagctatttcatccttgtaaaaccagtccctgacagtacctatccttgagagccagcctttgtggaaagtatagcatttcaaaagcaaagacttttcttacagttggagtagattctaccatgacttctagagttactgtaacgatgaagctcttccctcttcctgtaccggtcgctgatttcactggtgatattgttggctttttaagaacatggaagagttgaaagttggatcaatgtttgcttttttttttttgaggggatgatttgtaattttccagacctgactcagggctcactcatctctcttgttaaggacaccccttggaacgtgacgaatataatcaggtctctggttccctttcagactttctgctgacccctctgtcacccactgccagtcagggcagtccctcattctgcgttgggagtctggaagaagactctcccttcccttcctttgcccaggtaaatcctttgcttgtgaagcagcccaggggtatttaacatgaactctgctgctcattattatgggaacctcctccagggattgttacctctcattctaatacggctggacaaattgagtcatctgatgggtaggagggaagttaactgcctgtcggagctttatgcagcatggagttggttgagggcagattatgtcatggacgtccgctctgttggaaaaggagagacttaacaggctaatgttgcactgactctaataatcatgggaggcattcttaagaggaaagctcatggatttagtcctcagatgttactgtagacgtacccaggaaagaggccaagaatagctgaggcagaatcagagtttagaatattttaaaaatcatttgataacttgtgtactggatactattgtaggggctggggatacagcatcagttttaactggtctctggttctaggacctctgattcaggtggtatttatctgttacataaaatgagccatttctcttcactttgagaggggaagattgtcttggttatactgcacctagccaaagcagcttccttggagctgggtgggggaacgataggctagtgaggcttgctgtgaaaccactttgttaatctctaagataacaagctaatactcagcattcctgcattcagataagtgaggaagatggatggacagcttgacatgtgcccttgtaagaagtccgtataaacttctttgaggctagtgcagaatcattatcttgacagtttttttttttttttcctcttctccaagacggagtctccctgtcccccaggctggagttccgtggcgcgatcttggcttgctgtaagctccgcctcccgggttcacgccattctcctgcctcagcctcccgagtagctgggactataggcgcctgccaccacgcccggctaattttttgtatttttagtagagacagggtttcaccgtattagccagtagggtctcaatctcctgacctcgtgatccgcctgcctcagcctcccaaagagctgggattacaggcatgagccaccatgcccggccattgacagttctttagagcagttgatacggatctttcttatgtaattacagcagtttgtactgagaaataagcaagaattgagctttggtaaggagggttccgaagtcaaggaacatgaaataattgtggaggtgaggtgagaagagagggggatcctgaaaattaactgctggacttagagatgattaacaagtggctcccaggagttatgccaaatacttgttttgttttgttttgttttgttttgagttgaagtcttgctcctgtccccaaggctggagtgcaatggcgtgatctcggctcactgcaaccaccgcctcccgggttcaagcaattctcctgcctcagcctcccgggtagctggggttgggttacaggcgcctaccaccatgcccggctaatttttgtatttttagtagagacagggttttaccatgttggccaggctggtctagaactcttgacctcaggcgatccacctgcctcagcctcccaaagtgctgggattacagacatgaaccactgcgcctggcctttttttttttttttttttttaaactaggctttattgctattgcttttttcctttgaactttattttgaaatacagagttgaaagaatagtattatgaacacttaaacttttgacctagattcactaattgttactattttgctgttatatatttgctttctcttttttctgtgttgaaaagaagttgcagatatcctgaatgatactttaccgctaagtacttaggagatacatgccaaagaaagtgggatattcgcctatagaaccacagtgatcacattagagaaattccactgccacagtaatatctaatatggtgcatatttatatctccacatttgtctcagcgtccttcattttcaactcagggcagaatcctgttactccctgcatttagttgtcaagtctctttagtctcctttgatctataaccgttcctttgcccatatccccttttttttcccttccatggccagttgttttatagaatatcctacagtttggacttgtttgatttctcatgaatggattcaggttacatttaaacattttggtaagaataagacataggtgacattttgattaccttttaagagtaaaacaattcacatgtcaaactatttggatactgtctcagtccatttgtgtgggtataaaagattacccgacgccgagtcatttatcaaaaaaaaaaaaaaagtttatttggctcatgactctgctggctggaggactgggcatctggtgagtgcctcaggctgcttccactcatggtacacgaagtgaaggggtccctgcttgtgaagagatcacatggctaaagaggaagcaaggaggggaggaggtgccaggccgttttaaacaaccgtgttcctgtgcccagtttcaaaatagccttcagccaagctattgaagcagcctttgtgaaactggacacaccagctacttcagatcccttctgtggtaagggcagaggctggagtgcccagggttgtcaaacacacatgtactgccattcccactgggatccagtggcagacatcactcatcagctctttcaggaatgaatgcgagaataggtctcccatcccccagggagggcattaatctgttcatgaggggtccacccccatgacccatacatctcccattaggtccccacttccagcattggggatcagattttaacatgaggcttgggagggtcaaatgtctaaaccgtaggagacccaaactcctagagacaaagggagaagttcaccaaagtggaacataatgaagaaaggttatttaatgaaatcggcatctgccaacacaaactcatcttgagtaataggcattcctcactttggaatatatgatttaaggacaaggcatccctgcttgaaccccatggggtttgtctcttgatatttttccaggaataaaatgttctctgccttttaagtggcatatttgcagttggggctcatagtggccttcagcagttacaaagctggccttggccaagtggaatgaaaattcctcaggggcatgaggattgttctgattttattgtccttgcaggaattttactggcctgtggttggatctgaaagttaatgatgaaggagctattggaaaagcagactaaaaggtagtgaggggctgttgaagcggtgtcaggagagagtttagttagttttcatggctttaggtaactgaagtttagtagccatgtggtttaaaactggagggtacttggctgggcacggtgtctcatgcctgtaatcccagcactttgggaggccaaggcgggcagatcacctgaggtcaggagttcgagaccagcctgaccaacatggagaaaccccgtctttactaaaaatacaaaaattagccgggcgtggtggtgcatgcctataatcccagctactcaggaggatgaggcaggagaatcacttgaagctgggaggcagaggttgcggtaagccaagatttgcgccattgcactccagcctgggcaacaagagcgaaactccatctcgaacaaaacaaaaaaaactggagggtactaggccgggcacagtggctcacgcctataatcccagcactttgggaggccaaggtgagggattaactgaggtcaagagttcaggaccagcctggccaacatggtgaaaccccgtctctactaaaaaaaaaaaaatccaaaaattagccaggcgggtgcctgtaatcccagctacttgggaggctgagacagaattgcttgaacctgggaggcacaggtcacagtgagccaatattgtgccattgcacgccagcctgggcaacaagagctaaactgtctaaaaaacaaaaactggagggtactactcactgcttcctccgacagctcgatgtttttaggggtcccaggaagggcagaaaaacttaaccagaaagtcggaattcccaatttgagggtctcagtaagaatctcttgtgccttctgtgcagtgttctttacccatttcctaaggaacaaacagcttatggtttactaccttgtgggtttcattgccatttccattagccaggatatagaggacatgactagaacagtgtgttaaggagagaagtacctggaaaatcttttcaaaggtgatagttggttctgtgcctctccagttagtcaaggtaggtctgaaaaagaagttggaccagctacttaaattctctcccccacttctttcccactttggcagatgctgagggttggaaaagcaaaagcagatgtgtggcccaaaactgctccaaagaaaggtgaggatggtccactggtgaagggggagtttggcttctttccataaaaggctgtttctagaaaaagagttgtttctatagttttaacactggtattttttagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctggtaagggcagaggctggagtgcccagggttgtcaaacatactacacatgtactgccattcccgcctggattcagtggcagacatcactaattaggctctttcccttctgaacccttcagcacactctagtgtcatttaaataatactccatttggtatgtcagataggacctatttgccaccccagagaaattgatgacgcctgaaagtgaaattctgaggaactcttccaagatacagtggggtgtacaacctgtatcctttagaatcttgagttggtacagggtggctaattagatggagaagtcagtctcgaagcctgttgcactctgttcatgactagacaagaatcacatatgtatggcgtgctatgtgcctagcactgtgctaattctcccaacaaccacgttaaatgggtgtacctcacgttacagatggggaaactgaggtccagggaggtaaaagtgatttgcccaaagacacccacttggtgtataccaagactggtattggcatctaggcagtctaattccagagcctccactcttagctcccactctgtgactctcagtaatgaaaactggccaggggacaagggatggcattttaagttaagctgtctttctgtgtctccctttagaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaa

SEQ ID NO: 37013 - DNA, 405672 bp, Homo sapiens
cacgctcccctcgactgcgctccagcctggggcgcgcccggccgccgccgccttcgctgccgccacgggcccgtcttcttcctccttcggctcccagggtaaggcgcggggcgcggggttggatgcaggcgccctgcccgctgcgcgggatgcgcagcggcggctggggagcggtgattgatcgcccccggcggccgcgccccagctcccggcagccggcggccgcggacaggcggcttgacaggcgcgggcacagcggcagtgcgggcctcgcacctgcagcccccgcggccggcgccggggagcggcgaagactcggagctggggtttcccctctgcgggcgctgccagggtggaagggaggcgtgttccccgggaaaatgggacacggagccctgcaggggccgggcgccggaccttagggagcgggcagggctgggcggggaaggtcgcttcccggccccagggctcggccgctggccccagcgccctgtcggtcctcggtcgcgcgtccccgctctttgtcagccacgcttggcgggcgcgcggacccacccgcgccgccccaggctcgcgggcgcgcccctcctccgccgtggggaaacgggtgggggccaggtggggagggtcgcagggggtgagagcacctggtgaggtgcctgtcgccgaccggcctgcggcctagggggtgggctggggcttgggcgggcactcctgtgagtctcggggattgatggaatgacccaggtggccgagggtcgggcgggagcccggaggtcaaacaagtgtttgtgaggggccggagattgacggggtagagcccagaagggacgctttctccgggaggaggccttgggagagccggcctttgtagtgaaatgggcgtcttggagaggaatgggcggttctgggatgaagcaggtggtctgagaggaggggcatttttcctgcccccgagctgagggtagggatggaagcttggcctgagtttcccagaggttgaggctgtcacttcagcacctgccctggcactagaaggtaatgggaggaggggtaagtgctaagataaagggcaaagctgtgccaggacctgggtcctttcctttctgcttcctgtggctagatcccttctagatgttctttgggaagagggctcacacgctgctggcacaaggggtgccctggcagggaggctctgctgcccgaggctgcctacaggcctcctacaccatttttatgtttcttttgttatctctttgaattctgtgcctatggtggggatctgccaatgacccaggaggctgtctctgccccttgctgcctctaggctcagattcgagaatcctggaggagctgtggccacagacccattgtgtccagccatgtaggctacctcgctgtctctacacagccctgtgagccggtattccctataagggaaaatcaacagctcttgccctccctggaccctacagccaaagtcaaagctgggtacccaggttggctttgcggcctgtaggaaggctggtagctgaaggcacataccatttgtgctctgatggagcccttggggtggtgggccatgtgtagcagatggttctgggaagtgagcttgacctggctgagggaaggctgcccagtctggctggtggagcccagctggccttagagcaattgtattttcactcaactctctccactagctaaactgaccagaaaaaatgggctttctgtcccatccccccaccccatcctcatgctgtgccacgtattcccacaacagcccttggaataagcaaatgaacatttaatctaatgcctgctgggtgccatgcatggcatcaaccagtactacatttgcatttgacaatgttcttaaaacatcctctgaggtggaatattacccccattttgcagatgaagaaactgagtctcagagaggtgaagtgacttgcccaagatcacagcaattgtaagtggccaaaccagaatatatacccaggtctgtcttacttcaagtctggtacattttctaatatatctgctggagacagagtgggagaaaccagagaatttctgcctattctagcccatggtttgcttcttgcctgctattgagatcatgctttagctttttgaaaatacttcccatctgttgccccactttatccttatagcattcctgggaggtaagtagaacaggaatataataatagatactgtgtattgagtgcttactgggcagtgggcactattaagcactttacatgcaggattaagcactttacatgcagaacccaaccctatagggctaggttctaactgtcgtcatccccattttgtagatgagggtgctgaggctcagagagattaaatggcttctccagggtcacacagctagtaaatggagtagaatttaaacccacagcattctgtcatgggatctgtgagcttaatcctccaaatgtgccaaatagcaataataatagttcctaggaataggagctaacttttacatgatgctttaagatttatagacatcatcacatataatatcccccaaacctcatgaattagttttgggatgtattgtcttcatcccattttccaggtgaagaaactgaggtacagataggcaggactagaacctctgcttcccaagtcccagtgttccttatgggaccccttttgtctgctcacattcacccctttctccttcagatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctggtaagagaggtcccccagcaggctggacgctgtgggtgtgagggaggaatgggccagggcacagcagctgtgtggggagccgaggggtcctcaccagggcctctgacaaagcagccatcatctgatttgttattattattcttggaaagacgttgaaataacattaacgaaaaactcaaaagaggaaaatctgccaccccttgctcacgtgagacctgttttcatttctgcaccttcttccctgtctttgtccccattcagttatattttctatgcagttgccttcatggcttaggtaccattctgcatctgactcttttcagttaatcttatattaaaaagattttccatattgcactttagactttatggttaccatttctaaaagctgtctatttcatgactttctaaatcctactcttttttcactttttggctatattagacaatgctgctgagaacatggttaagaatgatttgacttctgttatttccttataatgaaatccttggagagtacagttttacttgtatcgccttccaaaagtgttctacatgctgacctttcacacgacgtgaaggctggggctacctcctgtggtgggatgtgcccagctctttgccaagcagcagcacagtgctgtagttatgagtgtaagctttggaatcagagagggtagggtgctggatcgtggccctgccactgaccaactgtgtgactctgggcaagtcccttattctttctcagtgtcactttccttgtcttaagaatgcccactgtgcagggatgccttgaaggttagatgaaataatgtgtggaaagcccttagcacagtttttggctcaataaaggagatgcttccactgaaggcatccacagctgcctccctgaagtgtgctcagcatctcagcagggtgttggtgttacagtacggataggaagatagagcagtgcctgcagctaattcagtgacatcacccgctttcaagccgtcaccaaggcctgtactgctaccttctttgtgtccctcaaataatacagccaccccctccactgtgtcatctctcacctggaccttccaatgagcatttaatagctcttcctctcttagtcttgccaccatcctccacgtgactaatagagtatttttttctaaaatacaaacctcaagaacacatattctattttatgaaatgaagtgctgcctgtacaacacttcattaaaaatacaataaaaaataaaataaaatacaaacctaattctattactcggctgcttaaaaaccacctttggcccctcattgcctgtggaatcaaggcttcagcataaagacccatcaaaattacttacctcttcagcttcacctgccaccacctctacccccaatcaccctgccacagtacactgtaactggacccccagagggatgcatcttgcaggatgaaaccaccacactttaattttcttctctgcaagatgctggtaaaccctcctcctcttttaagtgccgcctcctctgtccttaatgcccccagtggtatccaaagcttcctcctccgctctcacagtcatacttttctctcctccatgttcccttgttcaatgtagcagttaacccacagggtgcccatcactcccttagaagagtgagcaatttgggatgtgtcttatgttttgagcccccgagggctgcacggggccttgtacatgctagagatcaattggtattgaatgactgaatgaatgctgaatgagtgttttgaggatattatgtgatgtgacagactgtgatccagaaacaggcactgagctataacggaaagttagagaaaggcttatgtgggctcaggtaatcaggaaaggactttagagggaatgagctccaagtgaggagacaacagtggggcctggaaggcaggagggagagttggagctctttctagtgggcaacgaggagtccttggaggaagtccttctcaaaacctttgggcctgcagcatcagccagtaacagaattttagagctgtccctagggtgcaggaaggggtttacttgtccccagtcttgaagggccataactcagggccctgatgactcataaacctctttctcctgaagagagagtgggctgtctcattcttccttctttatgccctctgcctccatccttcatcactcatgcatacttagatcgttttgtgatgatttccacttccagtcttctctgaggaggcccacgggatgatttgcttgctgcttcagatttggagtctagaatagaagtggagtggactcaaggaggcttaattttacacaggcaaggctcctaaggaccctgctgggtcaactgagcaaagggatggtgggtgctgcgctgtgctgtgtttctggcatagatgctgatctcctttgcatcctgacactgctgaatgcctcttttgaggagggggctgggccagtgaggctgaaaatggggagactgccatggttaaaaataacttgtgcactgcagttgggcgtgtttctttagcaggagaggagagaggcagcagagacgaggcgggactgcgactttagggtcttgctgaaatcttcatgtgattttagaatgctgtgggggctccaccagagtaatggaaaaggcagccttagctctgcagggactccttcacaggaggtgcaggggggcatgtctgggagaccctggatgctctgaagctctctgaagcagaactttaattgtgggaggaaatgaagtcagtcttacgctggaagccagctgtggcctgtgcaattttctcctccccctggatcttgcttatgaagccaagtgggggtgtctgaatcactctcaccaaatagagatcttccctttccctggcccactccgtgtcctgagctggtcttagggcctcgcccttgcttgagaggcctgatggggcaagcctggtggtcacacatgtcagagtagagagggatgtcggggctgagaaacctgctgatttcagtctacaaagccaaacaggttttagggtgctgaaccttgttcttcttcccatcttcctgttctcatcctttccctacatttgtttctccttcttctttgccagccatattctcaactccctaagcccagccacattcaaatgtaacaagagtcactaatgaaagtgtcttgtttcggtttatcagctttatggtttacacagagatttcaaaataactctgttaggcaggacatatgttagcatccgaggctcagagggtttaggggacttgcctatagttacacaggactggtaaacacagatcttctaactccaagtacattgctatttctttttttttttgagacagagtctcactttgccacccaggctggagtgcagtggcgcaatctcaactcactgcaaccttcacctcccgggttcaagcaattcttctgcctcagcctcccgagtagcagggattacaggcgtgtgccaccatgcccagctaatttttgtatgtttagtagagatggggtttctttttttttttggagatggagtctcgctgtcgcccaggctggagtgcagtggtgcaatctctgctggatctcagctcactgcaggctccgccccctggtttcacgccattctcctgcctcagcctcctgagcagctgggactacaggcgcctgccaccttgcccggctaattttttgtatttttagtagagacggggtttcaccatgttagccaggatggtctccatctcctgacctcgtgatccgcccgcctcagcctcccaaagtcctgggattataggtgtgagccaccgcgcctggcccgagatggggtttcaccatgttggtcaggctggtcttgaactcctgacctcaggtgatccgcttgccttggccttccaaaatgctgggattacaggcgtgagccaccgcacccggccctgtacattgttatttctatttccttaggcaatacctggcaaccagcccagtctgaatcttctgtagttgacaatctaaatctccacactcacctgagagacttggtcacttccgggaaaggcctcaggatcctggtctatagaaccaggaaaggggagagacaaagatcttggaaaatttgcctcttcccctctggctctctgtctttagtgaagagcagtagaaatatccttacttaatggtggggagcaacaaggaagtggggcgctagggagcttactgtagcaaggagtacaaccccaaagggtagaaacaaagagaggaagaaatgatgtatcccttgggacctgtggggagtatattgagaacagggtgcaagacagggtgtcacatggctgtacactgcacaacccttgggggtgcgattcacatcacatttgttgtcattgcagacgtgtacatttattattacaagtttcctgcagatggcagtaacatgttttgaagaagggctcatgtttgggctagggcacggtagggtgcaggaagattccaccatctacccatcaatcaggtattcattcatctaacatcacataatcaggaccctccctgtccttggcattgatattcaaagatgactgaagatgtggtcccttctgcatggaactcagtctagtggagaggacagaagggagaaaaggccgggtgtagtggctcacacctgtaatctcagcatttcgggaggccgaggcaggagaatcattagagctaaggagttcaagaccagcctatgagaccctgtctctattttttttttaagtagttagaagggaaaaaataattatatccccgtatgtgttgtgaaaaaggggagtgcagtgactcagagctaaggattggatccctctctggttgttcatttattcattccttcaactaaaaaaggggttaagctatgtgccagtagaaagcatctatgggattcattcctaggagtatcagcaaatgctgctgaaataatcattcccaacatctgctccattgtggccttctagtcagacgacaattgtctctctgcacagcccttgtttcagttggctttatattcacgttcattgttcccaggttcatttccctcaccagctctggaggtctctgtagtcaggagtcccatcttaccctttttgccctgggacagagagccatgagagcactacctggtcagaagctggagcttactcctctgggcccatgtgtctctcctccaagttgggagctctgagaagacatctcacaggcacctctctgcttcattcattcattcaataaaaaaaatggattaagctcctgccatgtgccaggcactgcggagataactgaatctggagttacaagacttaggcaaatgacctcacttcttggatcctcagtttccttatctataaaagggagatggtgataaagggtgtaaaagggaaatgaacgagaatcagaatgtgctggaaaaacacaggttcacatggcccgttactgcacttaacagtgtcattccttgtaacctccctggcagccagatgaggcagtggagactcaggaggccagcagtttcccaggccagcaaagaaggagcccaagcctcttatttctgtccccttcttttgttctttaggcctttgtcagggagcagatggaagtggcttattctggccaagccgtgagtgggaagaagggaatgcagggatgggaaatggaaccctaaagacaatctcattgggaatccttactcctcagctgccaaacttccttgccctgaggctcttcgagttttgtatccaggaaggctcctcctccttcccagcttctctacttcttcctggcagtgtcctcagagtctctggccctgtcctggagcttggtttcagtagcagcagagaagagcagaggagagtgccctgaaagtggggcagaatgaattgtagctacacaccaccagctcagctccagctctttgaaagtaaatctgggtcacattagctgtgggctggaacatgaccacgtgggcagaattctgtgcaggcagcagaaaagacagccaatctgtcctttctctgaggtgcagggcccctgtgggaccccagttggtgagggaaggtggtttctggattgcaaggtgtaatgccatcttaatgccatcatgcttttctaatgacatcctaggtgacatagagaaaggtatggaatggcagtttggctcatgcctttctgtttgttatgggagaagcctaggctgaaggtaggaatgcagaggaaggactggttactttggggactgtggaaggccatcatttctcagtctcatgggctcaggggttagatgccaccagagtagctgacactgcagcaggatctagggctgcacttgttctttatttcagcagtcctccccttgaggaaaggtctgtgaacagatccatcatcactaaagtgttatatggagcctggctggcctcctttttctggttgctgtggctagggcctgccatgatttggcccggccactgcttgttgccacatgtcagttacaagcctgccagcctgaaagccctgtcttggctttcctgtaggagcagaataggtgtcccttgctggaatctctgcctggatctgggatactgctacagggaaggtctgaagcccctataacttgaagggtgatgattatgagctgaagcttctgtcttaagctgtgccccacccctaccccagaagataccaggcttttgccttgtggtcaggggaggattctgcctggggcctcagtggatgtctctgggatgccctcccccactcattcacacatttcttcatgtgctcactcttccattcattcacgcaaagggctggctttgggagtcagctggagccctagtttcattgctcacttgctaattgggtgaccctgggacgttagtcacttcattgagcctcagtttcttacagttaaaatgggggagcaagagcactacctcagagacttgcacagtagattaaataaggtagttgggagtaggatgcttggcccagtacctgctatatattcagcccttgataattttttttttgagacagagtctcgctctgtcaccaggctggagtgcagtggcacgatctcggcttactgcagcctccacctcccaaattcaagcgattctcctgcctcagcctctggagtagctgggactacaggtgtgcgccaccatgcccagctgatttttgtatttttagtagagacccatggtgggtttcaccttgttggccaggatggtctcaatctcttgacctcgtgatccacctgctttggcctcccaaagtgctgggattacagccactgcacccggctgcccttgatacatattagctcttttcatgaatatcattcattcactcatacacttgttcatagattcatgaatgtgctgatttatccccttgcttattcactgattacacacttgcttatttaacaaatatccctagggctactttgctctaggctcagactgcacttcagagcccagctcctgcctatgaagaccgttagaatgcagcatgaactgagctacgttgcaagtccaaagagttttgaggaagttctggaagggaaggcacttctactcctgcccctccctggcttagagcaatgatagtatttcttctggggctgggaaaagaaataggaattagccaggacaacctgaagagacagggcacttcccggtggtttgcatctattcttgctctcctttctttggctttcgtaggaaggaaagaaggaaaatgaagagagaacagctggtgagaattaggaactaaagaatctagacggtggtttggggagtgaactctggactcagtttaggagcaccttagagctggtgccagctgggttcctccggtgaataatagctggtaaagtcactgtgtagagtcctagatgggtgccaggcattttacatacatcatttaatcctcatagaaccctgggaagtagttgctattctcaacagaaatgttaagtaacttgtctgaggttatacactgagcaaataatggagctgggattcagcattacttaatgtgcatggcgccccctggccctcaacatgtacaatatgccctttgcagttattcaagtgctgagtttctggtcagcctaactccaaagccctggcacttttcaggatatttcaaacatagtaaagtagtgagaatagtacagtgaacccccatcacccagaaacaagaatgatcaattaattcatggccaattttatttcattcatacaccgctgtcagtggaaaaaacacagttcctgttttttcttttttcttttctttcttttttttttgagatggagtctctctctgttgcccaggctagagtgctgtggtgccatctcagctcactgcaacctccgcctcccgggttcaagcaattctctgcctcagccccccgagtaactgggattacaggtgcctgacaccatgcccagctaatttttttgtattttttagtagagacggggtttcaccatcttggccaggctggccttgaactcctgacctcatgatccacccgcctgggcctccgaaagtgctgggattacaggtgtgagccaccgcgcctggcaagttcctgtttttccattctcttactcaacaatcaacacaagaagacttctgtgacgccaagatatgtggggacttctccccgccagcaagttaaacaatagttctgcagtggacaccagcggggtgtcctccagttcaattacaacactgtctacctggaaatagcatcagatctcacagtttgagggttcagtccccaagacattcccctactccacttctttttttttttttttttttttttttttgagatgatgtcttgctcttgttgcccaggctggagtgcaatggctcaatctctgctcattgcaaccaccgcctcctgggttcaagggattctcctgcctcagccttctgagtagctggaataacatgtgcgcgccaccacgcctggctaattttttttttttttttttttttgagacggagtcttgccctgtcaccaggctggagtgcagtggtgcgatctcggctcactgcaacttctgcctgccgggttcaagtgattctcctgcttcagcctcccgagtagctgggactacacgcacacgccatcacacccagctaatttttgtatttttagtagacacggggtttcatcatgttggccaggatggtcttaatctcttgaccttgtgatctgcccaccttggcctcccaaagtgctgggattacaggtgtgagccatcacgcccggccaagggattcttttcttttttttgagacggagtcttgcgcttttgcctaggctggagtgcagtggtgtgaacttggctcactgcaacctctgcctcccgggttctcctgtctcagcctcctgagtagctgggattacaggcgtgcgccaccacacctggctaatttttgtatttgtagtagaaatggggtttcaccgcgttggccaggctggtctcgaactcctgacctcaggtgatccaccgcctcggcctcccaaagtgctgggattacaggcgtgagccacggtgcccagccccaccccactccacttctaatgccaatcacaagactcagattttttttacctgtgcttctgactgactggctataatggggtgctggctgggtgcagtgactcatacctgtaatcccagcattttgagaggccaaggtgggaggctcgcttgaagccaggagttcgagaccagcctggataatatagtgagaccccgtctccacaaaaaataaagcaaaattagccaggcaggagaatcgcttgaacgcgggaggtggaggttgtggtgaactgagctcacgccattgcacttcagcctgggcaacaagagtgaaattttgtctccaaaaaaaaaaaaagaaaagaaaaaagaaagaaatcgggccgcgcatggtggctcacgcctgtaatcccagcactttgggaggcccaggcgggcagatcacctgaggtcaggagttcgataccagcctcaacacggagaaaccctgtctctactaaaaatacaaaattagccgggcgtggtggtgcatgcctgtaatcccagctactcgggaggctgaggcaggagaattgcttgaacctgggaggcggaagttgcggtgagctgagatcgcgccattgcactccagtctgggcaaccagagcgaaactctgtctcaaaaaaaaaaaagaaaaaaagaaattagccaggcgtggtggtatgcgcctgtaataccagctactcaggatgctgaggtgggaggattgcttgagcccgggaggtcaaggctgcagggagctgagattgtgtactgcactctaccctgggctacagagtgagaccggatctcaaaacaaacaaaacaaaaaccacaaaacacacagaggatacaggtgaagagatgcagagggcaagggcgaggtatggaagaaggaatgtggtgcttccatgccctcccttgtatgccacccttcaggaatcttcacgagttgttatcctggaagctccctgaatcttaggcctttcatggagacttccttgggtaggcatgattgacaaccatgcagaaatgtgattgggcaaaaagggtatgtctaacactaacagtgtggaaacccagcaaagcctggctgttcagattctgcttgaattttctatgtagtattccttcccccagggtatggggcaagactcctgaaataggggtctcatgattatagtcagaaatgtgggggaaggcggctgggtgcggtggctcacgcctgtaatcccagcactttgggaggccgaggcgggcggatcatgaggtcaacagatcgagaccatcctggccaacatggtgaaaccctgtctctattaaaaatacaaaaaaattagctaggcatggtggtgcgcgcctgtagtcccagctactcagtaggctgaggcaggagaatcatttgaacccaggaggaggaggttgcagtgagctgagatcgcgccactgcactccagcctggtgacagagtgagactctgtctcaaaaaaaaaaaaaaaaaaaaaaagaaatgttggggaaggctgagagtggtggctcacacatataatcccagcactttgggaggccgaggaaggtggatcacttgacaccagaagttcaagaccagcctgagcaacatagtgagaccaccatctccacaaaaaaaaaaattaggtgtggtggtgcatgcctgtagtcctagctacttgggggctgagaaaggaggatcccttgagcccaggaggtcatggctgcagtgagctatgattgtactactacactccagcgtaggcaacagagtgagatggctgtctcaaaaaaaaaaatggctgggtgcaatggctcatgcctgtaatcccaacactttgggaggccaaggcaggagaatcacttgagtctgggatatcaagacctgcctgggcaacatagtgagaccttgtctctagagaaaatcaaaaaataatccaggcgtagtggcacatacctgtggacccaaccactcaggaggctgaggtgggaggatcatttgagccagggagatggaggctgcagtgacccatgatcgcaccactgcagctgtgatcatcatcatccagcctgggtgacacagtgagaccctgtctcaaaaaaaaaaaaaaaaaattgcaggaaagattgagtcttgctttgggaggaaaaagaaacaggtgaaaggagggcaggagggcagaaagattctgttttctaagacttgacttgcttctgaggtctacagtgcctcaacattatagcagaaaactatgacaagggctatagaagttatgagccaggaactgtgaacgaaaaaacccatatattgcaaccccacttctccctccccagttatgtataagaaagttccggtagctgggtgcagtggctcatgcctgtaatcctagctactcggagggctgaggcaggagaatcacttgaaccgggaggcagaggtcgtagtgagtcgagactgcgccactgcactccagccttggtgacagagcaagactctatctcaaaaaaaaaaaaaaaaatcagaaagttcccgtaatcacatacttctaccttcctccgtttttgtttttgagacagagttttgctctgttgcccaggctgcagtgcagtggcacaattgtagctcactgcaacttcaaactcctttacttccctcactttttaaccattatattatactacctttcctctagtagtaaatataccagtttatctgcttcagagtccatgtctgaggactggaaccactgccacctgacctactgcccagagtcttcatgagggattcctttttttttttttttttttgagacggactcttgctctgtcacccacgctggagtgcagtggtgtgatctcggctcactgcaacctctgcctcccaggttcaagtaattctcctgccttggcctcctgagtagctgggattacaggtgcccaccaccacgcccggctaatttttgtatttttagtagagacggagtttcaccatgttggccaggctggtcttgaactcctgacctcaggtgatccacccgcctcagcttcccaaagtgctgggattacaggtgtgagccaccgcgcctggcctcttcatgagggattctaacacccagatgttcaggctccaggggcagtgtgtccctcctagcgttgcttggctgatcctctggtccttccagcttgaggttcaggctctatccccagaacacacagagctaggctagagcatatctggttctgttctgccagtataattaaactaaatatccaaaaaatgaatttcaaggattcaatcttgacagactgaagtcgagttgcaataggattcaggtccttaacatcatggcgggaggatagcacagtggctcatgtctctaaccccagaactttaggaggccaaggtgggtggatcacttgagctcaggggttcaacatcggcctgggttacatggcgaaaccccatctctacaaaaaatacaaaaattagctgggcatggtggtgtacacctgtagtacaagctatctgggggactgaggctagaggatcacttgagcctgggaggttgaggcagcagtgagccatgttcatgccactgtactgtagcctgggtgacaaagtgaaaccctgtctcaaaaaaaaagaaattcatcaagggaatgagttccatttttgttataggggcctgtgccccaggactgccctgatgctggtgaactgcttcacgtgactctgatctcaactgagagcattggccaccactctcaagggcctctcccggcctcagtgatttgtgctctttccaggctgcctgttagtgcccctttagaggtttctaccttgagatggtgttggatggggagctgtggcttcaagtgaagagaagtttcatagattaaaaaaagccacacctcacagtttggggaacctcccaattccccaaagagtatagactgcctcagaggatccacacagggtaagaccctgtcctgcctcagagcaggaagagagattgggtatggttcagcagggctcacattagcctgattccttcaagagtgaagataaaaacagttttactgacaaagaagctgggagacagcagaggggccaataccttttataactactattgttaggttctgaatgccagccttggcgctcagcatcttacatgctgtatttgacctaatcctcaaaacaactttaggaggcagatgtgctacagcagaggaagcagaagcccagagagtttggtaacttgctcaaggtctcccagccagtaaggggccaagcttggaatggtgctagctctgcctagggcaacccactgcctcccccattacaaggaacagtagtttaataacagctaacatctgtgtagcacttcaaggttcacggagtgccttaacatccattatctctactgtgccttgggaagccggtgcggtgaggccttccacgcccctttgggatagctgcctgtcaggggtccagcctctgctcatttcttccaggaagcactggagattatttggagttggctctgacgagccacgggagaggcctagggagaggctgaggtggagcgacttggccagttgctatggtaacccagatggctgagtaaccattttgagggttgctatggtgatgggctgctggtggcagggatcttgtcttcctgggtggctggcaccctccaggcctcttaaattgagatgttgcactttctgaacagaagagggcagcatgagagcaggcaaaggcttcttaccccagagcggatttgggaacttgaggcaaagcttagaaaaggtttctaggagctgggcagaaagggagctttggctggtgcccaagaggctggtggagcttcacttctgagactagaactaggtaattttcttccaagagctggtcaaaggataatgcttggggctgccccttcagtgcctggcatcagctactattggggaatataaaagttacagcagacagctacccttgcaaggaggaatggagagaatatgtgcatgtgtgcacacacacacactcactactagcaaagaatttcttttttttgagatggagttttgctcttgttgcccaggttggaatgcaatggcacgatctaggctcactgcaacctctgcctcctgggttcaagcgattctcctgcctcagcctcccaagtagctgggattacaggtgaccaccatcacgcccggctaattttttgtatttttagtagagacgcggtttcaccatattggtcaggctggcctcgaactcctgacctcaggtgatctgcccgccctggcctcccaaagtgctgggattacaggcatgagccaccgcacctggcctaagaatttctttataaagcatcagttaacacataaaataatgcagcatgaaccaaaggtgaagaaaagctgggaataaactttctagaggttgaggaaggagcactagcagaaagagaaataattttgtacttccctctttcctccctacacatgaagtgccctcagcccttgaccactgagtggacattgagttggattctcaattgtcttgaatcagatctggctccctcccccaacccccataacagttcaatgaggcatccattccttcagcaaatatttattgaacatctactatgtgcaaagtattgtgttaggcccagtgatgaagaaagatgaaatagatgtctttgccctcaggaacctatgaagtaggaggttaaggaggcagtgatacagacatccacagtacatgtacctggagttcaagaccaacatagtgagaccctgtctctataaaaaatttttttaaaaagctgggcacggaggttcacacctgtaatctcagcactttgggaggctgaggcaggccgactacttgagcccaagagttcgagaccagcctggacagtatggtgaaatcctgtctctacaaatagcacaaaaattatctgggcgtggtggcacctgcctgtagtcctagctgctggtgggttaattggtgggcgcactgaggcaggaggattgcttgagcctaagaggcagaggtgtcagtgagccaagattgtgccaccgcactccagcctgggtgatagagtaagacgctgcctctaaataaataaatagaaaaaaaatttcacgtcatttggggtgaactttcaaggtagatttcagtaggtggagttgggggatgggacattctaggcaaagcctcagagtctgattatagggaaaggaggtacacacaagggtgtcattggagatcagcctgaaaaggaagctagatgtctaaatatggaagacttggaattccaggcttagataagggatgctgtgagacaaacatactctctccttaaatactctagccttccagctagtcagtagtcacagacagccaagtattttaggatcatctggttcactcattcatgcatttaatcaaaaatttaggccgggtgcggtggctcatgcctgtaatcccagaactttgggaggctgaggtgggcagattacctgaggtcaggagtttgagactagcctggccaacaaggtgaaaccccatctctacgaaaaatacaaaaattagccgggggtggtggcaggcgcctgtaatcccagctactcgagaggctgaggcaggagaatggcttgaactcaggaggtggaggttgcagtgagcccagactgcgccattgcactctagcctgggtgacagagtgagactccgttgcaaataaataaataaattaaattaaattaaataaagtaaacaaatatacaaatgcacgcgcgcgtgtgtgtgtgtgtgtatgtatatttttagagaccaaattttgccatgttacccaggctggtcttgaactcctgggctcaagcgatcctcctgcctcggcctcccaaattgttggaattacaggtgtgagccaccatgcatagcattaaagaaatagttggccaggtgcggtggctcacgcctgtaatcccagcactttgggaagccgaggtggatggattacctgaggtcaggacttcaagactagcctggccaacaaggtgaaaccccatctctactaaaaatacaaaaattagctgggcatggtggcaggcgcctgtaatcccagctacttgagaggctgaggcaggagaatcacttgaacccaggaggtggaggttgcagtgagccgagatcacaccattgcactccagcctgggtgacagagccagactctgtctcaaaaaaaaaaaaaatatgtatatatatatatatgtgtgtgtatatgtatatttttagagaccgaattttgccatgttgcccaggctggtcgtgaactcctgggctcaagcaatcctctggcctcggcctcccaaagtgttgggattacaggtgtgagccactatgcatagcattaaagaaatagttggctgggtgcggtggctcactcctgtaatcccagcactttgggaggccaaggtgggtggttcacgaggtcaggagatggagaccatcctggctaacacagtgaaaccctttctctactaaaaataaaaaaaattagctgggcatggtggcgggcgcctgtagtcccacctactcgggaggctgaggcaggagaatggcgtgaacccgggaggtggaggttgcagtgagccgagatcacgccactgcactccagcctgggtggtgacagagcgagactccatctcaaaaaagaaaggaaagaaagaaagggagggagggagggaaagaaagaaaagagagagagaaagaaagaggctgggcgcggtggctcgcgcctgtaatcccagcactttggaaggccgatgcgggcggatcacgaggtcaggagatcgagaccatcctggctaacacagtgaaaccccgtctctactaaaaatacaaaaaattagccgggcgaggtggcgggcgcctgtagtcccagctactcgggaggctgaggcaggagaatggcgtgaaccccggggggcggagcctgcagtaagccgagatcgcgccactgcactccagcctgggcgacagcgagactccgtcaaaaaaaaagaagaaaaagaaagagagagagagagagagaaagagagagagaaagaaaagaaaagaaagacgaaatagttaatgagtgccctatatgtgccagatcagttgctaggtgctaaggatcctgtggtgaattagacgacaaacagtctcagccctcagggagcttacgatttagtaaggatgagagacactgtaccataacttcaagtgtgatgagtattaccaaagggtagaggaggacctattaattggaggcggggggggggtcaaggaaggctttcccctggggagtttcagcagaagcatgggtaggagtgagccaggccaaaggagagtgatgaagggttataatctgggaggaaagtcggttggatggccctgaggcgagataacacattagaggcgctgaaagaaatagaaagtggcagggctttagggataggggtatttgatgaggctttaattgggaggacaccaaggataaagggcattaatttccttgtattactcttctcttccactagatgcccttccgagtacatccttctgcttcccccattgcagccttcttagaaatgcagcagcagtctcacccatcaggagcaaaagaaaatcaaagaccaaaaggagaaagcctcagagcttttgcgactgtgtggtctggctataaatttagactgttgcttgaaagaagcgaaaaacctccccttcatagacttccttcttcccatcccccctggcagccgctttgttcctctagccttgtaaaattttctctgtataaaacaggaacatcagccaaacatgtggacttccccactttccattcattagaagaatgcattatttcaaaatctcctgggagcatttaaatgcaaattttgtcaagaaagcaatttgagtcttagagaagctctctagccacaacctaaagcagaagtttcttctttgatttgtgtgtttcttaaaaggaatctcaaccccttgccttctccctgcaacgcccccaggtcttctctgattctcacagcggactcttcccctttttgcccctgttctttcttcacctttggcaagcatcagtcacacatcttgaggaacctgctcacaaagtggcgcgtgtagcagccccaggtgggaatggagggacttttctatgtagtgtaatggacataaggaggcagatgtctgtgtgggggtgagatgtctgtgtggaggtgtttgtatgcgtgatttctgtctgggccttcttaggcctgctggtataaaataatatgggaaatgcagatgactcagcactgacacagtcaagatccccagagttagcatttctatattctctgctgtttacgaaaaatgtgcttgtgccatcaatcagcaactcatcctgcattttccgctaaaagccttttactgaaaaatgcatatacttcaaacttattccccttctttttgtaaactgagctcattagcagctgacaccaaactgagaactagttttgtttgtttgtttgttttagcacggaggattaaactggaaggaaatgagcatttgtctaaggatcctccctgtcctctttcaggcccttccctgcatgatcttcatgcccacaacttgggcaggccagcaaaacttgatgggaaaagatatgattaatgacttgctcacctgatttctgatcagggtgtggtgtggaaacaaccagcatgcacctattagcgaaaagcgtcatttgttttacttgttaccaatgtgctgagcattgaccaaaatacttggcactactcacaaggtacaaagacaccttccctagcctggggttaagaagtttctccttcaaactcttgagaatgggaactggaatggaagcccaagtcccaattttggttgctcagtgttgcatgaattctttttttacttgctaatgtgcccttattgtgagatcagccagtgtaacttcttacccacaaccacctctccagacctcctgaaaaatcaagctaacaggggaggataactgctaaatggggggtggcgggcacaacgtgtcacctacattgaccagagttcttcattcactgctcatggctccagcgcactccatgaatattgggattgaatgatacacaaccgaatgttggatcaaatgatgttgggagctctgtcctcaaaatggcccctaataaatccctacccatattttccagtttcctttctttactctttcctttcccctgatgacaaagaataattggcttccccttttcttccctgaccagctatgctccagagtcctttctttgttccctaacagtcctggttccgtctcaggttcccacatttctcccttttgatctctgtctctctgttcagatggctgtcacagtttaataattctggagggtctatcccctacagatttatgtctccctgtctctcctcttattcaccccatggtgcattcagaatcccgttttcgtgcctccctgggttgtcatttctcaggctctggctccttggcctggtttacttcatggtgctggatctgccccgtcacttcttgttcagcttcttctgtttctggaaaaccctttgttcccgggcttctttgtgggctcagtgtcctccggccctacactgcagccctgtctggatcttgcccttgtcctcgttctgaccgcgtctagccctgggatctgaggcatcgtggtcttttgccctctgctttcccttcagtttctccaggtccttctccagcagccgcacaggccccgctgggtttctctccagccagggagaaaccctcctttgtcccgctcccggcggcgtaggtcagcgctgactggggctcccgctcgccctgtggagccggcccgggtctccctgccgttcggccggcccagcctttcatcctgacgcgcggggcctcccacccagcgggactcccgcgtgggccggcctctcgcgcccctcggctcgggccccagtccgggccgggcgggggtcggcagcccctgggggacccgtgtgggcagcccgggcccagccggccgcagcctggggccgaggactcgccgggacccggaggcggcggggagagggggcggggaacgggccgggcctggcgctcctgacaggaggagccgccgccgccgcccgccgctgcagccgcgccggggcgggctgagggaggagcggagccgaggggtgaggacgcggaaacgcgagccgggaccggcggagcgcgagcgggccgggtgcgagcggactgaggagcggagcgcgactgccgggccgggcgaggcgggcggacggcggagagcgagggcgccgtcgccgtctctgagacgcacaaagggtcgaggctggggccgccgccgcctcagcgcgcgggcctggaaccggcagcccccggggctcggcgagaaggcggtgcgggcggccatggccggctacgtgccgggtcagcagccggccaaccgcagccaggagaaggagttcgtgcaggcgtacgaggatgtgctggagcggtacaaaggtagggccggggactggccggcgctgaggcccgcgggccggcgcagcgtggccttcggagccggtcggctcggcggctgcaggtggggcggccgggcggggtcgcacccaccgcgcggggcttggccctgagctgctgcttctcggggccagtttatttacagagttgagataagccttcggaaaccgcccccggggcagtcggcgcgctcagagcgccagttacatgatttgccctattatccggccccagctggaagaaggcgagacaaggcgctggcctggagaccggccgccgtggggagttgctggggaggaggaggaggaggagttgggcgcgggagaaaccacccgctctgctctgggtgcgagcttcctcccagaggggctcggacctctgtgtgcccgcggagagtccctccctcgcccccttttgtctctttgagtctcggatgagtcgcgtggaagccgaggttggaaagcaccttggtgtcttcggggtggggtgggcagcggtgtgggtgagtgtgcagtttttggtggcgagaccttaccccctccatctccccgggggtctgggcctgctggaggtaggggtctgtttttttcctcccacataaagatttgccttggagctcggatttcagccctgaaggctctcttgcgagacacttctgcaagttaatgcctaatctgcgccttgggtgtatggggagaaagttttgacagacaagagggcctgtggactgcatttccctaactgctgtaggtgcccctgaatggaagccagggatgcgtggccttgggaggcccttgccttgatctttaacatccggttctgggagtttgctttggctggcagttatgctttccacagacggggagattttcccagaaacgacacaggcagcacttttccccattttattcagctcgggcccttgtgactaggcccttagtttctttttatctgaaggagaggaaacttcagcccctatgactgagtccagcgtacttgtttacagcacctatccagtgaagggaaactaatgaagaagctgtaaaacgccccccctctcccccctcccccccactttttttttcttgtggcattggaactctgcttgggaatgcagcaggaaaaaagtagagatgaaatgcgaaaaaagacctactagggtttttgcttgttccctctgcatcagctcctgtaaactgtccagcttttcctgcctgcagcaagttttctgtcaaccccctgtggtctttctttttaagaaatgtggttcatttcagagcacaaagaggttagattgtgctgctgaacttcattgaaaaaatgctgctcagtgaatggttgcattaagtttcctttgcaggcttttgagtaacactgctctcttcagagagaggagatacattaggaccgtcccgggctgtgacagcttcaaaccagcagaattaagacccaaaataggtgaagaaatctcagcacctcactggatggtagtactggtgacctccagcggaaaggaagttggactcctagcaaatgaggctgggaaagaagggggcagtagggcttgttccaggagagacctcttttgttcagttttttttttttagctgtctcactcagtttggctttcctctgaagggccttgatcaggtgtataggaacttaatccttcccagacacaggtctctttcttgaggggaggaatgagttaaaaatggttgcccaaagtaaattacctcgagttgtatacggtggtcgtgcagtctgctcttctgatcggtgcagaacaatctctcttccccccactgcaccgttctcactgggaggtcagagtggcttagcatccgggcctttgttactttgcttatggaattcctgcattttccagacttagaaatccccgtactaccttaataggagaacagtttgtctaagcagaggagtgagctggaatctatagagtgaccaggggaaggagtttgtgaggatcatgccacgtattggttttggaaagagatgggaaaatagatattgatgatggtggggtgttctagacccttattggctggtcaccacattacttggatctctctctgctgctattaatttgtagtcacctcattatacaggctgaagcaggatttttatatgcagaaggagagctaaaattttcagctgcctaaactgcccctagggccaatgggagaagggcagtaatgtatttggagtgtgagggaagcagagctgtgtgtagtgcagctgtattaggaatggtagtcaagtatgggttttccagaactgtgcttggcaaccatttttttttttttttctgtgtggtggcagtgagcatggtcttggcaggattagatgattcagcatggaaataaatgctctcccttatttcctaaatgtcccaaaggttctttcagatagctggccagtaaacaggaggcattagataataacactggattctaacagttcagagtgggcagcagccaagagaaccagggtatatccttcatttccccaattctctgacagtcattaaagtctctcttggaggtgccacaatgttagatgccagaattctgaatgagatctggttcctgcccttggttattccatctagtaagggaaagatacttgcaaacaagtagttgtcatactgtgataagtgctagaacagagatagtatggaagccagaggaaggctgaaaccctatttggatttacctgggagatttgacaaaggaggtgacatgagagggttttttttttttttttttttttgagacggagtctcactctgctgcccaggctggagtgcagtggcacgatctccactcactgcaagctctgcctcgcggttcacgccggaggaaattaagaaggaatagtcagggaggtaggagaaccaggattttattcctctcctaggatagagaccaactctactgaagaagcaggtcacatatgagcatagttttaggttttaaagaggtggttaaaaaccagcacacttggttgatggtggttggttaagacagaattagacttttgttttcacaaagctttaaggactaaatagtctttacttgctgggctgggctaggaataaaagagaacattcacatttcaacattggtaacatctatctggtacttatgaaattcagaattgtcactaagtgttgtgggttatacgaagctagttaggaccaattttcatttatcctagtgcagaaaataacttataaaacttactgcacagagggttacaagtgaagagtctgcatattacttaatgtacaaaattgatatcgtagaaagactatgctttggatttcttctgttgtgggctccagtcctagtttttgccagttaatttctactgtgtgaccttggaaaagatttctctcatcttttgggtttctcatctgttaaaatagggatgataatactaatttcttgggattcatgagaatataaatgagctctgggcatatatttgtcctttaatgttccattttattttactttactttattttgaggtggaatcttgctctgttgctcaggctgggatgcagtggcacgatctcacctcactgcaacctctgcctcccaggttcaagcaattctcctgcctcagcctcctgaatagctgggattacaggtgcacgccaccatgcctggctaattttttctatatttttttttagtagagatggggtttcaccatgttggccaggctggtcttgaactcctgaccttgtggtctgcctgcctcagcctcccaaagtgctgggattacaggcgtgagccattgcacctggcctattttattttttaactcttttctctccttttttttttttctatctcctaccagaaggaacctttaatgtttagaaaaacgttgatttatatcttatttaagctttataatatcctgaaggatagtattacacagatgaataaatttaggcacagagacttaaaattactgtctaagagccaggctccagatttctgggtgaaggtttcacattgtatcacagaagggagttttaaaatcacagtagatgacttgggctaagtgagaaattgtgaaaatgctttaattgttagtatcattattgttgttagttttagtttctgaagtatagtcacacactttaagtgacatacatttccagatctctgaactgtggagaatttcttttccccttattatgggagaagttttacgatatataaatcacattgaaattttcatacaaaaataatacaaaataaaataaaatacaaaaaatacaagaaataaatacaaaaataatttttaaaatagtacaaaatgatgaaattttgttaacacagtgattggaaaatatgggttgaggatttgggattgtttacctaagtgacgctctgaagcaaccttttggttatatgtagattcagcttatttatcctttttagtggatgttgttcttttttttttttttttttttttgagacagggtcttgctttgttgcccaggctagagtgcagtgtggtgagatcagggctaactgcagccttcacctctcaggctcaagtgatcttcctacctcagcctcccaagtagctgggactaacaggcatgtgccaccatgcctggctaatttttaagtattttgaagagaaaaggtctcactatgttgcccaggctggtctcaaccccctggcctcaagtgatcatcctgccttggcctcacaaactgctgagattacaggcttgagccaccgtgcctggcctacactcagtttttaagttcctttttagatcaaagtcctagagttggagtggatagtttttagccagaacaaaagagtaagtgctacttctggacatgaacactgttaattcagaaagtgagtcaagtcagtctgctgggaaatcacaagttttggccacattcatgctgttgaaataataaaatgtgtccatgtgctaacagtgcttatgggagctactgccttgtcttgggcttgttggcaaatgacgtaatacaaaccagggaaatgcaccagcgtaagcctattatactggtatttttcagtgccaattccaggtttaagagatcatggtggaaagaatacttcagagtgcatatctgagaacagaaacatcccaagatcaaaagtcacaaatgaacaattatagattgtaaggagtctgttgtgttttctcagtgttcttgaaaacacccagtctttactcctttttctaagtaaggttggccctttcagcttctgataattatatattgagccatgttgtgactaggttgtatggaatgctagagctcctgtttttactctcatggttttgattggagttgaagcctctctcgtctggcttctattggtggcatttactaattttctggcctggtaaatggcttgtggtagctaagaatgtttattccagttttttggagacagggtcacccatgtcagagtgcagttgataccattgtgtagctcactctaacctcaaacccccgggctcacatgatcctcccatctcagcctccggagtagctaggattaaaggtgcatgccaccatgcccagctaattattttatttatttatttatttatttatttatttttggagacggagtctcactctgtcacccaggctggagtgcagtggtgcgaactcggctcactgcaagctccgcctcccaggttcatgccattctcctgtctcagcctcccgagtagctgggactacaggcgcccaccacacacccggctaattttttgtatttttagtagagagggggtttcaccgtgttagccaggatggtctcgatcttctgacctcgtgatctgcccgcctcggcctcccaaagtgctgggattacaggcgtgagccaccgcacctggcaattattttattttttttatagagatgggatcttgcaatgttttctaggctagtctcgaactagcttcaagccatcctcttgccctggcctcccaaaacgctgggatttcaggtgtgtatcttctgaaagtacagtttgttacttctgatgaaatatttttttcttccagagcttctcagtttctgaagtaaattagaattaatctctgattctttgtctctttcagggcttttcataatttgacttactctgcacacccaactataccatctgttactgcctaacacatctctcttctccatttggactggtcttagcaaccttagcaacccttccccctgtgtcctgtgcctttgtttacattctcttttccaggaatgccctctcccttcctgattattcaaatctttttttttttttttttgaaacagagtctcgctctgttgcccaggctggagtgcagtggcatgatctcagctcactgcaacctccaccccctgggttcaagtgattctcctgcctcagcctcctgagtagctgggattacagatacatgccaccacgcccagctaatttttgtattttttaatagagacggtttcaccatattggccaggctggtctcaaactcctgactttgtgatctgccctcctcgacctctcaaagtgctgggattacaggcatgagccactgtgcctggccacagtaaaatctttaaaagatttttattaaagaagtaagatgtaatcccagcattttgggaggccaaggcgggcagatcacttgaggccaggagttcgagaccagtcaacacggtgaaaccctgtctctactaaaaatacaaaaattagtcaggcatggtggtgcaatcccgtggtcccagctacttggatggctgaggcacaagaattacttgaacctgggagacagaggaggctgcattaagccaagatgacaccactgcactccagcctggacaacagagcaagactttattgcaaaaaaaagaaaaggactttgttctagaaaagtcctgggatgaggggtaattctttttcaaggcaaatcttctagaaaagaattagcagtgttagtatctaaacttaattccctgtacctgcccaaaatgttctcaaatacaaccctctcttctttaacagtcatccctagagctgggcatagtcccagtttctaagaaggctgaagtaggaggatcgcttgagtccaggagtttgaggctacagtgagctatcatcaccccactgtactccaacctaggctacagagcaagaccccatctcaaaaaaaaaagcaaaaacatcatcccttaatctaacctcatgactcaattacaatgcggcttcccagagagtagatttctactgtcacccatcatttacataacctcttcattaatcctgcccatcacataaaactcaaattcttcctactggcattccagaccctcctctccctacccctaatctcaatatcattctttcagtgcttctaagtggctcacccatctccctaataccactttccccatcatagtatctgcttgtaggtactagtagaatatagtgcacacagtgagcttattcatggttgttgactgactaaaaagcacagaaaaaaaaatcacttcctatatgtctcaatccaacatgttcctgcaggttgaaaactataaactccaaaaaacacttcaagcaagccctttcctttcatcaacacaaacgaattgtgtttatcgttctgaataaaaatcactatggaaatttgccatggtaagagggaatccaacagtacatctggcaatgctcttgtctaaaagaaagatgctgactgaccaattatttaattagtcttaggtgactactcaaatcatccctgataattggaacattcctgatggttgacacatggtcatacagaagaaagcaattttaaacagagaaaaataaaagcttgtgccaaatgaaagcagacttccactataacacaattttaggtagccacagcaagtggaggatatcagatcccaggcaagcaaaaaagatcccatccttggccaggtacggtggctcacacctgtaatcccagcactttgggaggccgaggtgggtggatcacctgaggtcagaagtttgagaccagcctggccaacttggcgaaaccccatctctaccaaaaatacaaaaattagccaggcatggtggtacatgcctgtagtcccagctacttgggaggctgaagcaagagaatcgcttgaacccaggaggtggaggttgtagagagcccagattgtgccactgtactccagcctgggtgacagagtgagactccgtcttaaaaaaaaaaaggtcccatcgttgctcactccattttttcccaagcatctacctgttggtcagcttgcctctctatcccctgcccctacacacccccacccaacaaccacagaaagcatattgtctaaagctctgtatactttactgttttttttttttttttacaattttccacattaatatgtgttcataatatgaaaagaaattattcaaaaatataaatcagttggcttccctggtggtctagtggctaggattcggcactttcaaaaatataaatcaaagtccatgactctaaaaataacatatgcattgatatgctcgcccctttgacccttctctcaagagaaattccctgccaagtaatccacatacataagaagtgtaaaaagtccctagattaaaagagcataaaacttcattatggaaacacagtagtcccagctatttgggaggctgagacaggaggatcacgagtccaggagtttgaggctacagtgagctatgatcacgccattgcactccagcctggatgacagaggaaatattaattttagagtaatcagagaaagccgcatgaagaataaattaataagtatttattgaatgtctaccatgaaccagggagtaggtgatgtgctgagaagacaaagatattgtccttgtctctctatgatcttactgttaaatggaggaaacatattggcaaactgacagttactgtctattgtagggagggctatcatatagataaatgctgatgctgtggtagtgaagaggagtacccagtatagccagagtgagaaagtgtccaggaaggcatccaagagtaagtgaaacctgaactgttacctaaaggatgtgggaccctgagcaaaaagtttggggaaagagcattctgggcagcatgaacagaagtaaggggatgagcaagcttgagagggggaatattgggcattgataaggttggagcataggatgtgagggaaggagagatgagatgagatagggagagtgggcaggacaaaaatgttgactggctttgtatgtcatattgtatagagcttggactttatcctaaaggcttttgggagccattgaataaaagtaggcaaggaagactatgcttagatttacattttaggagtacttttcctctggcagcagtgccaaggaaggtaggggcgaggaggaaagactagtggcagacaagttaggaagctgtcacaggaatttaggcagggagtgaaactaaggttgtgaaaatagtaatgtaataaagcaggcaaatcaagaaatgtgaaggggtaacatccatgtgttttgatgactaattgtatgtggtatatgagggggagagggaagaacctaggatgacttggaggtttctggcttgagtatttgtgtgggtgggtcgtgtcatgaactaaaatagagaatataagaggaggaaggttattttctgtgaagtggtggcagtgatggtccacgagaagatactgagtttaatttaggttacattgcggtcgaggcttctgagggatgctaggtagagatgtccaggaggtagttggttgtaatgaacatgaaacttaggagagtgataggtgagagggtgagagagtcatcagcttatcaaaccacagccataggaggggagaaggagctggctttaggagtgtatgtatattgagacaaaaactctggggaactccaacaggagagtggtgtcagaagcagagaaagaggatctcctgaaggaaattgtccacagaaagggagtggccagaaaggtaagaggaacaggagagaagtgagtttcaaggagagtgtgacacacattgtagattatgcagaggtcaaataaggcaaagactacagatgtccaaaataaaggttactgctactggaacattttcagtggagttgtgggaagtgaatggaaagtgcagaagaggagtcagtgacctttggaacttggactttgaaggaagagagaggaggaagacaggtgaagaagggtggggagagttttgtttatgtattgtaacacaggagagacttgagcatgtttattttaagtgctgttttgaaagagccagtagagaaggaagatataatacaattcaaagacggggagaaaaattgatggagcatgggctctagagtcaaaagttgtgtcttttagaaagatcagagggttaaaaataagaatgcaggtgattaagttggttggttagaggtgtaggaacttgagggaatttctcctgatgctcatactctctctatgaagtaggaggtgaagttatttgctgagagtcaggaggaaggaaagaaggggtgagtgtgtatgtgtgtgtgtgtgtgtgcacgtgtgtgtgtgtatgtgtgtgtgttttccctctagccctagaagcactcaacaacctgattgtaatagattccaaggcagacaggtagattgatctaggatcagaattttccagcatagttttgacggaagaatatggggtccttgtagtttgtcttaaaatgtagcatcagtttgattattgattgtttgtactgttgttctctggctggcttgtattttggctccccagtgaaattgtctactcctctgggaagaagcatatatgtaacttttgcattcctgcctgtcatttagctaaatactatgcagaaattaattcttaagtttttgttgagataatttgacttttggacaggacatcttgactcttgacatagagagaggctttcctcacttgtggtctttaatccccatctcattatctgacatggatagtggaggattcactcactctccatgagtgaactccaggcctagcttcttcattagtcttaacaggttagctttactactctccccagggcagttgagctttgctttccatgaaggttatgtagttaatttgtactaggcttgtgaagacctgggtgtttacaagactggacagagaggctgttgtggaaaatgcagcctccttcttgtttattttggcaggcaggcaatgaaggagatagatttgttctcatgactcagagccctacctgctttaccttaacaggttcaatataaccaccacctttcagatgtgatagtgtccttcagagtttatctgacctttatatctaaaaagagtattagttaccctttgccctctacttgcttggttttttttcacttttattccagtgtagaggatatttcctaatgtgttagggccagctcagaattgatgtagttctttcccattggcacattccgcatctttgtttgtttattgccatgttcgccacagtgtgccttgttttgcgctccttgttttgtgaagctggactcttatcagataaacttgccatgagtcacactggggagtggaagtatgtctccactaatttggagaatctttgatcttgtttcactccctggtttggcttgtccagtgcaatttgtctctcaacctgcaagaggtgtgtgtgtgtgtgtgtgtgtgtgtgtgtgtgtacttgggtgtcccttgcctgtggcttcacctgttgccatgaatggttgacttcagggcatgcccctttgtgtatacagacttcctctactattgttatcaccatcagcaaaaatgtctctgttaagagcctctttgaatgtagaatatagtatataacactgagagttcataaaccctctgtcctctagggatttacagtatataatacacattacaaatgacaaaagacaataaagaatgtgtaagcggttgaacaaataatggattattgctcctcatttagctatcatattcacagtagaagatatcctaaaaagacatgtagtcagtgaggaagaggattaacagagaccagatcatcttcagctccaactaagatggcagagagctgccacctgtggccctttgatgccaggtaatttctctctgatatcctttctagtcatgcaggacctttttgccatattatctatacatatggggcaggatcctaacaggacctttgctctctagtggtaacctgtcactgaaatgggaggctccagtttccagcagggagagtgcctggaaggcttggctcttctggtacagttatctttgtaacttgagaaaatttattccagacctactacaaacattcgtgtgctcacaagcaccacagacagagcagcagccaaagctagctgcagcctgagcatgggtcagtgtagggaaagaagctaactgacctggcctgagtcacctctagaggggaagaatgtaggacttgtcccagcctttgttggttagtttcccaaatggaaaacagggaccagagtaggtggggtactttgaggtcctcatacctttcagaggactggatccttgttttcattcttgttcttattgttaataagtgtaataacagtattcatgtaacactgcctttattaggaagaatgaggaactgccaaagggctggaaattttctttactttccctgtgggagagaaagatagatggagcattaggtgcccatctctcaggcctcctttctctgattatcctgtgggaagtacctggaaagcagtgaggcattggaaggaatggtctaggccttggcatgagtatgtggtcgtgaaggcataagacaaaatatcttgtgtagctgtagcacaggtgctgtggtaagaggaaataggtttgggggcagtattaagggggctaataagcgcagaaaatagtatttgttgctgtcgttagttacttcactttgccttgcctatatgtattgtctgacagcagagccgaaactccagcatccttttgtctcctcctcctcctcctctttttcttattttctgacttataaagatgtatatcttcaataaataagcttgtgatgatatggaaagttaaataaataaaagttctagaaattggaaaactaaatggtgatttcattgtggtctttaaatataacaagtgttataggccacggtggctcacacctgtaatcccagcactttgggaggccaaggcgggcagatcacctgagatcaggagttctagaccagcgggaccaacatggagaaaccccgtctgtactaaaaatacaaaattagctggcgtggtggcccatgcctgtaatcccagctacttgggaggctgaggcaggagaatcgcttgaacccgggaggcggaggttgcggtgagccgagatcgcaccattgcactctagcctgggcaacaagagcgaaactccgtctcaaaaaaaaaaaaaaaaaaaaacaaccagaaaaacaaacaagtgttataattgtaattcttgtaattccttaagccaaaactccattataacatttcttagtttgttgttgttgttgttgttgttactttttgtgtgtatttgtttgaacttcccagctgtattgtgatctctttgaaggtctagattgtgtctgatgagatgcatatgatgcacttcatgaattgagctactttgcaaatgatgctggttgttttatttcttagtgttttcagcaacttccagcacctttcacaatgtttctttccacgtggttgtcccacagatgttgcatacttgatatgtccaaaaggggcattgttgtccccctccctgctcctggacctgcctcttcttctatgttcccgattttagtgaatgcttttcccgtccatccagtggagaaattctaaatactgaatgctttgtgtatactaaatatatattctgtccatttcatagtttaaagtgttgctatcagatggagaattgtaatgtgcagaatataataaagcctctttttttttttttttttttttttttgagacagagttttgctcttgttgcccaggctaaagaagtgcaatggcatgatctcggctcaccgcaacctctgcctcccaggttcaagcgattctactgcctcagcctcctgagtagctgggattacagacatgcggcaccacgcttggctaattttgtattttttagtagagacggggtttctccatattgatgaggctggtcttgaacttctgatctcaggtgatccacctgtcttggcctccgaaagtgctgggattacaggcgtgagccaccgcacctggccaataaagcctctttataccattttctaatttctatttcatagaattttaaaactgcataagcctttaacctctgtttctcaaattcactttcccctttggaatgttataattctacttcacctgactcctggaactccctgttatcatgtaacatattttaattattttgattgttgtctgagtcttcctactacaagagtgagactgagtctcactcttggccaggctggagtgcagtggcgctgtctctgctcactgtaacctctgcattctgggttcaagagattctcctgcctcagcctcccgagtagctaggattacaggtgtgcaccaccacacttggctaatttgtgtattttagtagacacagggtttcaccatgttggccaggcaggtctcgaactcctgacctcgtgatctgcccgccttggcctcccaaagtgttgggattacaggtgtgagccaccacacccggccaacaatgcaaacttcttttaaaaatttgtttttaaattttttgtgggtacataataggtgtatgtatttatgaggtacatgagatgttttgatacaggcatgcaatgtgaaataagcacatcatggagaatggggtgtctatccctcaagcatttatctttgtgttgcaaacaatctaattacactctaagttattttaaaatgtatagttaagttattattgactatagtcacccttttgtgctatcaaatagtaggtcttattctaactattttttaaaaatgtggaacacttcacgaatttgtgtgtcatccttgtgcaggggcctccctaacctctctgttgttccaattttagtatatgtgttgcttaagtgagcactagaatgcaaacttcttaagaatagaggtttttatttgtgtattaactaatttccctagcacctagaagagtttctggtataaagtagctgctccaatcaatattgaatgaatgaattggaaatgttaagttagttcactcttgttccccataaggaaaagaggcatggaaaggcacaataacttgctcaagctaacgccatatctccttaccaggtaagtgggttttaaaaaagtttaaataaaacgatgcttaatcacagttcctttatgtgatttggtactaatgtgtattatggacttaactgtattatctctatgaaaaggggtgggggaagcaaaagggaagaagctaatatatattgagtccttactatatgccgggtattttgttttattttatttatttatttatttatttatttgagacagagtcttgctttgttgcctggtctggagtgcggtggcactatctcggctcactacaacttcgcctcccgggttcaagtgattcttgtgcctcagcctgctgagtagctgggactaggcgcgtgccaccactccgggctaactttttatatttttagtagagacggggtttcgccattttggccaggctagtctcaaactcctgacctcaggtagtccgctcgtcttggcctcccaaagtgctaggattataggcgtgagccaccgcgccaggccagtcttatttaattgtcataaatgatatcctatgatagtccagtaaccttactagattttacagatgagagaactgaggcttaaggaacctaaatcacttcccagagggtcacacagctagtaagtgactgaactgggttttgaacccaggcccgattaactccatttggccctcttttaccttaaggcacaggaaaattttggatttgtggtctgggttgctttaagattcccagatcagactactcttgaaaatggtctgatttgaactactcaagtagagttacaaaaattgtttaccttaagacagccccatggagcagtggggttgtgtctgtagcgctcttgagtaaaaaaaaattctgtgttgcacatactcccactcagttgtatcgtatataattcacatttcagactttctttttaaccagggatccagaataactacagaaaggtgattatgtaacatacttgtacagtgcagccacttctgtgtttggtaatattctttttttttttttttttgagatggagtcttgttctgtcactcaggctggagtacagtggcgcgatgtcggctcactacaacctctgcctcctggattcaagcaattctgtacctcagcctcccgagtagctgtgattacaggtgcccaccatcatgcctggctaattttttgtatttttagtagagatggggtttcaccatcttggccaggctagtcttgaactcctgacctcatgatccacctgcctcagcctcccaaagtgctgggattacaggcgtgagccactgtgctcggctggtagtactgttaagcgctaagagcacaaacaaaaactatgtctaaaatgtagggcaggtagagcaggtgaggattaaacccagttgaaatcagcggtttcagtagtaagtgggcagatcataattacctgtgttgctcagagacctaagctgagagtgggggtggggaaaggtcacacccattatctttggagaaatgatgagagtaaataacccatagtttccagtttattccagaagcattctcgccagagtcacaatgttgaagtgggttttgagttagaccttgttaccccagatcatccaaggttaacatagtttccttagataccacagccattcattgtgaacgctgttagcttcctcttaggtagctttatgtagcctaccttagaaaggagggtggggtctgggaggggagaggagggaatagcaaaagtagcagagaaacaaaggactaattaggaggttcctcagtcatttgggagtagatctttttcattagctgatcactgagatcaaggatggaggtggtgatccaggaggaggaggagttgtagtaatcagaagcagaatagcataacttggcagtcagtggtggtccaaggaccagcagcatctgatagcttgttagatacatatatatataaattttttttttttttttttttttttgagagagtctcgctctgttgcccaggctggagtgcagtggtgcgatcttggctcactgcaacctctatctcccaggttgaagcgattctcgtgcctcagcctcctgagtagctgtgaccacaggtgcatgccatcacacccggctaatttttgtatttttagtggagatggggttttaccatgttgaacagactggtctcgaactgctgacctcagatgatccacccgcctcggcatcccaaagtgttgggattacaggtgtgagccactgtgcctggcctgaatcaattttaattttatcaagattcccaggtgattttttttttcttgaggcagagtcttactctgtcacccagcctggagtgcagtggtgtgatgacagctcactgcagcctcaatctccccgggctcaggtgatcctcccacctcagcctcccaaatagctgggactacaggctcgtgccaccatgcccggctaattcttgttttgttttttttttttttttttttgtccgaggcagagtcttgttctgtcacccaggctgaagtgcagtggcatgatcttggctcactgcaacctctgcctcctgggttcaagcaattctcctgcctcagcctcctgagtagctggggattataggcgcatgctaccatgcctggctaattttttttgtatttttagtggagatggggtttcactgtgttggccaggctggtctcaaactggctggtctcaaactcctgacctcatgatccgcctgccttggcctctcaaagtgcgggattacaggcgtgagctactgcacccgaccaattcttgtatttttttttttttttttgtagagatggggctttgccatgttgcccaggctggtctcaagctcctgagctcaagtgatccgcccaccttggcctcccaaagtgctaggattacaggcatgagccaccatgccaggcccccaggtggttttttaattcgattctgtgcccgttaaagtttgagaagcaccaagtttgtgattaggtggttagtgcaaggggctttggagttggacagacctgggattgaaacctggtttggccacttactacctgtgtgactttagataaattatttgaactctctgtgacagtttctcatatgtgtaataggggaactctctatttcatagggttgtgggggagagtaaatgacatggtgcattttgcaactgacactatcttagatttaatgaaatttagtaatgtctgtatcatattaagcactgagtctagcacagcctagcatactcaataagtgttattactaataattaaattaggcaaatttacaggaataaagaggctttctcctcttcctctttttctctttatctctcaatgagtacgtttgtctgcagttttataaagctgtattgtgtgtgtacactctttggtgttttgcctagcattatttaatggtagttatagcagcagcattaacacatcttgtacttattaatgtgccaggcataatttttatgtactttatgcatatattatttcattcagtccttagagcaaccatgtgaaataaatattatctccattttcggatgaagaaacagaacaaacaggttaagtgacttgcctgagatcacatagccagtcagtggcagaatcaggatttgagctgagacactcttattccagcatctgtgctctattttcatgtattgctattgctctcaaacttatgtggtgtgatggaaatcaggaaactttgattggatacttgattctgccactaatttatttgtgaccttggtcaagtcacttgtcgtctttgggcctatttccttattataaaaatggagggattatcaaactcaaaagcaattaaacaaaaaaagacaaaaaatgaaaaaagagtaaaacacaaaaacggagggattagatgagatttgtaaagtctgttcagtgattcattcaacatatagtgatttcaagcaaagattggaagaaaattttatctagggaattggttcaaaagtacttgttcaagcaggttggtgtcattaagaacaaggggtttgaatcttgactcagccacttcctggctatatgaccttgggcaacttacttaacctttctaaacattgatttcctcgttagtagtggggagaatagttcttaccttgcagggatattgtgaggtttgaataagataatacgtattagcacctagcatatgtgaaacatgcagtggatactcaatatccgtgagttgtcttttcttccttccattcattcgggagatgcttagggaagcagatataccagattcaaaaggatttagaccctcgcttggtccttatgtccttttctgtaatggtattctcacctttgggaaatgagaattagtagggaaggaagtgtgcatatagccaggtcctgtctgtttttaaataatccatctttttgattttagattaaaatttctttttacaatatataatttaggccagtaatcccagcactttgggaggcctaggtgggcggatcgcctgaggtcaggagttgaagaccggcctggccaacattagtgaaaccccatctctactaaaaatacaaaaattagctgggcgtggtggcatgcgcctgtaatcccagctacttggaaggctgaggcaggagaatcgctttaacccgggaggcggaggttccagtgagctgagattgcgccactgcactccatcctgggcgacagcgcaagactctgtctcaaacaaaacaaagcaaacgacagcaaaaacatataatttatgacaggataaatgccattttttttgaccagctgggcaacatagtgagaccctgtctcatagtaataacaataacgaagtaccacaaactgggtggcttaaacaacagatatttattgtcttacagttctggaggcgagaagtctgaaatcaagttgtcagcagagttgattccttgtgaaggctgtgagggagaacctgttccatgcatctcttctagtttctggttgcctcagatgttccttggcttgtaaatgatgttctctcaccgccttcacatctgtatatgtctgtctgtgttcaaatgtcccctttttataacactagttatattgggttagagccttttcgaatgacctcatcttaagttgatcatttgtaaagaccctatttccagataaagtcacattcacagtccctggggttaggacatctttctgggggatacaattcatcctataacaaatggtttagggccgagcacggtggctcatgcctgtaatcccagcactttgggaggccaaggcatgtggatcacctgaggtcagttcgagaccagcctggccaacgtggtgaaaccctgtctctactaaaaatacaaaaaaattagctgggcgtggtggtgggtgcctgtaatcccagttacttgggaggctgaggcaggacaatcacttgagcttgggaggcagagattgcggtgagccaagattgtgccactgcagtccagcctgggcaacagagcaagactctgtctccaaaaaaaaaaccacacaaaaaacaaacaaaaaaatcaaaacaaatggtttagtcactttgtaacctggacagaggagtgaacatatatgaaattaactttctttggtcttttaagatttattactaagatttaactagagttaaaactttccttgtcctgttggccgggtgccttggctcaagcctgtaatcccagccctttgggagggtgaggcaggtggatcacctgaggttgggaatttgagaccaacatggcgaaaccccgactctactaaaaataacagagtagctgggcatggtagtacacgcctgtaatcccagctacttgggaggctgaggcaggagaattgcttgagcccaggaggcagtgattgcagtgagctgagatcacgccactgcacgccagcctgacaacagagcgagagactctatctcaaaaagaaaataaaagctcttcttgtcctgctaattctgcattttgatttttggcagcatttaggaaagagctgaggtggacctggtgtgtagcgttggtgggagttccttcgttttctgggctgaatgatttaataataatataatagtggctttcattaatttcttactatgtgccaggaatggactgtgttaagcactttatatacattaatccacttaattctcatgataaccctgtgaaatagattatctcattttgcagaggagaaaagtgggtctcagccagtgaaataacttgctcaagttctctcacccagtaaatggtagagcagtcatttatgtgtagctctgttggacttcagaactccagctcttaactcagtatatacttttccttcacttccttgaatagaactgtttggcttgagtctccttttctctaaaaactcctagttctggaatggtgccaacttaaggggtcagggaagtgacctttacttgtgttcctttgagctgttattgttttcattgggaaagagaatgtgaagtcagttcacatttcttacctactggttgcagtcttgccatggggccctagtcagatgtgagatgttgtaagttacttaaaaaaaaaaatgtcctagtgattaagaggaaaaaacataggcctgctatgtttatgtaactctcttttgtattattacaaaattaaacatgttcactgtaatacatttaagcagaaattacaaagaaaaaagtaaaaattctcttttctagtctttattttctccacctaggcccactggtcagggtaaccactgttcaagctttggtttgtatccttacaggttttttcttgccaggcttgctttggaactgcacctttacatcctttatattcctttaggttggttgtgtctcttcttgactcatgagccttacctcttatttatttttattaccatacatctggcttacatttttattttttattttttttttagagacagggtcttgctacattgcccaggctagtgtgcagtggctgttcacaggcaccatcatagcacagtgcagcctcaaactcctggtcttaagcagtgccccctgagtagctgagactacaggactgcaccactgcactgggctgccttacttttgagtctccctttgatacttaagagttctgccatagggccaggcacggtggctcacgcctgtaatcccagtactttgggatgctgatggatcacaaggtcaggagatcaagaccatcctggctagcacggtgaaacctcgtctctactaaaaatacaaaaaaaaattagccaggcgtggtggcgggcgcctgtagtcctagctactcgggaggctaaggcaggagaatggcgtgaacccaggaggtggagcttgcagtgagccgagatcacgccactgctctccagcctgggtgacagggtgagactccgtctcaaaaaaaaaaaaagatttctgctattgcacccttttctgtagtctttccctcacctcctggtaaaattttacttacctttgaagctcagttcaagtcctcccttttacattaatccactggaaagctaacccatgataactcattctgcttcataactcatagcattaatttctaccactcatttgccagttgaccatgaaatgccgtgtatcgtcacttgtattttattatttgttatttaacttatcacacatttgcccagttagattgtgctgcttgggctcatggtgatttattctttctagtcccaattttgcctaacacaatgtcctacatttagcaagtactcagtaaatgttgatgtgattggattttgttagtacttcacacccttctaaagatcaggtgcttagagccggaagcctaagggaacacttacctggctgacatcatcttggctgcctgtcaagatggggtgtgtgcctgagagaactgcccgtaaatgaaatacttgtgcaacaggttatgttttctcctttagtgggtgggattcaagacttcacattgggaaaaagagatagtaagtgtaggaagagggctgaaaaggggatggatgggaggatgctaccttgtgagaggtggggatatggctttattaaaaacataaatattaaaggctggcgtattgcagagagaagcttcttggaaccagcaggctaattaggcaaactggcttctctggtgcaaaccagttgttaattgccatttattttctttgctataaaactgtaccagccatctacttactttctcattagagtgaatctggagaaaaggcttaggttagatttaggaaatccaggagaaaaatgcaggacagtcagagtaagaccagggatgggcataatcctttctctcacttgtcttaccagccctagaccttaagggtggccaggacctccttgcatttgccagtagaggttgctattgaagtagtgtaaaacctcttgtttctattcctgctaactccttttgccccatcttatttttctccttcactgacaccctcctatcacacacacattattggttagttatcattcccatctctgaggttcacatatgcagtggaccaccctgcctttagctgtccagactttgactgcaacctgtctttctattccactcctcctcccctcccccaaatgatttgaaatggagaggaaaggaaatggagtttgatggttttaactcttctgtggctgtggcttagggagcagaatgttttgattgcttgatttaggggtcttgaggtctcctaatacaatattctttttgttaatagaaaggccccactccattttttttttctctgagtattttggactcaaagtcttgtgttgaaatgtcggtacctgcccccgaaggggaaaagatccctttcagagtttatttttcccccccattcatggggaattcttctcattatcagaagatgaagattactggtcctttgaacagagtataaatatagccaacaccctaatatatttctaatgattgggctttagctttaaaaacattaggctagatgcctccctattttttgtggcatgatttagctgtaactagcctggaggcaataacaatactaaatgaccttttgtagtcacattaaacattgaaatggtactgagactgccttggtggggagttttggcctatgggaatgatgtgagttttggtttctactcctttctctgttttcagataaatcctcctacatgtcccattctctggctctgggaagtactgacagtagggaaaagttagtacactcatctcattgttcagatcaagtttcctgggtgcggttttgcagaacttcctacaagagctgactcaagagttctcttctattgtggagatgttcctgctcttatatgtcatactaatttatatccttgaaattttgagcagcatcatttggatgtgttaagttgggaatgaagaaagtgaaaatattttcagagattccttgagaaaagggttccttttgctgggtaaatcaacgttccctagatgctgtggctaagaagtgaagaattctaagccaacttttttttaccccttttcttttctttacttttttttttttcgagatggagtttgctcttgttgcccaaggctggagtgcaatggtgtgatctcggctcactgcaacctccgcctcccgggttcaagcaattctcctgcctcagcctcccgaggagctgggattacaggcattacagacgtgtgccaccatgcctggctaattttttgcatttccagtagaaacggggtttcaccatgttagccaggctggtctctaactcctgacctcaggtgaaccacccacctcagcctcccaaagtgctgggattacaggtgtgagccactgcgcccggccttttttttttttttttttttttttttttaagagacagagtcttgttctttcacccaggctggggtgcagtgacatgatcataactcactgtaaccttgaactcctgggctaaagcgatcctcctgcctccatctcctgagtaagctaggaatacaggcacatgccatcatgcccagctcagttttattattttttttttttttgtagagacagggtctcactatgttgccaaggctggtcttgaactcctggcctcaagctatcctcccacctaagcctcccaaagtgttggattataggtgtgagacaccttgtccagcacctgtttttcctttttgatgtcagatccctctgaataacaagttatttgcctttttttccctccataagactgtgagcaccttgagagctgcgagaacatctcacttatctttgtatctctgatgtttaggacagtgtccagctcaaagtgtctataaatgtatgttgcattgaatagtggagggaagctttaaatacatttactgcagacagatgtatgcttagcatatttaattgggagacattattagaaagtggagatggataaagaaaggaatttttgtggatatgatatagagaatttttgtttcctaaggatttaaaatttttgtttgtttatttatttgtttattttttagagatggggtcttgcagtgttgcctaggcttgtcttgaactgctgccttcaagtgatcctcctgcctcagcctcctgagtatgtggaattacaggcatgagccactgcacccaacttgcctaacaatttttagagtaacagttattttgcggttcctttacgtggagaacctttagaagtgttccatctgactaccttggacaaggcactgtgaccttctttgtagcagagactaaagacacctgcccatttccctcaaatggagggatatccctcagtaaaggaaggagctcagaattagattgggggtagagaaaggaagcattgagtccctcctagccctgcactgtggaaatgtaaagctattattatgataattgctgttggcaaacaagaaaattctcagcctctggtttgtacctacacccagtcacaacctcaggttgggtggatgcagactttaaatattggggtcacctgtagctgttggaaaaggtccctgtggtttctctgggtgttgtgcaagcattacttttttggctcttttccctgtatccatcagtaaaaagtaggaagtttgaggagctgtgctttcggttggcattaggcattggagtgcctttatttcctacatttaactggtaaatatccaacactccataacaggatggccctgcttggaaattcttacctagggagtgactgaagcctaagaggaactgcacagccccctgtattgaaaacggagtagtcatttcctagagcatggcttggatcctgatcagctgatttcctgtctctacagggatgtgatgtgattcctcccccttccttctggaagaaatggatattttttttcatttcctgtttgatagcatattttctgagtaccaggagacacttgatgactataaaacatttgatgtgtggggggtgggaaggaaggaggcttttgttttcagcagaatggctttcatttgaggaattcaaagcacatacatgaacccaagctgttttgttcccatgggagagacacaggctctaagaagattgtttcgaatccctttcctgggctgtgtctacttgacctgcactggtagagccccttctcccccataggttagaaaagctcggtccctcatggagctctgcatgctgtggattctgctcttgccacatccgctactcagccctttttgtgcctaaatccgctggagagcaactattagtccctgggggaagtgacaccacccttggaatggaacctggctggatgccccttgatccctgactgagtgacacagactgggacaggaatctggctgtccagatttcctgtcctctgtcctcactagccgacttggctgcttccaccctggggctgggggtatggggtgtggtgggagctggttgctaacaagcagcgccgcctgtggacctgcacagccacttgttttcctagccaagagctacccgtccagtctggcctgttcctgatccatctggagtgagagcagagacctggaagagagatcagtggggaggcagtcattgtgatcccttttgtttgtagtgaagctttgcttagtgtttgagggcctggggtttaattttgtaacagactcttactatagttgtgtgtgtttaactataagattttcttttcttctcttttctccttcctcgtcctcctcctcatcctttctcctcctcctcctcctccttcttcctgtctgtttttatttttcccaactttataaaggtataattgatatataaaaattgtatatctttatggtgtacaatgtgatgttttgatatatgtaaacattgtggaatgattaaatcaagctagttaacatctgtcacttcacatagttttgtgtgatgagaatatttaagatttactacttccagaattttcaagtacgatacattgtttgctgtacaatacatctccagaacttattcattttttctagagttgctttttcttaaataaattattaggtttcttcttgaccttgaagaagtccagaaaaattcttacaaaatagggaattgcatggtaggtaggttatgagaagtttcatttttgggttttgtgaatactacgaacagcttttcctagtttgctagggatttgcgtggccaggtatttgctgcatttaaagttcttagatattatcatcagaagaacagtcttttttttttttttttttttttttgagatggggtctcgctctgtccgccaggctagagtgcagtggcgggatctcagctcactgcaagctccgcctcccgggttcatgccattctcttgcctcagcctcccgagtagctgggactacaggcgcccgccaccacgcccggctaattttttttttttgtatttttagtagagacggggtttcactgtgttagccaggatggtttcgatctcctgacctcgtgatccgcccacctcggcctcccaaagtgctgggattacaggcatgagctaccgcacccggccagaagaacagtcttaacaagaataagtggaatcagggagcatgcctctaacatttaacagtacattcttccttttacctctgttgttgaccatgtgccttcttgctccaggggttttcagttttcttttattttgttgtatcagatacattttccctctagggtagaaagcagcatcttacagtggaaaggaaccctggctttgggtcttactggctctgtggtcttaaacagtcatgtaacccctttcaactgtgtgcttttcctaattccccatttgtaaaatattggtggtgataaccatcttgcagggtttttgtaaaggttaaatgagttaatatacgtaaaacacattggttggcacatagtatgtaattgtagcttgttttttattagtaggagtcataataacaatacgcttgatttttttatgataaaatacactaatataacatttagcattttagccatctgtaagggtaaatatagtggcatcaagtacattcacttgattgttgtgcagccgtcactattatctatctctagaactttttcatcttctcaaactaaaattccaaacccattaaacaataactcaccttccccctccttagcccctggcaaccacaattctactttctgtttctatgcatttgactactctatgtacttcatataagtggaatcatacagtatttgtccttttgtgtctggctcatttcatgtagcataatgtcctcaaggttcattcatgttgtagcatgtgccagaatttccttcctttttaaggctaaataatattccatttatgtatctaccacattttatttatccattcatctgttgatggatacttggcttgctaataatatgattatttttgggtttttttgacatcttatttaattaattaatttatttagacagcgtcttgctctgttgcccaggctggagtgcaatggtgcgatttccgctcactgtaatctccgcctcctgggttcaagtgattctcctgcctcagccttccgagtagctgggattacaggtgcatgctaccatgcctgactaatttttgtatttttttagtagagatggggtttcaccatgttggccaggctgatctcgaactcttgatcacctgtttcggcctccctaagtgctaggattacagatgtgagccactgcgtccggccagattatttttaatagtaatgaattgattgtctaaggtgcgttcaaaggcttcaaagctggggagaagaggatgaagtagaacaatatccttgtttgtgtgttgactttgtctctctgggttttgcttgcaagacctattttgataggagtctgatgaatgatggacctactgaaccctatacagagggtccagacctggcagaattctaggaaaaaaaaattgcctcctagtctaatttttctcagtgataaactactctgtgtgcttacagtttgtctatcttgcttctctccctctctcctttgctcctactatgaatgggattcttggaatggtgacatatctagactcttggattgttttgcagaggtcgaaggctgagagagaattgctatatagctgaggggtgatgagtacagcgaacggccaactgtgtgccaacctggctttccagggcagtatttttaggatatatgtacctatatgtgtacacacatatctctacacacacatacatacatatgtacacacacacaaatatcccattattgacacttgacacagtaagggagctacatgttcttctctgggttcccctcaatgcagcccaccaccagaatgcatgcattggaaacgggtccaggataatgtgagaggtctccaaggagttccaagtataaagagccttagcagaagggccttgacagcttagacagtctcttacaatgtctaccaaaattctgaagaaagactgctatccagctgtgatttttctgccttccaggttagacctgaaaaagtccaggagcctagcttctgtgtcctgtgcttatgctggacatgggtggagggtgaggagaggcagtagtccctccaaacccttgtatctccaactgtggattctcctgtttgtttatagggtggaaggcgtggtttatactggtttgtccccagttcctgctctgtgcctgaggggactgcagtggcattaggattttttgcccagttgctcatggacatagagacacgtcacctcagtgcacccccctgtgcaaattggcctaccctcatattacctgcttttgtacctccaatgcctagagaccagttgtctctcagaagctactcaggatgattttatgctgtcagcataataaaagtgaattaattctatattaaattaataaagaccatatttagtattagtcaactaaggttgtatatgtacatattactaaagaaaaatgaattttaaaaaagaatctattttagagaaacagattaaatatgaacgacagtagggggcacttgtatgacagtagaataaagacaagcgtgagagtgttcagtttgaaatttgaagtttaacttttacttgtttcttggaagttcatgttttttcctcatgcaactttctgcaaaactgaaggttggattttaaatataaaatatttgacatgaccaagttatatttaccctttgtcaactaaaaattgacttttttcaaagtttgttatttttttaatttaatttaatttaattttattttgagacagagccccctctgttgcccacgttggaatgcagtggtgcgatcttggctcactgcaaccaccacctcccaggttcaagagattctcatgcctcagcctcctgagtaactgcaattacagatgtacaccaccacgcctggctgatttttgtatttttgttagaaacagggttttgccatgttggccaggctggtctcgaacttctggcctcaagtgatctgtgtgcctcggcctctcaaagtgttgggattacaggcgtgagccaccatacccagtctttttttatttttttaaagacaggttcttgctctgtcgcacagagtggagtgcagtggcacaatcatagctcactgtaacgtgtctaccaggctcaacagatcctcccacctcagtttctcaagtatctgagactacaggcatgtgccattacacctggctaatttttaaattttttgtaaagacgaagtctcattttattgcccaggctggtctcaaactcctgggctcaagccatccttctgccctggcctcccaaagagctgggattataggcatgagccactgtgccccaatttatttattttttatttttttaccttcagatgctctttggcaagcaagtaaggattgctcaattaaaagtattgcattatctcattcaactatatgaacatacaaaacttaaaaaaatttgtctgaggccaggcgtggtgggtcatgcctgtattcccagcactttgggaagccgaggcaggtggatcacctgaggtcgcgagtttgagaccagcctggccaacatggagaaaccccatctctactaaaaatacagaaattagccgggcatggtagcacgagcctataatcccagctactagggaggctgaggcaggaggattgcttgatcctgggaggcggaggttgcagttagccgagattgtgccactgcactccagcctgggtaacagtcgagactccatctcaaaaaaaaaaaaaaaaaaaaaaagtctgaaacagtattggaagctttaatttctatttcaacaaatttgtgctactctggattatgtgctacctgtcactcaaggatcttgttgaaatactttcttgtacaaaaacaacgaatcaaaacaaaacaaaacaaaaatgagtgtacttcatgttgtatttgagtagaggtcctaacaaacacttgaaaaatggctggtggtaggctggacgcggtggctcacgcctgtaatcccagcactttgggaggccgaggtgggcagatcacaaggtcaggagatcgagactaccctggctaacatggtgaaaacctgtctctaccaaaaatacaaaaaaaattagccgggcatggtggcgggtgcctgtagtcccagctactctggaggctgaggtgggagaatggcgtgaacctgggaggcggagcttgcagtgagcagagatcgcgccactgcactccagcctaggcgacagagagagactctgtctcaaaaaaaaagaaaaatggctggtgttagatgaacacagctttctctcatttcaataatgatattgaaaggttttaaaggccaaataattttttttttggagacagagtcttgctctgtcacccacgctgtagtgcaatggcgcaatctcagctcactgcaacctccgcctcccaggttcaagtgattctcctgcctcagcctcctgagtagctgggattacaggtgagtgccaccatgcccggctaatttttgtatttttagtagagatggggttttaccatgttggccaggctggtctcgaactcctgacctcaggtgatccacccaccttggcctcccaaagtgctgggattacaggcgtaagccaccgcgcctggcctaggccaaataatttttatgaactgtctggagaagctttgatgaggaataacagtatcattttcaaattggcttctgcacaaactacgtaattttgagtattccatgttaatgcatatgatgtagctggctcttaatcaccctatgaaaatggagtacaaggcatgctgaatacttcaaattcacagataactactaaaactaattttaatcaactgtctcgtcatttattcctacttgaattaccaaagatgcttgcttatggggggaaattgaacagattttttttcctcttgtttaccctttaccttttttaaaatgttatctgccactgttttttttttttttcagacagtctcgctctgtcgctgcaacctctgccttccaggttcaagcgattctcctgcctcagcatcccaagtaactgggattacaggtgtcccctaccacgtccagctaatttttgtatttttagtagagatggggtttcaccatgttggccaggctggtctcaaattcctgacctcaagtgatcctcccatctcagcctcccaaatttgccactattctttatattccagctaaaatgaactagtgctttctgcttttttttttcctagctttcctgctttcatgcctttgctcatgctgtatcctgtgcctgcattttcctttaatttctacattatatttggtccttacatatccatctcaaatgttactttttgtggatccttccctgattatctcagatacaagttatatcatctttctgaactgacataatattattgaaagaaatacacttaaaagtaatagtaataactgacaacattcagagtctgttacaaaatgttttcacatgtattagctcattggaacctcacagatgtttttcatcactcctgttttacagctgaggaaattaaggcttaaggagattaagtaacttgcctgaggttacccataattagaactaaatctttttttttttttttaattttttttagagacaaggtcttggctgttgcacaggctgcagtgcagtggtgtaaacatggctcacagcagcctcaaactcctgggctcaagagattgtcccactccagcctcctgagtagctaggactataggtgtatgccactacacccagctaaatttttgtgttttttgtagagatggggtctcactgtgttgcccaggctggtcttgaactcctgacctgaaatgatccttctgcgttagtcctccaaagtgctgggattacgggcatgagccatcatacctagcataaatctaaatcttatgacctcaaatcccatgttttttccaccaaacagtgctatcttacgattcttatcacttgctactatgggttagaattacttgtgtaaatgtcacatctggcctactactttgtactgtccttagatgaagagttaatgccttattctttgtctctgacatcccatagcacagagtattgcgtataataaggcttcaataaccattgctgaaaggctgacaagttgaagaaatgttgatgaatgcatgtgtctagcacagtgcctcgcacatagatgcctaataaacatttattgaatttaattgtaaaatggatcaaagaccatagttaataagagcttatagggcacttaataagtgccgggcaactgggcacggtggctcacgcctgtgatccctgcactttgggaggctgaggcaggcggatcacgaggtcaggagatcaagactatcctggccaacatggtgaaaccccgtctctactaaaaatacgaaaattagcagggcttggtggcacacgtctgtaatcccagctacttgggaggctgaagcaggagaatctcttgaacccaggaggcggaggttgcagtgagccgagattgcaccactgcactccagcctgggtgacagagtgagactctgtctcaaaaaaaaaaaaaaaaaaaaaaaaaaaaagtgccagtcactgttataaatgctttatgtcaaattaactaatttaatccttagaacctatctccattttacactggagtaaactgaagaacaggagggcatagtgatttgcccagggacacacagctgttaagcagcagagttaggtttcacaatttgctctagaattctcatgtactcaaacattatgctataatcagttgttcataatattttcacgctgttaaattcctcctgaatgcctgtctgtcttgggtgtagctcaaagaatgaaaagcagaagcagcataacttgttgaatatactcttgagcctgcgtcagaatcacctgcagggcatgttaaaacacagattgctgggtcccatcctcagttctgattcagtaggtctggggtggggcttgagaaattatatttctaacaagttcccaggagatgctgatgctgctggtctggggaccacttggtgtagcatataggtgttaagagcatggactcaagctgctgaggtttgaatctcagctctgccatttattaactgaacttgggcaagttcttgaacctttctgtgcttcagttctcatctgtaaagtgttttactgttaccacatatatcataggattctgacggagattgaatgaaataacatgtaaagtgcttaaaatggtgcttggtttgtagtaagcatgcagtcttagctacagtaatggggataggacatgtttcttgccttgtagattttagagtctagttattagacttaaatctaataattttaaaaagtacaaattcaggtattagtttacatggttctgattctaccttagatttggaaagatgaaatgcgtgtatcttgggggatatggtgggtagtgggagaccaggaggaggaaaggtacatgaaactagaagataatggaaagttatatagtcagaatttagaaaggttggaattgccagtggttttggtattattacctgagaacttgagggagatagaggaaggtgcctgtgctctctgtttgccaaagagataactgactccttttcccatttctctttcttagagctggtatctggtctgcaggcagttccggcagcatttgctttttgtggggaacagtggctaaggaagtgatttgctactggcttcagaagttgggctctgctgcctttatcctccacagctgcctcacatagttttgattcttcctgagaaaggcagttgttaggtttggaagtcttcagattccagagacagctggacagctgaccctctggtagctatttcccaaactgccagcctcctgttgcctcatctccctgggccccttcttttttgctttgaagcaatatcctatatttagtgaactaaccaatttgaggttagaggaaatttgatgggggagtctctcccaccttaaaatcctggatggatggagtatttgggcccaggaacaagatgtatcctgttaaaaaaaatttaacaccttcatcaagtatactccaaatgacagcttacagtgctatgaatgtacctctagctcatgggtaaggagcagtgtttatttttgggtgccctgaagaaaatatttgggggaaggagtggggagaagctcaggcagctccatttatggttgagcaatgcttggtattctacagaagggaccatatggacagtggaagagagtttagcattctgattgttcacctcttgctccttccattctgatggctaattagggacacctcattagctatcagagtggaacaagtatttgccaggctgacatgagcctcagccctgcatcctgcatcttctgctttcccaacctgctgagtcaccacctaggaatggcagtagccaggttaccacctggagcacctggagcactcttggcataatgcactgttgactggttttggtctcctagacacagcttgggcctctccaagcctgttggagtgataggctgggtcttagctctccttccagcttgttccacaaggcgctgacctacttttcagggacaattaagtgtttgtgagcaaaggaaggcggtgacccgagtgaaggtgaaccagagctgcattaaacaaacatttggagtcactttttctatcttacacaggagggcccatctcagtccaaatggaatggcagatcaggctgattgtggtagccacattctagatgcttatcaagatagtcaactaacccttgaatttttattctttctatcaatgtaccttaatatcagaagttacttttcataatcattgtaccccttgtctgtgggctatacgaaaagatttggaagcaagttggggctcttagagtgaattattgatacaagctagcttttgatataccttttggtgtatcaaagatacactttctggtggcaatgtctggttcatttgtaacatcttggagaggattggaatctcttttcctttttgtatcaggccaggataataggatagaggagaggccagatctgtagagaatgagcaagtggcttgtttagggtttcctgcccttgtgaggtaagggctcaaggattagattcagtctttccatttgcagtgaaaggaagtaaactcactttcccaccctcatcctggaggttacttatgttatttgcagaccccaacttctgcctctctgttaagtatacttcttatgcaggttgcccttactgttacatcttaccactgggggaaagatccaaggctctgggaaggacagtgacagttgtcctacattggctagtttcaagaccctgagggaattgccaagccagcaattaggcaatttctttttcttttcttttctttccttttttgagatggagtcttgctctgtcgcccaggctggagtgcagtggcgcgatcttcactcactgcaagctccgcctcctgggttcacaccattctcctgcctcagcctcctgcctcagcctctggagtagctgggactacaggcaccagccaccatgcctagctaattttttttcatttttagtagagatgggctttcactgtgttagccaggatgatcttgatctcctgacctcgtgatccgcccgcctcggccaccaaggtgctgggattacaggtgtgagccacggcgcttttttttttttttttttgagacggagtcttgctctgttgcctaggctggagtgcaatggcacgatctcggctcactgcaacttccgcctcccaggttcaagcgattctcctgcctcagcctcccaagtagttgggattacaggtgcctgccaccacccccagctaatttttgtatttttaggagaagcggggtttcaccatgttggccaggctggtcccgaactcctgacctcaggtgatccacctgcctcggcctcccaaagtgctgggattataggggtaagccaccgcccccagctggaaatttcttaaacttttatttttagcaactccatattcatgagaactctcataatcttctagtcagtaaaaagaaaagttattgaagttattgatactgcacccagagatccagatcaaatcttaaggaaggaagaagcttagaggagaacttcaccctgccactctctcattggaattcccttctaacaacgtgtgaggtgtcagccccatttgaagaactagtttatatatcagagcatggcctggaaatcagcgtggcatcaattttggtcttttttttttttcaaatagagacaaggtctcactatgttgcccaggctggtctcaaactcctgggcttaaatgatcctctctccttggccacccaaagtgctgggattacaggtgtgaaccactgtgcctcaccagttttggtcttacagatgactaagttttttgggggagggtattttaggtgacgtgcaattgctccattcctcctagacatcccagaatctggtcacaacctccttttttccacttatcctttcctttatgcacattaaacctgttctctgctgtttcccagtctgtcagcccctttatggtgtcagtgcttcctgacctatcatgtacaatagggctcgtactggcattctcagatctcttttttttcttccacgccttttctatccccagtgctggacctgtgttcattttctccactgagctactgagtgccactgcataacagtgtgctgactgactctattacagatttatgagctctagccacagcctggctctcaatcctatcctgaaacctttttattctcttctggttgactgccattcatttttttctgcagcagccattccagtctttcaccattctcttcaaacttgttgctccaccccaccttataaactctcaataagtaatttagtcttttacgtctcaatttatctgtaggctttaccagtccttaccacattccctcctatttcagaggcaggtctctgggcatatacatatatattttgtgttcttagttcctcccttcctagtgactctttgtaaagatattcaggttttctccatcctaagataaaaattcctttaagcttatctcttcttcagactaactctctgtgctttttttttctttaccaccaaactacctcaacagcctttcttctacttctttagtcatcgtgagccactatagccaaggtttgtgcccaccatcccaatgaaaggctcttgtttgtgatgacttgcttgcagaactcagcagcctctttttgttctcacgctgtttcatcttgtcacagcatctgacaccatttggacctctttccttccctgactgtgtgctatctctggatgagttgacctactctggtgatttcatttaggaatttcatctgtgtgtacagtgatgactctcttgtcagaatctgtaactacctattgtatgagcttttcccccaggtccaaacttgtatttccaaatgactactctccttttccactttgtagcctacagaaatttgcatgtaatgtatccaaaattcagcttatacaaccactatggagaatggtttggagaactaaaaatagagctaccatacagtccagtaaccccactccttaggtttatacccaaaagaaaggaaatcagtatattgaagagctatctggactcacatgtttattacagcactgttcacaatagccaagatttggaagccacctaagtgtccatcaacagatgaatagataaagaaaatgtgggccgggcacagtagctcacgcctataatcccagcacttagggaggctgaggtgggtggatcatttgaggtcaggagttcaagacaagcctggccaacatggcgaaaccccatctctactaaaaatacaaaaactagccaggtatggtggcgcacacctgtagtcccagctactcgggaggctgaggcaggagaattgcttgaacctggaaggtgaaggttgcagtgagctgagattacgtcactgcactccagcctaggtgacagagcaagactctgtctcctctcccaaaaaaaaaaaaaaagaaagaaagaaagaaaatgtacatatacacaatagagtactagtcggccataaaaaagaatgacattctgtcatttacaacaacatggatggaactggaggacattatgttaagcgaaataagccaggcacagaatgacaaacattgcatgttcttacttatttgtgggaactaaaaattaaaataattgaactcatgaggatagagagtagaaagatggttaccagaagttgggaaggggggatggggtcacagggaagtgggggatggttaatggatgcaaaaaaataaaaagactaaataaaacctagtatttgctagcacaacaaggtgactatagtaaaaataatttaattattcatttaaaaataactaaaagagtttaattggattgtttgaaacacaaattgcttgaggtgatggataccctatttaccctgatgtgattagtatacattgcatgcctgtatgaaaatatctcatgtaacccataaatatatacacctactgagtacccacaaatatttgtctttgtttattttcttcttcttcttttccttcttccttccttcttcttctcctcctcctgttcctctcctcctccttctctctcttcctctcctcctcctccccttcctccctccctccttcttttcttcttttccctttcctttcccctttccctttttcccattcccctttcccctcctttcttctttctcctttctcgtctctcctctcctcaccttccccttttcccttttcttcctttcctctctcctctctcttttccttccttccttctcttttctttttccttctcttttctctttccttttcttcctcttttttccttccttccttccttttctttttccttctcttttcattttccttctcttttctctttcctttccttccccttctttccttccttcccttttctttttccttctcttttccctttcctttcctttctttcctctttcttttctttcctcttttttcccctcccttccttccttctttcccttctttctttcttttcctcctttcttttccttctttcttcttcaacagggtcttgctctgttgcccaggctggagtacagtggcacaatcatagctcactgcaacctgaacatcccaggctcaagctctcctcctgcctcacccctcatgtagctgggcctacaggcacacacaaccaaggctggtctcgaactcctggcctcaagcagtccttctgccttggcccctcaaagtgctgggattataagcatgagccaccccacttggccctatttattttccacatctgattggacactaagttctgtttgtctagctgaaaaatatctcaacagatattgtttcctggctagactcactgccctattttagaccctcgtcttctttgatttatgccagtggtcatgccacatttcctcttaaaaactgatgatcagtttcaccccttgtttatgttgttttctatgccttgaatgatctttttactttttctgcctcacaaatgcttgttcatactgtaatcttttgtcccaactcaaaacttaatagattttaatggtgttcctgcttctttccttctaccccaaccagtaaaaaatttcacttaccttttcatctgagttcttatggtaggatgtacatcctttgtgatagtatttatcatcttattttacagttttctgtttaattgtcagcctcccctagaccatgagttcagtgactgcaggctgtactttcttcatctttgttttttggtgccataacaatttgtagaattgttgggctgtatatagagttcctgctttctccagataaagaatgtttagaaaaatctgaaagagttatgctactgttggatattggttgtggcagaatctcccctcccctttttacttcataaaatattcatgtttgttgtaggaagattttaaaataataaataaaaatataaaattaaagtgaccaaaaatcctaccatttataactgctgtaaatattttgatgttttctttcaaatattttcatgtgcaaatatgcatgcaatacatatttggaaaaaaacagtttgtaacatgtttcttcacttagtgtatgttgaaagtctttcagtgtcaaaaatatgtatcagcatcatttattaatatgttgctatcagtattctcttgtatggatgcattgcacttgagacagtcttctgttgttggacttttaggtaattttgcactgtttggtgttatgaacaatgagatcaatatacttacatgtatatatttgcacacttaactgtatttttaaaaagataaattcctaagaatggaattgctgagtcaaaagttatttgtatactttaaaaaacttttgccaaactactctccataaaagttttaccatgtggttgggttttacatttcattgagatttttttccccctttggttgattttatgttgccgttggaggttttatacattggaatgatttaattaaggctgtgtttctaggaatattaatatagcagcatgtgcaacatgaattggataaggaaagtcagtttttttgaggctgttctaacaatccaggtcagaggtaatgaggatcagaagggagagggtgactcttgaatgccggagagagtgactcttgaatacagaagaggatgactgggagaggtatttgcaggaactgataggatttgagaatgggttgggtaaagggtagtgccattacttgaagtgggaaattaaaaggaggcattggctggatgtggtggcacacctgtgatcccagcactttgagaggccgaggttgggggatcacttgaggtcaggggttcgagaccagtatggtgaaaccccgtctctactaaaaagacaaaaaatagccaggcatggcagtgcgtgcctgtaatcccaactactcgggaggctgaggtgaggcaggagaatcacttgaaccggggaggcggaggtcgctgtgagccgagatcgtgccactgcactgaagcctgggtgatagagtgagactccgtctcaaaaaaataaaaataaaaataaaaataaataaataaaataaaataaaataaaaaataaaaggaggcattgattttgggaggaaagatacggattcacttttagtaatttcagttctgtttgctgtgacatgctccggtggaaatgttcaagcacttggcactacagagctgcaataagaagagagccagggttcagtcatcccagcccgatatttaaagtcctccataattgcctctctagcctcctctccaaccactttctcacttctaagccagacaaaactgtcttaatcttatcccattgttcaccacctgcctcaaagccctgtaggaagtcttctttgatctctccactggaagttagttccagttttctaaacttaatgctagttgtattttttttccatatcatttgtattatactttaacatcctatttgtatgtatgcattattttcttctacaggattttaaactcctagaacctgggactatatcatgaacttttttttttttggagactgtctccctctgtcacccaggctgaagtgcagtggtgcagtctcggctcactgcaacctcctgcactcaagcaatcctcccaccccagcttcccaagtagctggggttacaggcgcatgtcaccatggctggctaatttttttgtatttttactagagatggggttttgccatgtgctcaggctggtctcaaattcctgagctcaagcgattcgcccaccttggcctcccacagtgctgggattacaggtgtgagccaccgtgcctggcataaactcttttttgtctctcacattactagttctgtattttgcacagtgtcaaaaaatatttggtgatttacaaagtaaatggaatctgcttaaagtaatggtaataatacagtggattattgtcattctacacctaatacctactaaatgttaacattattttatgtgcattttcctctttatttttcttaaatactcaaacatattatgggagggggagtggaaaacaaaagatgttaagtgagaatcccctttcacagccgtgttctttgtttcctccaagattcttgaagaatggtatatacctgccttttagcttccaaccctctctgctacactgaaattgcagttgtcaaggtcaccagtcacctcctaattgccaaatccaatggtaaattttcagctctgatcttacttgacctttctgtggtacttgacactatgaaacactccattctccttaaaagtttctccttccctaaccttttgtgattttatcctctcctgattttctttcttcctcattttcgtatttatcttccctttgttcacctttaaagaaagatactttctaggattttgtccttggcactctacatagttttcatgagtgatcttatttgtactcatggcttcaactgctgtggtgactctgggccagttttctcttccgagctccaagattttatctctgagagctagaggacttcttttggatatcctgtaggtgtctttgactcaacatgttccagatgaaacccttcactctggcaaacctgcttttctctctcttactccttactttatttaaggtactatcttctatccaggcacacaaatgagatatttgggaatcatttgataatcttccttctctttgtccatacaccctaccagaccccaattcaaataaaacagcgatcaaatgctgtataatttcgtttcaaatctgtgtcctttcctttgttttgataacagtagtactttcttagttcagattctgtatctatagtgtcctaattggtttcctcccttccttttcgttactgccagaatgctctttctaaaattaaaatctgattataaaaatagtcactcggaagcccttgcaatgggtttccattgtctttggggtgaatctggtttctttagcatggcatgcaaagctttcatttcctgccattattcttccgaagtagaaagcaccctacattctagccatattaaattgagttgcttaaatgcttcatgtttgctcatgtttctactttgtttcctctgtctgaaacaccctgttcccctcactcttaattctctgtggccctgaggtcccagttcaagcatcatctcctttggaaatccttacctaggccactaggcttcctttttgctttgcttctgtatatctttatctgcattagttgtaccatattatgtgttaggttacttgtttgtctcccttactagattataagctgagagaggaaagagactgagagctcttcatttccatcagtgctctacaaatttggcacagggtagtgaataaaaaactgcttgttgagtatatgaatgattaagaagggtatgtgttcagtggcagtactgggatcaggattcagaactcacattcttgtcttttataaaatatatatattttttatttttttttaagacggagttttgctcttgttacctaggctggagtgcaatggcgcaatctcagctcactgcaacctccacctcccaggttcaagcgattctcctgcctcagcctcccaagtagctgggattacagatgcccaccaccatgctcagctaatttttgtatttttagtagaaatggggtttcaccatgttggccaggatggtctggatctcctgactttgtgatccgcccaccttggcctcccaaagtgctgggattacaggcatgcaacactgtgcccggcgtgcacagtgtatatctttaggtaaaattcttaaatgtgaattgctgtttcaaaaggtatgtgtacttgtaaatttgatggataatttgattcattgctttaatttttttttcttttttaaactccatggaatatttctagtcacattgctgtaattgttaattttgtatatttcaagcatatagacaagtacagaaaatgtatagcagatacatatgtacccactactttttaaacagatgttgacaccctcattgacgttctccctgttaggtgcttttagcacttcctcaacattgtgatgttctcccacagaattttatcttagacgtcacagtaaaaaagttcctcagaattcatacactaccattctggaggtgccaccatacattctatcttggactttctttttaaatatagcctcattgttagcaaaaggcagcttcagaggaaaattccgttatgttatttttggtgtctggaatctgacttttgaaaaatgtttattttgccttcttcctctactcaaaagcaacaaaagaatgctaccagaactttatcacaaaccaagtgacttaaacaaattaaaaaaaaaaaggcagttggtggcctatgtttctagagacttgtttgatttgctggcagaacagcccaggtgagttgagccagtaagcacttttcttccactaggtttttcagaataaccaaatgtagttctcctaagcaggcactgatctttagctgacttagtggtgcagctgtatcctctgggttttgatggagttgatgagagaaactgttcttgcgggtggtaggaagctgttgacctgacctctgttacacctgactgtttcaatatgcctttgtggaaatcaatttcctacccttccatctctctgctagagatctataaccttgttccagtggaaggtgactcttacctctgatcttttcctaggtcctcagaatgcctggcagtgaggcttttaggttattttgggattttataaactgagaggggaaccttagtctcaggtggggctagaatctgaggtcctataggtacagatttatcctaaaagcaagtgtttttgccttctctctcagttgctcagtgcttcttacctcatttgatctcttagtattacataagcaccttagggaggaaaggactcaaaggagccaaccatttctccttggacccacagccaaaaagaaaaggctcaacgagagtgagcttattcgagggtctgtagcctaaagcatgggctcttttaaagcctcttgttgggccgtgaagcataggtctaatccacgtgaagtaattacccaggcctggggtggccacagggtgagcagagctcttcgtaccctttttgccagacctacacttaatttcctttaaagcctcacttggtcttgccatttcagccctttccttcgaagtatgaagcctgactttttttgtcttcctttcttcagccctgcagaggcagctgtggccctggggacagccctttcttcaaatggcaaactcattttctgtccagcagaccagaaggacaaggtgtaattcaacgcttctctccaccagacactgctgccagggggagacaatgaagaaagtgatctttgttgctccctgaataggtccctgaacctggcacctgcttttgttactggctccttaagtcactggagacatttttgctgtttcctgggttagcagctgctttgggataatagtagcaactggttgtcaggatgtcagttctgcctcaaagaaaatcagtgtatttatatgaggagagttaccttttctgttcttaaatttcttcagggtttgtctgaagagtgagcagttggaagtcagctgtgcccttagtttgatgaccccatgaccctcatctttgaatctgaggagacactgccatttctactatccaagtactaaccaggcctggccctgctcagcttccaaaatcagacgagatcaggcgtgttcagggtggtatggccgtggacgagacactgccatatttttttcgtcctgctctccctctggtgagactctgagttctgggttctagcatgtaggtcagtgcctcctacctggtaagcattcaacagatatatgtgggatgaatgattgaatgaattccttgatcttgctgtccaggttcagtttctctgacactgatacgtgggtgctctatgggagggggacctttgtttttaggagaaagattgcttcaaaggaattatggaaggtgttgatttctagggggctttgggggaactatgggaactctaagatatgattcgttctcgcctcattggtctagatctttctcctcgatagtaactgtctgctgacagacttgccctgtttcaggagcagtatcctgaacctgactcatctgggctctgtccttgagcagggtaagggattttttttttttaacagccatcctgtcactgtagattcagaagccctcaggaccacatctcaggcactgtagtcttggacttcctgatctggctgcattcagtcaagttccactcagctcttaggtgtctgtgcctttgtaagggctgttggagacagaagggctttttttccgctttgtcagcagctggccagagaatgcctattagtctgccagatcctaagtctttcacgtttccctgtctgtgtctggaacttagggcagaatctcttaccacctgaggttacatctcactatttgcctttgtgggacccattggaggataaaagatgaatagccatgaaaggcatgcagagttattgaactatggttctttgaaatgctgtgactctgaggaaagatccctggtctccaagaatacaactggagccagaccattgcaccaccaccctcctttcccaagagcctctttggaaccatcactcattccatagttccaaacatccttgtttttgtttaatttttatctgataaatgttatgaaacaattttaatggtgaaacacacagaggaaatgacaaactagcatgtgttgtcttttaaatgcacttagttcaagtggttaagtcagttgttcctgttgttagattgctgttgtgtagtcgactttccttctttaggtgggaagagtctctgaatagactttaaaaaagcaaaaggaaccagctcttctttagctgattgatcattcctttacatctgactcttttcagcacttaaattcagattgtactatgctgattgctttcagatcatgacacagaagaggtcttaaggtcatttcaggagttctttagctgaggtccatgtgatacttctccacttgtaaacaaaagtttgtatgtaggtaaatatgtatatttttatagggaaaagtatccttagttttcatcagattctcactggagtttatgacctaaaaatagttaagacttagtattttatttatttatttaagatggagttttgctcttgttgcccaggctggagtgcaatggcacgatcttggctcactgcaacttccgcctccgggtttcaagcaattctcctgcctcagcctcccaaatagctgggattacaggggtccaccaccgtgctcggctaattgttttgtttttttttttgagatggagtcttgctctgtcgcccaggctggagtgcagtggcgcgatctaggctcactgcaagcttcgcctcccgggttcacaccattctcctgcctcagcctcccaagtatctgggactacaggcgcccgccaccgcacccagctaattttttgtatttttagtagagatggggttttatcgtggtctcgatctcctgacctcgtgatccgcctgcctcggcctcccaaagtgctgggattacaggcgtgagccaccgtgcctggcctattttgtatttttagtagagatggggtttcaccatgttggccaggctggtctcgaactcctgacctcaggtgatccacctacctcagcctcccaaagtgctgggattacaggcatgagccaccactcctggcctatgacttagtattttataagaatttgggggcttggcatggtggcttacgccaggcccccagcacttttggaagccaaggtgggatgatcacttgagtccagaagttcgagaccagcctgggcaacatggtgaaacactgtctctacaaaaaatacaaaaattagcgaggcatagtgatgtgtgcctgtagtcccagctacttggggggctgaggtgggagtatcgcttgagcctgggaggtcaaggctatggtgagccaagattgtgccactgcactccagcctgggtgacagaacaagaccctgtctcaaaaacaacaaaaaaagaatttggggctcctgcctcatataactagttagtggcaaagttgagatagactctgaaatcctgggattgactctacaagaatctatatttgtgttttttactatatcctactgtctaatttacggtctttaagcactaaactcctttttaacctgttaatcttgcctatcaagttgcattttgagaaaaatgaaccatgtatttgtgtttctccataactcctaatactcacatctgcacaaagtagtaccttgctggttctgttgactgactagtagcattggaaggcacaaaagcttgggttggttattactttccctttccattatcttttttttttttttttcctctaagttggggtcttgctctgtcacccaggctggagtgcagtggcgcaatcacagctcactgtagcctcaacttcctgggctcaagtgatcctcccaccttagcctccccagtagccaggactacagtcatgggacagcacacctagttaacatttttagtttttgtagagatgaggtctcactatattgcccaggcaggtctcaaacttctgagctcaagcagtccgcccaccttaccctcccaaagtattgggattacaggtgtgagccaccacacccagcccctttccattatcttagcagctgtcacaattatttagcctgatctttttaggtgggcatactcccttttctctctgtttttacaatgctacttacacagtttctccacctgcatccaatctgtaattgggagttttgcagagcagtgtatttggtatgctgtgaactcttccctaggtcacccaatggcatcttgtgagccaggttgtctgaaaaacttcaaatcttggtggcagtgtggtgggtgtatctcccatatgagggattgttccagggatctgactcaattgacagctcctgaatttctaatatgccaaggcttttgtggtaagatgagcaagaatttttcaagctcagatttggggaacatagcttcttgccatgctatctcattggcatgatgtgtgacttttgggcagattacttaacctctgtctatttactttttctttttttgagacagggcctcactttgtcaccaaggctagagtgcagtggtgtgatcttggctcactgcagcctcaacttcccaggttcaagcgatccttcatcctcagctccccaagtagctgggactgcaggaacgtaccaccacacccagctaattttttggagtttttgtagagacggggttttgccatgttgctcaggctggacttctgtctgttttctcatctgataatgaaaagttgcaattattttcacaagatactttcaaagatgagtctaataatgcagatgagccattttgagttccttacaacaaagatgctgtggaaatttcaggattttccccctttagttataatatgggtagcttatcctaagaacctgtgactattgggatggtcatctttttgaggccagcagtagaaagaaatttgcagtagtgactgacacattaaagcaaccccgaaacaaatcagagtgaaatagtgtcctggagttggggatatgtgggtgatatctgggctgcattttctctctaggtatccatggagagggtcctgtctccctgaatggttgtgctttcaacagttagggaatgagcttgacagtttctgcttcttccctccccttgccttgaactgccttgatatgcagtgcctcctctgttgtgtggctgtattccagtccgtaaacatgactgctgtaaggagagtacagagtattgtttattttgtaaaacttgtctcattgccatgtaatatttgctcaagagctcctgttgtggtgatattcttgtggtgagcatggccctttaaagattttgttctcaaatgttaaatgagcccctgactggtgtcctgaaaagcatttaagcttctctccctagagtttaagcaagaggagcagtaatcccagtggagcctgggctggggtctagagagaaggtggcagatgaggtggcagatgacaggcaggggcggttgtggtcccgtagctcatttgcacaaaggaggggctggcctctcctggggaggtatttccgctcactggaacaaatgagggcgctcaaaaggctgtaatgtaatgaggcttctctggtgacgtcacttgtaaatgtggtcaaagtccagttcttgggggctagtagaagcgggagtagagatcattcggtttgcatgctttcacttctcagctgtcactgtgccatggtgcctactttcagccagtgaaccaactcaactgggccgggcatgaacgcttacaagtatcagaagttcctggagggactcaacaaccttagaggtattacaaggcttcaggctccctaccctttgtccttgctgatcgtgtgagcacttattatggtgtgtattgtatagggtctgtaaaaccctcctgctctgagctggccctattttttatgcgtttaggcaattaaacagaagggatagagtttgtaaatgcaatcctaagtgagtaggagagaatctccttaggtacttcagcaacagcctgttgtcttgcttgaacggacaagtaagaaatgtcccctgtattcttgagctcagagggctcagggcactccctgttttctttgaggtggccagacagtgtgggtggagggctcttgccatagggccctgcagcctcacctaggtgtagttatgtttcttgggccaggttttccagttgcttgtgtctacagtgagtcagagtcccatttggagagaactggagttgggagtggggaggagggtggagggaggaatgcaggttgatgggctatttgtaagcccattgtaaagtaagcctttgtaaagagtaaaacaatgactttgaaagaggaagctttttattaaagttttaaaggaaatagtgttttctttgcatcatgggcaaattcttcactgaccagacatgagaagaatgtactcagatgtgatgtaggactctttttggatattaaagagaaaaatgaatgaaatctttttactttcccttctctaattaataagtggttttatttccatttgcagaggagggtgcttaaaccatttttctttcatcagtagttaggattctggacccagagcaaccatggggtgtggagagagtgggagggggtagagggaggaaaggagtaaactgggttttttcagggatgaggaaagtggcagacagggtgtgggcaggagatctgtactcccttcttgccagggtatgtagatgttttactttctttcactatctgttgaagaactctggttctaagaaatatatatggagagctttgtatgctataaagggatatacaggtcgggcatggtggctcgcactcgtaatcccaacactttgggaggctgagatgggaggatcgcttgaacccaggagttctagaccagcctgggcaacataatgagacccccatctctacagaaatgttaaaaaattagctgggcatggtgatatgcacctgtacccttaactacttgggaagctgaggtggaaggatcactctgagttcatcttagaggtacagaacccaaataacacagcaaagagccccagagtctggagtgagaagagtgctgctctctggtgctagagaccatgtgaagaagggaagaatacccacatctgactaagcatatgtgtaaatgcaccttcctctctgagacaaagagctgtagtatggggctttagagtgaaggtaatagatcttttctctccacactactactcaccttgaatggagttctgttttctaatctttcattcactattgtttgcttcattcacttatatacactgtataatagtctttatagcataaaacatacaatatatagcagtttctcttgttgacccaaagaaaggatcagatttaaactcttctttgctcctgcaacctgagtctttttcaggtgggagaagttcctggaaagaggacatgtagtttttttggtttagtccttatcattttttggaatgttgctataggtcttagacaactattcccccaattctgggctgccaggcagagagttagatacaaaccattgcctttgtcaaatcctcctgtgggttgagtttcacccactgtgccccctgattaaggtgaatggttacttcccttcttcttttcacttaatatctttgtgtattccagaagggctgatggaaagaggtaattggctcccctcttcatttagttactgactgttgcttttcttggcatggttcagcttgtagacattcctccatctagtgggtaactgttgaagggaatccagtgggagaatagagacattgtacaagtttttgaagttctgatccccaaattcctatgaatttttggtgttttgatccagaattggggtgcaatattttccactgctcgtgctttttctggagggctttaacttatatttctcaagcctgtcaaaaaccttagttattggggtgatttctggccagatggacctctctcatgggtatgacaggctgaactattggcccgagtcctgatttttggcagagtccagacctgtgccatgactgggataagtaggtaattagggattaattagggaagcagagaggtaggtgaagtagagtggtgagaaagtggttcactagcctttactaagaaaaatttatgataggactatgagataactgacttttaaaacagaaatataatggccaggtgcagtgtctcatgactgtaatcccagtgctttgggaagctgaggcaggaggatcagttgaggctaggagtttgagaccatcctgggcaacagtagcaaaaccctgtctctaaaaacaagcaaacaaacaaaaaaacaatacaaaaactagccggtggctgggcacggtggctcacacctgtaatcctagcacttcaggaggctgaggcgggcggatcacaacgtcaggagtttgagaccaggctggccaatatgatgaaactccgtctctactaaaaatacaaaaaaattagccaggcgtggtggcgggcgcctgtagtcccagctactcaggaggctgaggcaggagaatggtgtgaacccgggaggcagagcttgcagtgagcagagatcgtgccactgcactccagcttgggcgacagagcgagactctgtctcaaattaattaattaataataaaataaattaaaaaaaaaaaactagccgggcatgatggtgtgcgcctatagtttcagtttcagctactcaggaggctgaggtgggaggattacttcagctgggggtttcaaggctggagtgagctatgatcatgccactgcactacagcctgggtgacagagtacaccctgtctctctgtcttttttttttgcaatctccgcctcccgggttcaagcaattcttgtacctcagcctcctgagtagctgagattacaggcatgagccactgtgcctggctaattttttgtatttttagtagagatggggtttcgccatgttggccaggctggtctcaaactcctgacctcaagtgatctgcccgccttggcttcccaaagtgctgggattacaggcgtgagccactgtgctcggcctctgtcgcttaagtaaatagatagattaaaaacaaaaaagaagtataccccaacatacctatgtaattttacccttctcttcctttgcatatactgtcttatttcctctgcctggaatcccattatttttttctctttgtaccaaatttctgctcatctttcaatgcctagctcaagtctcactttccttccgtaagttttgtttttgtttttgtattcccagtagaattattctctctccctcatctatgttgccatggcactttaaacatacttgttttagagcatatcacattatgttttagttattttattaaacatttgattttcctgctagtctttactgcttggtcaagttttctataactttcataggcttcagttttttcatttgtaagaaaggggatgatagaatttactttacaagatgttgtggggattaaatgagatagtgaatataacatctgatgcagactaggagcctgatagatgttagcgatactgtttctaaaggcgggaactgtgtctcatttatccttgagtctcctttacctagcatagtgcctggcacatagtaagcataaaaagagtatttgggggaattgaattgaactaaactcatatatttaaatgtccttcagtagtcaccataggaggttaaaaaaatattctaacaatggtgcctatgctgcatacttttatttaagcatgctttttgtgggttttctcttcagtgccaggttatgaccctcataagaaactccatagtcgccgggcatggtggctcacgcctgtaatcccagcactttgggacgccgaggctggcggatcacgaggtcaggagatccaggccatcctggccaacatggtgaaaccccatctttactaaaaatacaaaaattagccgagtgtggtggtgcgtgcctgtagtcccagctcctcaggaggctaaggcaggagaatcgcttgaatccaagaggcggaggctgcagtgagctgagatcataggtgagcctgggtgacagagcaagactgtctcaaaaaaaaaaaaaaaaaaaagaaaagaaaagaaaaaaagaaactccatagtcattttatagtcatacctaatttttggtcaaaagatgatattacccaagacaaaattaaacccaatctcaaagaatgaaaatgcactactattgaaaacattggaaagatggtactactagtctgtaggtagttccagatgaggggttccaggtattttgaacagcaacagtattgttgaataagtggaaaaagtgactactgagaaagaacatggtcctttttggttctcttagttctgatacatttgtcagatcatgtttctcattatcttagagctttacttgggacatccacttagtctgccttctgagaagcctgtcccctgttaccacatacagtcaagcaggacaagctttcacaccccaacatacaccctcagagagtgaattctttttttaagggggtgcttttttcccctcttcaacttggcttggaaaaaagacttttttgactttttttctgatgttaaatgatggactacattgtccttatagaaagcagggaaaaataaactaataaaatcaccgaaatcctacaaattactaggctcatattttgctgtatttctgtcatcttttctctatccatgtgtatataatgttgcttttatatatatctgttgttgtagttctctgtcttgctctttattattttgtgagcattctttatacctttatctacatcatgattttttacagttttatggaattccatcaaatggaaggttcatttatttaacatactccagtagcggggcatgtacattgctaatttttcactgctatgataacgaacatccttgtaaataaatttttctgtgcatttctgattttttttaaggatggatttccacaagtggaatcactgggtcttaatacatatattcaaagctctggatgttggcttttaattttatttcacttttaaaggctactgagggtaacaagaggctatctgtaacactgaatacctctctgatagctcttggccccttgtcctctagggatggccctgtcttcaggcttagtggccagttggctcagatgttttattatccagttaatttcatggtagaacaggggccaagtggccttctcacttagtcagcagctcccatcatgtcatcatcatatcactgcactgctttactctgaagcttttctcacagcaactctaggcatttaaatagcttcattgatccttccaaccctagtacccttttctcttgtagtggtaagggacccattaatgttgattgggaaactgcagtagcaagaatgaccatcaatattgtacaggaatcccacattggaaccctggattggtaccagattgagattctctttgttttcttgctgttactgagctagcaccgaggtaataaattgggccagcttaatttgataaaataggttgacaaactttactgtgtcaacacacccctgctttggtagatttctgcctctggaagaactagaactggtgctgtgttttaaatcaatgtattacagccaagtgcaaatcagcttctgttatgtgggactgatagccttagagtagaattatagacttgatgagagtacatccttgtttctgacttggagtggacatcctggagcagataacgtgaggttttgtagctgatgatagactggggatatttggaggttagctggagaactgaaagaaggcacatgtgtaggactttgtgtgtagggggccaataagaaagtctctgcagcagttaggatagtggaaaatggcttgagtcactgacaggcttgcgtcctgcatccttcatagtgagaactgtgtgcctttcccattcccagagcccttaagcaaagctgtcataaaagggcgattctctccactgcagggaatctggaagtctgcatgcttctggggtgaggcctgtcaacaccttttacagcactaggcacctagtagaccatgtgcttatttggatagttgatagttttgtcctgttaaagttttttctctccttaattgtatactttttaggcttactgcatgtcactgggctagagagggtcatcagcacaaactcactttggggttggtttcagttgctgctgtttttgcaatgtgtattttttttgttacaactggagatggttgttatacgatccctatttctcaaagagtgagcctgtatagctaacaagcatacaataccattttcccctcatccttgattttgttttcttgtcatgtaggcattagtattgaaaggttaaggccttcatcctcactatgctgctgtggtttctattggttgttggagaaaccccaggctgataatactacttttatgttgattactcattgtaacaactgtggggatggtactttcaatgaataccagttgttaaatagcatcttttgctcattgtggaatggcaggaaccttttggacttcttggtttgaaatcctttgatttggaagatcacttttttacaatctgttatcaacttaattgcctcactccctgatcatgttccatgtttcctgttgcatttactggaagtctccatctccttccttcctttcattgagaactttctgacaggatacaaagattattgatagtccctgtctttgagggattatcagccccatatagtttagtggggagactgtagagggcactagatttttttttttttttgagatggagtcttgctctgtcacccaggctggggtgcaatggcatatctctgctcactgcaacctctgcctcccaggttcaagtgattctcctgcgtcagcctcccgagtagctgggattataggcgtgtgccaccatgctggtctaatttttgtattttcagtagagatggggtttcaccgtgttccccaggctgatcttgaattcctgacctcaggtgatctgcccaccttggcatcccaaagtgctgggattacaggtgtgagccaccatgccctactggcactagatatttatttatttatttaaccatgccctgccagcactagatatttatttatttatttatttatttatttatttattcattcattcattcattcattcgagatggaatttcgctcttattgcccaggctggagtgcagtggtgcgatcttggctcactgcaacctccgcctcctgggttcaagcgattctcctgcctcagcctcctgagtagctgggatttgcccactaccacacctggctgattttttgtatttttagtagagacggggtttcaccatgttgcccaggctagtctcaaactcctgacctcaggtgacccatctgccttggcctcccagagtgctgggattacaggcgtgagctgtgcctggccagcactagatatttttaagacagaggaatgacataaacaactagggtgggtattttttgaggggtggggtggggagagataactggcagcagtgtgaaagatcatttatagggatcatttacagggaagtggggatatagctaagccagtaagtatgtacctgattttagtttgtttaggatgcaaagaggtgagagaagtaaagagcagggatgttaaatctttctttttgatggagtttcgctcttgtcacccaggctgcagtgcaatggcacaatctcggctcactgcaacctccgtgtcctgggctcaagtgattctcctgcctcagcctcccgagtagctgggattacaggcgcctgccaccacgcccagctaatttttgtatttttagtagagacagggtcttgccatgttggccaggcttgtcttgaactcctgaccttgggtgatccacccacctcggcctcccaaagtgctgggattacaggcttgagccaccgcacacagccagggatgtgaaatctttctaaaagagaatttgggctgggtgtggtggctcatggctgtaatccagcactttgggaggctgaggcgggtggatcacctgaggagttcaagaccagcctggtccaacatggtgaaaccccatctctactaaaaatacaaaaattagaccgggcgcggtggctcatgcctgtaatcccagcactttgggaggccgaggtgagcggatcacctgaagtcaggagttcaagaccagcctgaccaacatggagaaaacttgtctctactaaaaatacaaaattagctgggcgtggtggtgcatgcctgtaatcccagctactcaggagcctgaggcaggagaatcgcttgaacctgggaggcagaggttgtggtgagccaagatcatgccattgcactccagcctgggcaacaagagtgaaactctgtctcaaaaaagaaaaaaaaaaattagctgggtgtggtgacaggcacctataatctcagctattcaggaggctgaggtaagagaatcgcttgagccaaggctttggaggttgcagtgagctgagattgcgttactgcactccagcctgggcaacagggcgagactccgtctcaaaaaaaaaaaaaagagagagagagaatttggtttttaaaaatattttatgttgaatgttagctggaactggagatccactttacccccacagctcaagttcagcttgacccttatgttgtgcaatgctttgtgtttgggttggtatttcctgggactggtcaggtgatgcacttcagcatgaggcctgtgtagtagctgaagagtagtgacccaaggtgtctatcagtgataagaggagagaagaagcccgtttagctctggacagggcctctgtttcctctgagatctcttgtctactctccctggtccagggctccatctttgcataactttttacagatagatttgaagtgccaacttcattctgttttggagtactggcattggacacaattgattacatccctgcctgtttaaaatattctcttcttttaccttcaatgagagtatttcatggttttccttaacctatctgattgctgtttgtctgctttgttgggtctttttcttcttctgactcttaactgtggcagttttctaaggggtaaggcagtgtagtgaagtgggaagaacatgggctttggatccaggcagggctgggttcaaatatatgttttttgtgtgtgtgcgtgtgtgtggagaacggtctcgctatattgcccaggcaggtctcgaactcctgggctcaaactatcttcccgcctctgcagagctccctgagagctgggattacaggcgtgagccactgcgcctggctcaaatctgtgtttctacatttatcagctgagtgacctggggcaagttactcacttttcctgagcctcagttttttcatctgtaaaatggggataataatatcttccatataaaattatgaggattaaacagagtagtataagtaaattttcttattgcctgattgatcggttgatcgtagagatgggggtctctgtgtgttgtacaggctggtctgaaactcctgggctcaagtgatccatccccttggcctcctaaagtgctgggattacaggtgtgagccactgtgcccagcccaaactcagtattttcaaaccaagcttaaatttggcttttctatcctagtccccattttttgacagttgaactcacattcttccagtctctgagattagaaaccttgcagacatctgttaactcttttctcttcatcaaccccattttcaatctgtcattgagttcttttgttcttcagagtttctcttaaatttgtctttttctccccattctctattccatgactctagtccagtcacttatcactttgtacctgaattacagcaaccgcctcatattttgttttctgtgtcctgtttctctcttcagttaacaccgaagtagcagctactttcctagtatttcctattactgaaagtctaaatttgttacaaagaccttttatggctggacctggtggcccatgcctgtaatcccagcacttttggaggctgaggcagaaggattgcttgaggtcaggagtctgagaccaggctaggcaacatagggaaactgtgtctctacaagaaaaaaacatttttttttaagtagccagacctggtggtgtgtgcctgtagtcccagctactcaggaggatgaagtgggaggattgcttgaagcccaggaggtccaggctgcagtgagccatgaccctgtcactgcactgtagcttggggacagagcaagaccctgtctcaaaaaaaaaaaaaaaaagacattttatgctctcatccccttcctacttaaccaggcttatctcacttattttcctagaacacaccttcagttccacacaaaccctgttcctcattgtgtcttatcctccctcattcattctctctccttgccctttctttctttctttctttttttttttttttttgagactggagtctcgctctgttgcccaggctggagtgcagtgacgtgatctcggctcactgcaagctccacctcccaggttcacgccattctcctgcctcagcctcccgagtagctgggactacaggcacctgccaccatgcccagctaatttttttttttttgtattttttagtagagatggggtttcaccttgttagccaggatgttctcgatctcctgaccttgtgatccgcccgcctctgcctcccaaagtgctgagattacaggcgtgagccaccgtgcccagcctctccttgccctttagttctctttacctggaatgcccttgttctttatacttaactgaaatctgtctattccttcaagtttcacttcaggtctttcttctgatgaagacttctctgattatcgtagtccaagttgatgtatcactttcccaagctagttttatctatctattgaaatggtaagcttttttgagagaactgttttatagacatttctattattcccacggtgcctcgctcatgcctagccaagtttaaatgctccttacagagcacttataaaatgtggtgaccaaagccaatcactctttcattcgacaaatgtgtatgagcacctaccatgtgtgctgtgctctgcactgggatcccagcaataaacaacacagaaacaagacaggttatactgtagagaaggagacactagacaaatatttgttggtcaacagaatttgtggaagccaggcaggactctaagtgaggacaaatgacaagaagagggagaatttagaaaataagatatcagtgaaacgactattataggaaaaaggtgtttaatggattcattcagcaggtaatttattgaatatccactgatacaaatgtattcccaggtattagggatataccagtaaataaagcaaagtcctttcccttgtagagcttatattctatcatttagaggcatttttgaaaagcaaagcacctaatattggatgaagcccatctgtgggaggacagcagtgaaggagttaaaatgcttctagggctccaggctttgttgaaacagatggtttctttgcactagggaatgtttttaagagggattagaggactgggctgaggaaggcctgagacctctttccctcacgccatagcacacacacctgctgttctggcgcctggtagctatgtaacttgtcccccacttggtaggcacttgtttgcaggcttgtgattgtgactgtagggctggctctaagcttctgacatttttattttcctttcgtgatttttatttgtggtccaacagcaatgaagtcccatttgaatttaacagacgttgggacttgtctgcgttcctttctggtccatatttacttttacataattgtaatctttctgtttgtgtgtgtgtgtgtgtgtgtgtgtatgtgtgtgtgtatttttctcccgatccagttttattgtggtaaaatacacatgacaaaaaattgatcattgtaagtactttaaagtgtacagttcattgacattaagtacattcacaatattgtacaaacaccatgactattgaattgcagaactttttcatgatcccaaatggaaatcccatatccattaagcagtaattccccttctccccaacccctggcaaccactaatcagctttgtgacttgcctgccctggatttgctcattctggatattttatataaatttagtcatgtggccttttgtctctggcttctttcacttagcatatgcacatatttacatgccttttccatgtaacattataaggattttttaagtgtttcgttacagacattataattttcttttttggacacagtctcgctctgtcgcccaagctggagtgcagtggtgctatcgcggctcactgcaacctctgcctctcgggttcacgccattctcctgcctcagcttcccgagtagctgggactacaggcacccgccaccacgcccggctaatttttttgtatttttagtagagacggggtttcaccatgttagctaggatggtctcgatctcctgacctcgtgatccgcccgcctcagcctctcaaagtgctgggattataggcgtgagccaccacgcccggcccagacattataattttaagttatcttgttgataatggcttcatttagccattcatttattgttgaatatttggattgtttcaagttgctattattttttaaaatgctacggtggaaacctccctgagtgtgctctgccatctttcaggggactctgaatgttgcacatcagctgcagaagagccattgtgcttgatttaggatagtgtggactgttatccagctctgtgggaggacagtcaagtaatgaattttatatagaagggagcattattctttgcaaaataagaccatgttatccagggagtggcagggaaaagttttttttccccactgcctagaattctctgataatccctctatccctttggctgtaggaaagaattgattatagcagttgaagatgaaatgttttattcatttattcattcaacaaatatttgagagcctactatatgccagacatttgaaacttgctcatgggttgagcttggctaaacagtgcctttcactccctgggcctttcatacctgcctgggaacaagaataggacctacttccagagtaatcagagaggatccagaggtcagagccatgtggggccttattacctcatggtttaactcctcaagatttggtaccattatagatactaatcacacattaatttgtctgctcactctggggatttcaaggccaggctgccacttttcatacgtggctgttcttgttcaccactctaacagagtcctggctgctaggagatgagccatcaggcctgtgccctcttagtagttttgttcactatatcctgggcaaggcagcaaggagaaggtgcttactgactgagtataaaagcttcagagactttattatagtaacgttactgtgttcatgcaaggggtgaggttggcatgtcacagattctgagttagcccagatatacttgggttagtgctgctggggccttcttgccttctggcagacagccctcctcccttttttgtccttgctgacccatttaacagaatacttttaatttctctctaccttgctaggaaaataaagaccacttaggaccattcagggccacacactgcttacaaaacccagtgtggagtagaaaaagcactggaggccgggcgcggtggctttgcctataatcccagcactttgggaggccgaagcgggtggatcacaaggtcaggagatcgagagcatcctggccaacatggtgaaatcccgtctctactaaaatgcaaaaaattaactggatgtggtggcgcatgcctgtagtcccagctattcgggaggctgaggcaggggaatcacttgaacctgggaggcggaggttgcggtgaccagagattgcaccactgaactccagcctggtgatggagccagactccatctcaaaaaaaaaaaaaaaagaaagaaagaaagaaaaagcactggaaacaattgctagatcttaaacattcacttaggaaatgccaaacctgtagatttggagtaagaagcagagaggctagtgagagagttcagggtttaggcctgatttctatcctcttccacctaccacttgttgcatttccttcactgtcagaatttgattgttctgtgtctgtatcttcagatgtgtttttcctagtgtatttgaaaaactgttgaacagtcccctctgggcagggagggaagagggttagacaatcaggagtagagactctgttatttctctctccagacctagaccctggagttaactgaaggtccagagttactgaggggcggctgtgtttgtttttcagtaggctggctttactgagtgggatacaagagcccaaagcacaggccattcccagaagcctaacattttcatatttctttctctgccaaagaatctttggttagggttaagaataactagtctgtctgtggaaataccaaggccttttgtttgccagaagaaaagcgcttttgattaaggctgccttttctctctctcttttttttttcttaagctgttgtgggaagacttcagagcctctgaaggtgccgtatttaaggggtgtaggggaaggaatgatagctaaatagaactaagggagacttaatcgtgctttaccgcacatttgtgcagagattaacaacagcaacaaaatctacccagtttttggtcattgcttctactagcctttctttcttcctgtcttttatgaaatctacccaaaacagtagttcccaaaggacctgctgtactgatctgaccttgaatcatactctatcacttagtgtgatttggggcatgttacttaacttttctctttaggctagagttttgcaactataaaatggggattatagtagaccattttcatagggttataatgagaattgaatgagttaatatgtggaaaatacttaggacagtgcctggcacatagtaagagcttatcccagtaaatattactgctactgtgtatggcaaatgctgagtgtagctttattttttcgattagtaattccaaatgtggctttctagggttagcaaagtcagggctttttttttatagaatgaaaaggaagcagacattcccattaggcattaactttttatcagtcagaggcaaagggaaagatttattctctgtgtggacgcatcatagaggctcagtgtcttcttagttgaatgtcaacaagggaatcaatttcatcatgaagaactactctttggcaaaagcaagggcgagggttgggttgtgtactttcgtagtctttgtctgagagtagtgatgtttcttgtgccccaggaaagcttgaaccaaggtatagagaaagggcccctgatcctccaaatttacagtagtaagagaagcaagaaatatcttagtaggaaaaggggaaaccctcagggctgggtctcgtcccagtgactctactaccaggtctggagaatgtcactagtggaggctctgggcaagtgcctggccactgcatttccctggccatagtaagagatgtgcagaatgacctgccctaagtctctgggctgtttgttttataaactgctaccttcttccccaaattgctgggagtggctaaggaagtggcacagaaatttagatttttgtgtctttcttgcccttttctgtattgtctttagtttttagaaggactttcttggctgccttctccctcccccaccttgctccatcctctcttgcaaagtaaaatctcatcttcctgcaggaggttaggttgtaaagtttacacataaagtgaggattccaaataatcaaaattatcatggaaaatatctcaaatgacccagaaattaaagtatataaacatggttttgtgtatatgccagaacaaagttggaataccatatgaaatagttggcctgtaattaggagacattttatatgaaaaaataagtattctcaaaaactagaatcatgtacagcattcagaatgctcacaatgtgaagaggcacaccggacttagacatgctaaagtctcagattcaagtcctctcatctcatgctcatgttcatcctggtaaataacttcactttggtgtaaaacctcattgagtggaattgtgagcaaacttttgtactgtttatttttctcttcctggtcaagtttgcatagttaaatgcaagtatgttgtgattgtattttatccttcttttctgctttctgtttttctaatttcttcttcccttttaaaaatcctcactgccgggggcagtggctcacacctataatcccagcactttgggaggctgaggcaggcgaatcacttgaggccaggagtttgaaaccagcctggccaacgtggtgaaagcctctctctactaaaaatacaaaaattagccgggtgtggccaggtgcagtggctcacgcctgtaatcccagcactttgggaggccaaggagggtggatcacaaggtcaggagatcaagaccatcctggctaacatggtgaaaccctgtctctactaaaaatacaaaaaaaaaaaaaaaaaaattagccaggtgtggtgacgggcacctgtagtcccagctactcgggaggctgaggcaggagaatgtcatgaacccgggaggcggagcttgcagtgagctgagattgcgccactgtactccagcctgggcgacagagcgagactccttctcaaaaaaaaaaaaaaaaaagccaggtgtggtggcaggcgcctgtaatcccagctactcaggagggaggctagtgcaggagaatcacttgaacccgggagacccaggttgcagtgagccgagatcacacctctgcactccagtctgagtggcagagtgagactctgtctccaaaaaaaaaaaaaattctcactttcttcttctaaatccattttatagcacacaacaattcttctcttacccagaatgcttatttgtgtgttagcttgtcccatttcttagtcattttcgttattcaaaattatttaaaggagaattgagagtaggaagggaagacttctaatagtcctcttcgtttaaattctgtaatcatagcttccactctcctccttttaggtcctctaacttttgattcttataccttgcatatgaggctctttccttctttttccccccattttagtcatttttctgtagaaaatttctgcttatgcttggggagctagatatgaattcttgttatacttactaagcatcactggttctatctctagatgtttaatagtcaggtttttagatcaataggtttttagatcaatcccaaattcatagtgtcatgaaaagatagatgaggaactgagcccacctggagaagtcaaaggatacttgggccaagtgatataactagttattgacaagcttaaaccatgacccagggttctgatgtacagttgaatgcctttcctccaaatcacattgcttgctgttgaagccttggctaggagtaatctttagtaagatccttgaattgtgactttttttcttttgtttaattttattacagttccttcctttaacaaaaatgctaagtaatataagctttaagagggttaaaattagtccggtttcaaagatatatttgagaattatgtagtatctcttgagatagtctagagatcttagagctacgttggggcctaaggactgagaatcgctgtcatcagactagaggtttgagaaaaggagatttttatttatttatttttgagacctagtttcgctcttgttgcccaggctggagtgcaatggcgcaatcttggttcgccacaacccccgcctcccaggttcaagcgattctcctgcctcagcctcctgagtagcatgtgccaccacgcccagctaattttgtatttttagtagagacggagtttctccgtgttggtcaggccggtttcaaactcctgacctcatgtgatccacccgcctcggcctcccaaagtgctggcattacaggcgtgagccacctttcccggcctaactactgtttctatagaaggagttttccagattgatgcctaatgtacaaataactgcatcatcagtccctggctgtcatcattttgctgtgcaaaaagggaacatcagagaggggtccaggagccactccacatatcattcgtaaatgttattgctaatggagagagggatgatggtgggggcaggcgtatttgtgttcatagaggaaggtaggactgtaatctccatgcctagtttctgattggcattgataatataaccatctttcagagagtcagctccaagaggtaactgggaaacatctcagttttgctccgggcactatttcctttgccatctataccagaagctgtggtgaatgggaaagccattgctttctgaagtgcccttaggcctttctcagtgactcttaagttttaagaatcatttgggtgagcataatgctgaaatcctgtagctatgaaagctgcactgccatggcaataaaactccccattgaataagtaaaatggcaatttccaggaatctgggtggtagttatttcaatcaagttgagaaatgggatcaccgagagggggatttccgcagaatctgggctgtcagggaaatctttaggctgtcagggaaatctttattccccattgtcttctccttacaaattccaggagaggagtatgaggttatatttgtgtcctcagtaagcccataaaggtcagccagtgtgctaccttacattgtaattttccttttcaacattcttttttttttttttttggttaaattttactttaagttctgggatacatgtgcagaatgtgcaggtttgttacataggtatacatgtgccatggtggttttcattcgtttatgtactgaacataatcttagtacctcacagacagtgcacatgtactaacacctttcctgaaaccttaaaatataagaaatatagaaatacaggtagtttgtaagtctttgctcttggggaagccaattttggatttcctttgtctttttgtcctatcatactccttgaaaggggtagtaaaagcatttttctctttttccctctctgtagttcaccccagtggggcacatagttgctggattcagcaacgttctttcccaaatgattcttaaggcatgcgggtcactgaggtttatttttaaatccataacccagggttcagcagttgtccttactgaattcccgtgtggaggctttcagctgcccagacacccccacgtctttactgggcacattccagcagtcctaaagtcctgaccctcaggagtgaaattctggtctggtgtctcactcctggaattccttcatgaggcatggctatggcatgaatcaggtgtcagattggaaagccaagagatcaggtggcttgtgatcataatataaaaaatttctaactggtaaaatggttttggagacttaatgcgtattgaaagtttctttctgctttattgtcagccttagccgcctcttgatggtctctttagttcctttcctggattgtctaggagcatgctggaggcagtcagaacataaggagttaaattgcagtgaacttatggagaatgattaaacagtgattaagtgatattttaacttctgtttacaggggagaaatggatgtcatcaggaaaagggtttgtttgcagttttgactgaagtcatcttatcttagccagggctgcctgcccttattcaatttcatttttagctgcaaggtgaactcccccacacacttattttctgatgtccatctttgtctttgctcatattccaccccttcctttctttccccagaccccgtgttgctctaggaaaacttgctccactcagaacagagttggggtgggacttagctgcccttctgcatcttctgtttctggaagtctttgggatgaaccatacatgggagagtcaggatactggaatgccattgaactagtggaaaaagcactagataggcaattgaagaggcctgggtttgaattccagctctgctacttattagctatgtgatcttggacaaattacttaatctctgtaagtcttagtttcctgttctgtaaaatggaggtgataatttctacctgaaagaataggaattagagaggattagagttatatatgtaaagagcattgcctgacacacacacagtaggcattcaattatgtgtgatcaaagaggtcagagttgatggtagaatttagactgtctcggttagccttttgcctgtttttcccagtgctaattgtatagtttatatattatagtttaaagttatgctgccaggcgcggtggctcatgtctgtaatcccagccctttgggaggccgaggcaggtggatcacttgaggtcaggagttcgagaccagcctggccaacatggtgaaaccccgtctctactaaaaatacaaaaattagccaggtgtggtggcacacacttgtaatcccagctactcacgaggctgaggcaggagaatcacttgaacctgggaggtggaggttacagtgagctgagatcacaccactgcacttctgcttgggtgacagagcaagactctgtttcaaaaatgaaattttaaaaaaatgaagttatgctctcctttgcttttattacagtctagtaaggagcttggagggcttttagacccccataatctccatcaccctcctcaaagctgctctaaataaacaaatttaagtaaaaagtatttgttatataaatgcaggatgaagacttattatgatggcttttcctctttcaaccagattgcaagatacaagcctatttttaataaaatttctggttccctactctggtactaatgcaaagatttatttttcttagggatgagttgtggccaattgatataaaaggagatataggccaggcatggtggctcgtatctgtaatcccagcactttgggaggctgaggcaggtggatcacttggggtcaggagttcaaggccagcctggccaacatggtgaaaccccatctctactaaaaatacaaaaattagcagggcgtggtggctcatgcctgtaattccagctaccggggaggctgagacaggagaatcgcttgaatctgggaggcagaggtttcagtgagccgagattgcgccactagactccagcctgggcaacagagcgatactccacctcacacgcacacacacaaagaagatgtactttcttcttttgatacttttttacatatttgacgcatttgtgatagagaaatggattatgattattctatccttcttccttttactaaggtagaatgagccaaggtcagtggggcctgacggatctcagggcctttgctgttcctctcatccctggctatggttggctaagtctctttttcttaggtctcagggtgttcagctgttttgggaacttgttgaaaattgttgctttgcagtacaaaagacactctgttactttttaatcaatatctttttttttgagacagggtctggctctgttgcccaggctcgactacagtagcccatctctgttcactgcagcctctgcctcccgggttcaagtgattcttgtgccacagcctcctgagcagctgggactacaggcgcgtgctaccatgcccagctaatatttttgtatttttagtagagatgggattttgccacgttgtccaggctggcttcgaactcctggcctcaagcggtacacccgccttggccttccaaagtgctgggattataggcgtgagccactgcgctgggccagtaatcagtatctttttagcatattacttattttggggggatcctccaaatcaggggtctccagtgtgctaaatatttgatagagcatagggaaatttgagtattttagtttccgagtattagtaaagagtggctcacattgccttttactttatacgttcatgcattggaagacttaatattgttaagatggcagcactccccaaactgatctatagattcaatgcaatccctgtcagaatcccagtggggttttttcttcttctttcttctcctcctcctcctcttcctcttattcttcgtcttcctcttcctcctcctcctcttcttccagaaattggcaagctgctcctgaaattcatgtgaaaatgcaagggacccagaatagtcaaaacaatcttgaaaaagaacaaaattggaggactcacacttccagatttgaaaacttactacaaagctacagtaattaagacaggatggtactggcatagggatagacatatagatcaatggaatagaattgagagtctaaaaataaacccttacatttatggtaaattgatttgtgataaaggtgccaagacaattcaatgtagaaagaattgtcttttcaacaaattatactgggacaactggatatccatatacaaaagaatgaaattggccaggcgttgtggctcacgcccataatcccagcactttagcaggcagaggtaggtggatcacgagatcaggagttcgagaccagcctggccaacattgtgaaaccccatttctactaaaaatacaaaaattagctggatgtggtggcgggcacctgtaatcccagctactcgggaggctgaggcaggagaatcgcttgaacccgggaggcagaggttgcagtgagctgagatgacgccattgcactccagcctgggcaacagagcaagactccaccttaaaaaaaaaaaaaaaaagaatttaaaccctgacctcacacaacatataaaacttaactcaaagtggaacatagacctacatataagagctaaaattacaaaactattagaagaaaacttaggggtaaatctttgtgaccttggattaggtagtggtttcttgtagctaacactgaaagtatacacaaaaaagaaaaaaatagagaaattatacttgatcaaaatgtaaaacctttgtgcttcaaaggacactacctagaaaatgaagacacctcacagaatgggagaaaatatttgcaaatcatatatctaataagggacttatatccaaaatatataaagaattctttgaactcaacagtaaaaagaaaacccaataaaaaaatgggcaaaggatttatatagccatttcttcaaagaagatatacaaatggctaataagcacatgaaaagatgcttagatgcttaacatcattagttattatggaaatgctaatcaagatcacaatgagataccacttcatacccactagaatggctttaataaaaaagagagtgaggatgtggagaaattggaacacccccaacattgctggtgggaatataaaatggtgcacctgctttagaaaacagtttggtggttcttcaaaaagtagagttgccacatgacccagcaattccaaagtatatatccaaaagaaatattatattcatagaatatagaaaacatatattcatagaaaactcgtacataaatgttcatagcagcattattcatagtagccccaaagcagaaacagctgaaacatctatcaactgatgaatggataaacacactgtggcatatccatacaacagaatattatttgtcagtgaaaaggaatgaagtactgattgatgctaacatggatcaaccttgagaacattagactaagtgaaagaagccagacacaaaaggcttgtatgattccatttataccatttatacataataggcaaatccatagagaccataagtagattagtggttgctaggggttgaggaggggcgaatgggaagtgactgctaattgatatagggtttcttcagggggtgatggaatgttctaaagttagataatggtgatggttgaacaactctgtgaacatactgatacttaaatatccattgaattgtttacctaaaaagggtgaatttatgttaaccaaatctcagtgaagctgttataaaaatattaggctgatttgtaggtatgaatagtatttgtctgtttgtattgggccccttattgctgccactgagaatcttgaagttgtcttgaatattttgcttcagaactgtcactgtcttgagcaggcaagttactgttgccccaaatcttcaaggtgagaaacaggtttgcaatcatttttttgcaggagaatacatgatggcactttatatcaggaagcgaacttttaaggtgagcactctgaagttgaagcatttccaagttttaagtgggactgtgccctaccttagttcttacttcatcctttaaactgtgtgtcacactggagtaggcagtttcccagccccatacccagctccaccaagatcctcacttctttcatcatttgcccatttttccccaggctatgtttgatcttgctctgaggccttctttcttgggaggtatagcgagagtagctgcagaaacctctgggtggcaccctgcccccacaggattaccaaagaatgacatgtgtggaagaggctcaggcctgtgttggcaggaagaagtgactcatttttcatcaaaggaatttcaaagaacatataatgacaggatgatgtcacaggagcaggtggagacaggaaccttgattgagctgctggaagatattaaatggtgtggctgcctgggcagtcagaatgattgaccagcataaatcacaggaaacatcacctgttttttagttcctatttcatgagccctggtgtgggcagtgctgttcatgtgccctcagagcatatggttgagtctatgcatgtcttgggtatactgtgtttgtatctgggtgagatggctcacaacatcctgtgctagtcatggacttctttttcatgcagggcggcgtgtgtgggttcctgcactgtgtgcctcagttctatagctagcagggtctgtgtcttggaaatgagcctcacatggtcatactggctggtttgaaggcatgacatttcctctgacatatttagagaggggaacttgccttgacatcagaaggtcagatctcagaattttttaccttattgccaaaagtaccctagttccatctagtattttggcaagagctagatctttgctcaaagcccagttaagtcttgtggtggtggtgtttttcttctttgagtagagggccctccaatggtgttgtatggttgaagctgataaggtgaggcggagtgtggtggcgggatggagagtttcagtcaggataagtcttagtatcttttcatatcgcaaagcagtaaagttggttaggttattcaggctgttatttatattaagattgtgaaagagtgctcctggtcatcatcatgcacctaccagagtctgtgtgattatgaggttggaggctaaattagccatttacacaaagataaaagagaggctagcattgataatattctgcctcaggtttcaggcctctcaaggaaggtcttaggagagatggcttagcaatatcaattgctgcctttgtgcttataactcgttcatctgaagatggcctggaaaaagggacttttaggctgcataggacaccaccaaaaaagtagaagatactacctctctttaagatgtatcagggctggtgctgggcgtggtggcacacgcctgtaatcccagcactttgggaggccgaggcaggtggatcacgaggtcaggagatcgagaccatcctggctaacacggtgaaaccccatctctactaaaaatacaaaaaaattagctgggcgtggtggcgggtgcctgtagtcccagctacacgggaggctgaggcaggagaatggcatgtacctgggaggtggagcttgcagtgagccgacatggcaccactgcactccagcctgggcgacagagcgagactccgtctcaaaaaaaaaaaaaacaaaaaaggaaaaagaaaagaaaaagatatatcagaagagctgggcatggtagctcacacctgtagttctagctactcgggaggctaaggcaggaggattgcttgagcccaggagttcaaggctatagaatagtgccatgattgtgcctgtgtagtcactgtactccagcctggacagcatagaggcccagtttctttaaaaaaaaaaattttttttttaaataaacccaagatatatcagaagcaagaaggaaaagttaaaaaacaacaactataatttgaaagggaggaaggaaagctttatttatttcttgacacagtctttaattgttacgttcttctggctgatcatgagttttgtttttagacaatattactaggtacactgtaggatgtaaacagatctttggagtaggataagaaggaaatgagtcagataacttacttcttagagaagggtgctggactttccgggggcttagttagcaatattcctcctccctgctagcagccatctccctgtatctcttcatgaaataacaaatcattagaagagatttttaacctgaagtgctgaaggacccagggaagaaagttccctagggtgtatttgatttgggagccccctgagggtaatctgtggtgatgctgtttcagaagtcaccacctgactcgttgtcagatgagtctgagcccaagactcgtacctgccacataatatatacaggtcctctctccctttggttatgagctaaaggcctttaatcatgaggtagaggagtggataagggagaaatatctgaaacccaattaaccagattccagaatgttaagggaatccatgtgggggctgggattctgaacatctctctctctctctctctctctctctctctctctctctctctctgtgtgtgtgtgtgtgtgtgtgtgtgtgtgtgttttggtggggggtgaaatgacttttttttttttttaatttgagacagagtctcactctgtcaccaggctggagtgccgtggcatgctcggctcactgcaaccaccaactccctggttcaaatgattctcctgcctcagcctcccgagtagctgggattacaggcacgcgccaccacgcccggcctagaaatgacttttttaggggctcacctataggataaaatccaaactcatcttgtcatttaagatctttcataatccagtccaactttctataacattaaatcaaaattatacatgttcttactttaaaaggttaaaatattactataaggcatatgacaaaaataatctgtattttccactatttttttttaagagacagggtctcactcttccacccaggctggagtgcagtggtgtgatcatggctcactgcacccttgaactcctgggctcaagggatcttcccacctcagcttcctgagtagcttagactataggtgtgtaccactgcgcctggctaatttttttttctttttgtagagttgggggtcttgttttgttctccaggctagtctcaaactcctggcctcaaatgatgctcctaccttggcctcccagagtgctgggattgcaggtgtgggcccccacacctgggccacatttctgtttcttttttttctgcacacacaaacagccagaatatatttctttctcttttactagtgattcttgatttttttttttttttggttttgaacattatctgttgatattctactacagaaaattagggtttagtttttttattcttacccccttaacgtacacactttctcttcccccttcttcccaaagtcacacgttattgccgttatattcagtgttcagattattgtgattatataaatattgcttaaaggtgagctatgtaatatactatgattacatttcctttttggaccaacttttaatttttcctggaattaataattgccatattttgtcacttgtttactgatctatgtacataccttcagactctctcatgggactctaagacttctctctcagtatgttgaaacatatcaaataatcttttagttcaatagtctatttggagacatcccccaggagctttctcttattcactctggatgggttgctcttaaagcctttagtaaagctgtcatcctggcacttcccttcactatcatacggggaaattccctcacctgtcttccctgttggatttcatgtttcccagagctgatgtcgtatttcatgatgtactccattttttcattgtggtatatcctagcttcctgagaaaggatacaagggaggtaaatgtttttgagactttgcttatctgaaaatgtcttattctacttttcatttgattaagagtttgagtatagagttctaggttgcaaatcactttctagcagattttttaaaaaattatttaaaatttttttgtagaaatgagatctcgctatgttgcccaagctggcctcaaactcctggcttcaagcaattgtctggctaatactgccttttaagtctctctaaggatattaattagaggctgtctttctctctctctctctctgtctctctctctctctgtctctctctctctctctctcctctctccttccttccttccttctttcccctttcccttcccttcccttcccttccctcccctcctctcccctcctctcccctcccctcccctccccttcccttccctttcttttcttttttcctctgcatccagcattgtctctgtttcttctgagctccttctatttattttggtctctgtctttcatgttagaagttctcttaaaatgtctgatgtttcttggtgatcttcacatttaagacttgggccctggccaggcacagtggctcacacctataatcccagcactttgggaggccgaggcaggtggattgcttgagcccaggagttcaagactagcctgggcaaccccatctgtacaaaaaattacaaaaatgagctggatgtggtggcgcatggaggctgaggtgggcagattgcttgagccccggaggttgaagctgtagtaagctgagactgcgccactacactccagcttgggcaacagagtgagaccctgtctccaaaaataaaaaaagaaagagctgggccctaaaatgctgattggtgggactcgttaactggtatactcctaatgaataaccaggtagaggaggttggtttccccaggaaagactggccagtctcccatctgggggccaattctggtagctagagctctgggccaagtggagcaattggccagtctggaagggcctcatcgttcattgtcaaagtttattgattgattgattgattgattgagacggagtctcaccctgtcactcaggctggagtgcaacctctgcctcccaggttcaagcaattctcctgccacagcctcccaagtagctgggattacaggtgtttgccaccatgcctggctaattttgtatttttagtagaggcggggtttcaccatgttggccaggctggtctcgaactcctgagctcaggtgatccacctgtttctgcctcccaaagtactaggattacaggtgcgtgccaccacacccagctaattttgtatttttagtagaggcggggtttcaccatgttggccaggctggtctcgaactcttgagctcaggtgatccacctgcttcggcctcccaaagtgttaggattataggcgtgagccatcatgcccggcccattgtcagatttcatttaatatccctgttttcactgagacacctggctcctgacctcacacgggcctgaagacttccaaccaatcttgttttcagccttactctgcagcatgccttctcctaccaagtcttcagaggttcctggtgcttccaatttctgagcctttctgggattctgcagtacaatttaccttgtttcttattgttgcccatttcctgcaggcacttagcagagagaaagaaagctgacatttaagttttcgaccatttgtttatccacactccagtgtatcaaacttttgttgctatttcttattcttattttctgtgggtttgtgccattttaattctcttactgtcacttttctgaggtttctgaaagggagctaaatgtgcttattaaatttgtgatggataccccaaagttggcagaagttaatcttcccaatttacttacctctctctgagcctcctcaaccccaacccaaatacacaaaccctgtggttcattctagtgtcacttgtactttctgtttttcattctcttcctcatgctatctctcctcctggagtgtttactcttcttatttcagactgttgaaatcctatacattcttctagtcccaggttatatttcttatctatggaagccttttttttgacttccccaacaggaaatgaccatttcattgactgaatttctgaagttccattcactgagttcttatagtcttgccctcctgacacagcctgtactgctttatgttaagactatctgtatacatatttctccagttagattgtaagctcttaaaggatagtagcataagactggctttgtaattttttttgttattgataacaatcaacatagtacctaggcaactaaatatttcacagaaccacagaattttagagctggaaaagaatttagagatctagaatgtgaactcattttatgaatgagtaaacagatccagtgtagttaaacgatcctgaagtcatttaataagccaagaacagaactggacctataatcgtctctagttctgtaatgtctaaatgcattgataaaatctgatatgtgcttatttagatattctggtttatcaaaggttaaccagagagtgctttttgtttcattcttgttgaaaatttttgtcaatatctttttggttttagtaattaggtatgccataggtaatttcttttcttttctccctccttcgctgcctctctctcttctttctttcttttttcctcccctccccgcccctctcctctctcttcctttctcttttcttgtcttttctttctttctttctcttcttttgtgtgtgtgtgtgtgtgtgtgtttgtttttgttttttttttttttttttgatggaatcttgctttgtcacccaggttgaagtgtagtggcgtgagtagctgggactacagatgtgcatccccacacccagctaacttattgtattttttcataacaacagggttttgccatgttgcccagggtggtctcgaactcctgggctcaagaaatctgccctctcggcctcccaaagtactgcgattacagacgtgagccaccgccttgtgctgtctctctttttctctttctctctctttttgataaaaatcaggatcttgagtattctggattttgtcaaaaactgagctggaggtggtgcggtggcctgtaattccagcactttgggaggccgaggcaggtggatcacttgaggccaggagtttgagactgggttggccaacatggcgaaaccccgtctctactaaaaatacaaaaattagccgggcgtggtggtgtgcctgtaatcccagctacttgggaggctgaggcacgagaatcgcttgaacctgggaggtggagtttgcagtgagctgagatcgcaccactgcactccagcctgagtgacagagtgagactgtgtctcaaaaacaaacaaacaaaaaaaccccaaaacaacaacaacaaaaactaagctggataatagttttcttcccaggcatatatgagcatcagagacccaaggattataggtagggaaaaaatgtaggcaactgtattgaaggtgctctgatttttaagaaaattttaaaaattcactggatatgatgtatttggggtgattctttctttctttttttttttttttttttaacctagcagtaaagtacaggcccagttgggtcctacttaaagttttcctgtttgacaatttatcaggaattattattgcttaagatagctttgaagtaaattgtctgtgtcaaagaccttcctccacttctctcacttacctagctcttggcagctgtttccaaaatgtttgcactaactccatagattcatgtctgaaggattagatactccaggaacatctattgggagaaagtttaactacaactgttgtccatttttcaattaatgtgccagtcactaatcaaaaaaacagatgctgtcgttttcctcatccactacttgggacacctaaggatggatggacagatacttaagaggctgcctccttcttctgagattgggcttttcatcagggctgtgccacagggtgtgatgctgtgtgatagcagatggctctgcttcatgcccattactttttgttttatccaaagtagaagctgtggtccccagattttagagagtaagggcttaatcatactcattggcttttctgcctttgcctgtttctgcattgccacctggctgccattagagggaattcattacaactctgagtccctgcagggagctgagaggagctatccttgtgtttaggatgggacatgtgttcttaaaactgggccaggcacggtggctcccagcactttgggaggccgaagcaggtggatcacttgaggccaggagttcgagaccagcctggccaacatggtgaaactccgtttctattaaacatacaaaaattagctgggtgtggtggtgtatgcctgtaatcccagctactcaggagactgaggcacaagaattgcttgaacctgggaagtggagattgcagtgagccgatatctcaccactgcactccagcctgggcgacacagcaagactctgtctcaaaaaaagaaaaaaacaaaaaacttaaaaatggttacccagatttccttttatgacttgttcagtcagaggcagctgggaggatgcacgctggggaaagcattactcaccaggcacacatagtggccctgactgctggcaagtagtctgggctgtgttaagagtgagtcacctcggggaatggaaaaattgcaaggtactgaggggtaggagttgtgtgccagtgactgctccttttctgtctgctattttctctataaggactcatcacaaaaccataaatactgacgatcctgttgaggcagccgtgaagccaaccaactttatggtgataatgtttcccataaaaggaatgagctgactggacatagcattgttgccttctatgttacaggtgtatatagattttgacacaagcttgaacttgtataatgaaagttccatgtgtgagaatttcatcagaataaaagcaacacagttttctttgttgtttaaaaacttagtcttctgtgtctatctatctttgtccagtaggggtcactgagggttaggctctcaataagagaaacactaatctagtgataaatgagctggattccttgtctattgtgacatctttgtatattcagtactatgttttttaaaatattagagcagaaacaaaaggcgtgaacttgtattaagaactttatgggcgaagcgcagtggctcatgcctgtaacccgaggcgggtggatatcacctgaggtcaggagttcgagaccagcctggccaacatggtgaaaccccgtctctaccaaaaatacaaaaaaattagacgggcatggtggcgcatgcctgtaatcccagctacttgggaggctgaggcaggagaattgcttaaacccgggaggcagaggttgcagtgaaccgagattgtgccattgcactacagtctgggcaacaagagtgaaattccatctcaaaaattaaaaaaaaaaagaatatttctggacaaaaataacaatcctgggcaagattctggaacagtccccatagacagggcttcttttcttcgtatcatttttttctccatttctttaagatgttggctaccagagtttcctggaaaaagcttactagatagatattatttcattggggaaaagggtcaaaatgccagagagagagattacttaaaatggtaatatggctgttgaggttgactagatattcttgtcctttccctttttgaagcaatgctgtcgaagcctaatttgacttagtcattgagctgttcaataccacacattactttcacttaccttcttgcatttgccactgaggatgacttgatgccctgctaggaggtctcttgtgtggtaatcataataacaagagttggcattaatgagtcaatgtttaatgctttttaaatagttaatgcttactgtgtgccaaatatattatgcattttctcacttaatcctcactgtaacactgtgaagaggtaattttattatccctttttgacatgagataactatggattaaagagattaagtaattggttcatagatacacaactagagattgtgaaatcagaatttgaatataggtttggctcacaaattatatttacagccctggtaagagagagagggagagagagagagagagaggcaggcacttgggtttaagagtgagttttcttttttctttttttctttttttgagacagtttcgctgttgttgcccaggctggggtgcagtggcatgatctcagctcactgcaacctccacttcctgggttcaggcaattctcttgcctcagcctcccaagtagctgggattacaggcactcctgggtaattttgtatttttaatagagatggggtttcaccatattggtcaggctggtctcgaactcctgacctcaggtgatccaaccacctcgtcctcccaaagtgctgggattacaggcatgcgccaccacacctggccaagagtgagttttctaagtgctgtaccagagcatctctcactttattttctgcccctcctctttagtgttactttcccttttctttcttaagggtaagaccttcagttgctgagcttgataggaaggccatctagagttagatcctgggcagaatccatatccggagggatttccagaagtggaatttcttttcttttcttttcttttcttttcttttcttttttttttttttttttttgtgatagagtcttgttctgtttcccaagctggagtgcagtggcgcgatctcagctcactgcagcctccacctcccgggctcaagggattcttctgactcagcctcccaggtagctgagactacaggcacatgccaccatgcccggctaatttttgtaattttagtagagacgggtggccaggctggtcttgaactcctgaccttaggtgatccaccccgcctcagccttttaatgtgctgggattacaggcgtgagccaccatgcccagccaaaagtggaatttctttctccctgccttcctctcccctcccctcccctcccctcccctcccttcccttctctattgtcttgctctgctgtctaggctggagtgcagtggtgtgatcatagctcactgtggcctgaaactcctgggctggagtgattctcctgcctcagcctcccaagtagctagaactacaggtgtgtaaccactgggcctggctaagtgttattatgttttggagagatggggtcttgctatgttgcccagggtggtcttaaactcctgtcctcaggcagtcctcctgcctcagcttctcaaagcgctgggattacaggggtgagccactgctcccagccaagcagtttaatttctgaattaataaactatcttccttccagctccaaggaaaagcaaaacttacacttgtgttcttggagacacttttttcttttaaattcccaggtagatttggaagttcactgttaaagatggttcgacacccttgttagtgtatgttacctactaggcctctctagaagagcattttgagttatttctgccataagatgaatggttttccaggcacttgttctcggttgtatgtttttgtggtcaaaaaagatgcattaccagaagaaatgtttatattttgggagtattcataattcactgggcccagctttgccctttctagtgtgcacccgcccccattcttgctcttaagcagttctcagatcctctcattcatttattaatttgctcattccacaaatagttatttagtgactaagattttataaaggagagcagacatttatctagcttcaaaaacagtctagtgagggagtaacaatatgtgctcagctgtattataaagcacaaagtgctaaactttatgagagaaacagataaagtataataaaagctcaagggagggagaagtttacttctcactgggatggagggaggaactggagataattctgtggaagtactggctttaagctggtctatagaaataggagtttaatatctggagatgggaaggaaaaacgtgccaggataatgagggaaatattgtgaagccagagagttttggatttaatttgctgatagggagaaatgtaaagttttacagtgaagttataaataaacatttattaagcatttaaaatgtgccaatcattatacatgcttcaaggagattactgttgtggtgaacgagggcagggttggtaagttggagactgagattagacagattaggtaatttaggtgaggtaagttatcagttgccaaggtttcgtacagtctgagcaatattcatagtctttgtggtcagatgtagtttgtttgctgctcctccaaataatgacaattataatcagcaattattgagcaggtattgagcacctgaaacacattaactcattcatccttactacaactctgagacagatgctattattatcatcattttacagatgaggaaattgaggttccatgaagttaagtaacttgcccaaagatgctaaatgtgatgtatacatagtagtatggatttaaacccaggcagactgggcttataatttccatgctactataatactcatggcatctatgtatacggagcaataaatatggagattttccttactttattgtattcaatgacacttttgtatgtagaatgttctttgtagacattctgggcctttgcaagttgtctcaataccacattgccaaaccttagaggcagagtcatggatgtctcctaattaagttatctgaagcccacatcctctgcctgtcttcagttagatgcctagtgtactcatgggaggggacagatgacaagagtttcagggccaggctttgatgtctgcatcgtgccatttccagaaacccaaggttttcagtcctatcggttatgtgctattccctctaccaaatttataatcttaggtatatttattgtattttttaaaagacttctctctttgtaagcattatttttctagatttggcttttttagttacggtgtaacgtaaatttttagtctgaatctgctaaagttatgatgcttgtggatatcaattattttgagaccaagtaaatctcaatgacatttgaataaaatgtccagcatacctttgcacaggcttgttttgcttgcaaacattaaagtaattctggggtgttgccttgtgttgagatttcttgtgggtaacagttaggggagaccatcccaaattcctgtgggtaatcccaaagagaggcagatctaaaatcttaatgaagttctgagtctgtcttctacaaggcttctttcatggtttggggccctgcccgttggctgttagtaagggatatcctggggggtgctaaatgtgactttaaaaagactgttctttgtatgataaatgatctcttaaaaagaaaactagtcactccctcctgccagcctctaaccacttcctgtaaatgacagcacacagatcttagtttcaccaagtgaaaaaattattttattttcatgaaagcagttcccctctgcttcttccttccaacatacatatatataataaatataaatataaatatatacacacacacacacacaagctgcagataggcaggctttttacctgtaatatcaaggtataaaatgacatgtttttatgatcttatgagaataaattactttggttatctttcattgtcttctctaataataaatgtaggttcagaacatatcttggtatttgagtactttggattttttcccccaaatttcctaggtgtttttgaatgacacaaacatggtatatgattttctaattactgatgccagaagctcctataacagctttatgatggcttcaggtagcaaatagggcagggaaatggctttcactttgggaaacgaaaatatggtgaaggtatttgtaagactgtgaaaagacggttgtggtggctcatgcctgtaatcccagcactttgggaggcagaggcgggagggtcactcttaaggccaggagtttgagaccagcctggactacatagtgagaccccatcttcaaaaaaaattaaaaaattatagccagcatggtgatgcatgtttatagtcccagctcctcaggaggctaaaccaggaggattgcttgagcctaggagttcaaggctgtagtgagctatgatcacaccactgcattctggcctgggcgacagagcgagaccatgtttcgaaaaagatggttgagaaatggtggacagatgccaagtggagtggctcatgtctataatccctgcactttggtaggctgaggcaggcagatcacttgagcccaggagttcgagaccagcctgggaaacatggcaaaaccccatctctgcaaaaaacacaaaaattagccagacgtggtggcacatgcctgtagtcccagctactcgggaggcagaggtgggaggattacttgagcccggtagtttgaggctgcagcgagctatgattgtgccactgcattccagcttggactacagagtaagaccctgtctcaagaaatggtgatagaaacagcactagcaggctgggcgcggtggctcatgcctataatcccagcagtttgggaggcccaggcggatggatcacctgaggtcaggagttggagaccagcctggccaacatggtgaaactctgactctactaaaaatacaaaaattagctgggcgtgccgggcgcggtggctcactcctgtaatcccagcactttgggaggctgaggcgggtggatcatgaggtcaggagttcgagaccagcctaaccaatgtgatgaaaccccgtctctactaaaaatacaaaaattagccgggtgtggtggtgtgtgcctgtaatcccagctactcaggaggctgaggcaggagaattgcttggagccgggagacggaggttgcagtgagctgagatcacgccattgcactccagcctaggcaacagagcaagagcgaaactccgtctcaaaaaaaaaaaaaaaaaaattagctgggcgtggtggcacacacctgtagtcacagctactggggaggctgaggcaggagaattgcttgaacccaggagatagaggttgcagagatcggagcatcactgcactctccagcctaggcaacagagcaagactctgtctcaagaaagaaataaaagggaagaaacagcactagcaattaatatatactgttgttgagattcttttcttaaagccaggtggaactattatataaataagtcttgtaacgaggaagtataaacacctcaagttgcttaccctaaagttagtgtacttattttgacagaatttttttcttttttgagatggagtctcgctctgtcgcccaggctggagtgcagtggcgcgatctcggctcactgcaagctctgcctaccaggttcacaccattctcctgcctcagcctcccaagtagctgggactacaggcgcccaccaccacggctggctaattttttgtatttttagtagagatggggtttcaccgtgttagccaggatggtctcgatctcctgacctcatgatccgcccgcctcggcctcccaaagtgctgggattacaggcgtgagccactgtgcctggcctgttgtgacagaattttttaacaaagggataaaatatatttatttggaatcaggcataataaaagttcagacatgggccagacacagtggctcacgcctgtaatcccaacattttgggaggcctaggcaggaggattgcttgattccatgagtttgagaccaacctgggctgtaacatagtaagatcctgtctctacagaaaaaaagacagaaaaagctcaggtgtcagctcatcctctttcttggatgaccttggcaaaataacttgaatttctggagcctcaagtgcttgatttataaaatggggtaataatatatagttcccagggatattacagggatcaaatgaaataacagatgtaaagatgctttatagtagctgcttaataaattttagtttcccttccaagcaagtccatcttcttcgaccatcacagcccaggagcttcttcacttctccacagcaaggggtgtgtcatagtcatcttggtgtccatggtatctggcacaatgctctgcatcttttaatgaaatgaatgaagtgctttgtttcagaagagagggagctccagcttagtctccactggactatgtcatcaatttttcctttctaattcttattcccttcagcaaacactattacatttcacatatcaagaattctctattgaccctacattgctctctctgctcctgtttacagcaaagttccttgaaggagttgtttttccctgtccttgattattcttctcccattcattagttcttgaatcgctccagtcaggctttttctctaccatgccatcaaaactgcacttgttagagtcaccagtgacctccagaatgctaaattcaatggtcagttctcaatcctcaacttgacatattaatagctcttgcatggttaattgctactttttagaacgctttcacctggcttctgggatagcttactcttttgggtctccctctaatccactgaatcctcttttttagccccttttggttgttcttgctcttccctagataatgttgaaaggcttccaggacttagtccttgaacttgatctcttctctatgtttactcactaaataatgccatctagtctcctggctttaaaattccagcctgggccaggcacagtggctcacacctgtaatcccagcactttgggaggccgaggcaggtggatcacctgagatcaggagttcgagaccagcctgcccaacatggcaaaaccgtgtctctactaaaaatacaaaaattagccgggcgtggtggtgggcacctgtaatcccagcttcttgggaggctgaggcaggagaatcacttgaacccggtaggtggaggttgcagtgagccaagatagtgccactgcactgcagcttgggtgacagagctagactccatctcagagaaaaaaaaaaaaagaaaaaaattccaggccaggtctctccctgaactctagattcatatattcaattgtctattcaaagttccacttgaggggtgggcatggtggctcaagcctgtaatcccagcactttaggaggccaaggaaggaggatcacatgaggccaggagtttgagaccagcctgggcaacatggcgaaacccggtttctaccaaaagaaacaacaaggaagtttcacttgaatgtctttaggcatttcaaacctaatgttattcaaaaggacatttctaccctgcccccccaaaaaacagacagccacagccaccaatgaatcccaaaccctctgcatctctggtatcagtcttccccatctcaggaaatagcagttctatcctttcaatttctcaggccaacattttggagttattttttattctttccctgctcattccacaaccaatctataagcaaatccagatgattccttctttgtaattacagaatttgaacacatcttaccacctctgtggccacactctggctctacccatcattttgtagccaccaattttcacttgaattattatactggcattatagctggtttccctgtacccactcttatctctcagtagtatgatctcaacataggaacaagaatgatccttttttttttgagatagagtttcgttctgtcacccaggctggagtggcgcgattttggctcactgcaacctccgcctcctggattcaagcgattcttctgcctcagcctcctgagtagctgggactacaggcgcgtgccaccacgcccggcttatttttagtatttttagtagagacggggtttcactgtgttagtcaggatggtctcgatctcttgacctcatgatccacctgcctcggcctcccaaagtgctgggattacaggcgtgattcaccgcgccaggctgagcaatccttttaaaacctaagttaaatcgtgttactgtctcacacaaagccctccaatggcttcccgtttcacctagaataaaagccaaaggctttacaatgatctgtacagccataggtgatctgacctcgtctctggcctcctcttctgatactctttcctttcctctttcaggtccagccattctaggttctttggtgttccctgaacataagaaacgtaattctgcctcagggactttgcacttgttctttggcttatccattctccagatagccacatgacttgtttgctcatattctttttttttttttttttttttttttttttgagatgcactctcactctgtctcccaggctggagtgcagtggcgcaatctcggctcactgcaagctctgcctcccgggttcaaaccattctcctgcctcagcctcccaagtagctgggattacaggcgaccatcaccacgcccagctaagtttttgtaattttagtagagatggggtttcacggtgttagccatgatggtctcagtctcctgacctcatgatccacccgcctccgcctcccaaagtgctgggattacaggcgtgagccaccacgcccggcctcatattctttatctgctcagatgtcaccttattagacgagccttctctgaccatcctatatataaaaccgtaaacttggctaggtgctggccgggcgcagtggctcacacctgtaatcccagcactttgggaggccaaggcagttggatcacgaggtcaggagttcgagaccagcctggccaatgcggtgaaaccccatctctactaaaaatagaaaaattagctaggtgtagtggcacgtgcctgtagtcccagctgctcaggaggctgaggcaggagaatcgcttgaagccgggaggcacaggttgcagtgagccaagatcatgccactgcactccagcctgggcaacagagcaagactctgtctcaaaaaaaaaaaaagtaaactatcccccattgacattgacactccatctcctcttcgtctcctttagtattctccatagcatttatgtgacaagctatgtatttacctgtttatatttcttttctttcttctcctactagtatgtaagttctgtgagagcaaggtctttgttttgtttactgctattgtttctggtacctggaacatgacctggcacataatatgaagtaaatatttgatgaatgaaatgtaggttagcacaaaattgtagatgatcctattgccagatttaaaagttcccattgtattagtggtcccgtcaaggcccctttattatttttctgggtagtaggttatgcacatctaaaactctttccttttgcttcaacaagctctagaaaaaagcaaaaggaaaataaataaataaataaagatttcacatagaaaaaaaagtaaaacccttccctattattagaaaaaaataaacttgacagatatataaagcaattttcattttttaaagcttgtgagactatagcatcttcatctatatcatagtgtaataggtactttagaagtaagtaaacagggtctcactttgtctcaaataaaaaggctgtagtgcagtggcatgatcatggcttgctgcagccttgattcctgggctcaagccatcttcccacctcagcctccccagtagctgggactatacacacataccatctcatctggctaaattttaaaatttttttgtagaaatggggtcccactgtgttactcagtctggtcctgaactcctgggctcaagtgatcctcctgcctcagcctcctgaagtgcagggattacaagcatgagccactgcatctggcctgatttagtgagtttggacaaatgtatacagtcatggaaccaccaccacaatcaacaaaaggaacatttccatcctcttacagttattttgtgatccttttagtcaatttccttccctcattctcagcctcttccatttctagttgtatagttttgcttttctagaaagttatataaatggaatcatatggtatgtagccttttgtgtttggctttttttatgtagcataatagttttgagaatcatctgtgtcgtcgtatgtatcagtagttttattctattttattgcagaataggtagtccattatatggatgcacaatttgtttatacatttaccagttgatggacatttgggttgtttccagttttttatattatgaataatgctgctgcaaacattcatatacaggtctttgtgtggatatacgtttctctttttcttggatagatacctaggagtgagattgctgggtcctctggtctaaggccgggcacagtggcacatgcctgtaatcccagcacctttggaggcagaggcgggaggattgcttgaggtcaggagttcgagaccagcttggccaacatggtgaaaccccatctctactaaaaatataaaaattagctgggtgcggtggcatccacctgtaatcccagctactcaggaggctgaggcaggagaattgcttcaaccctagaggcggaggttgcagtgaactgatatcgtgccttccaaagtgctgggattacagccatgaaccactgcgcccagccagacggatttttttaacccttgagaagtaccccctaaatgagcagtttgctctcctcgctgatcttcatcacacctagatgtcaggtctgcttcatgggagcttgctctgtatgtatcctccctggactgatgttcaggctccttgcttctcctcccgggttgtgggtatggagggtttgccctctgacaactccagggtacttgtggtgctcatacatcctcatgtactttgctttctccccgcaagaggttccctaatgcttctgtgacttttttcttctggctacatcctgaagtctggccttgcaggcaggctgggaatggaaagttaagagtgtgacgtcctctgacaccctcccttcttgtagaagggtctgaggtttgtttatttaagctgagcagaggatgccaaagatagaggtttgagtcagcttgacactggcttaggcgctccttttcactctccttgttccttcttccctttcccctcccccgctggccagttgtttcctgggctttgtctgagatacactgtacagttttagtcccagtctactagcgcctgctgaaaaacagtcagaagtgagatggaggagaagctgccaggaagtttctgacaacactaagctccggcctctgcctctgctgatagtacaggacaacagtaacctcaggagaaaggcatccagaggcctgcgctgagcttgtggctaactcaagggaggagaaaggacgggcctggaaatgcccctcttagattcatcttatttaccaccaaccatctttattttgactcacgttcttggagttgctggtgttctatactggaagaggcatgccagaggtagagcaggtaactaactggtacccagttattctttaaatctactgtggggcttttgagggtggggtgaatgatggaggtcttcccagttgctttccttaaagggccagtacgtccttcagctggggtgctgtcagacttaagagtgtgtgtgtgtgagtataatgaagaagctggtctgccctggggccactttgggatgggggtggtgctcttttctgttctgtgagtctgtctggagagtgctggttagatgaggtgatgactgggctcaaaactgaagggaagtggctgctgtgctgacttagtctttcctcagagaactgagctctttctttctcaatctcagagtggtttcttggaaccttgtttttaactgaaaacatacagtaactcttttaccctcctccaggtatagatttgggttggagaagtttctgttaacttggtgtgttttggggtgagaaaaggcagaggaggaagggtcagtcagtggaaggggtcgtgcgatgtccttgccgaggggcatcctggaacactgggtgtctgtgttctctttgatatcattgatactgttcctacacagtttggctatgtgtatccaaatcatcttgttcaatgcaaggaagttaatccctctcttccctagggaatcaggctttgataattaaaaaaaaaatttttttttgtaatggcaccagaaccctcattcttcccatattgctattagttatattctgttgacttctaaacactcagagcagggatcagccctgagtttggctgattctgagtctccatggttgaggattcatatggtctaacttttactggagtgtatacccttgggtctcattgccttcagtactctcattgtgatgggctcactaccttcaaacttaggtatgtagacactttttatagtgtatcttacaagttaaggtggggatttgatggcttattatttagctttctattaaaagttcacaaacgcctgacagaattagaattagattcaatcattccccagtgtcctttccagtacgtcccagaaaagcttttgactaaatattcagatcctagtgtgcatctatagcagcggaaacaaagacagacattttagaagtgtgtttgattgtgtggtggtgtttttaaaaaagccacctcaaagtggctttcctgtatttgaacttagaaagaaagagataggcaggcttaagttgtttggtcctatttactatttcacatgtaatgagaaaataaatacaatatcatttaggtagaggctgctgcttttctttccttgtgcattatggtaatgtcatttttaaacattaaataactaattagttgttaatatttttaaagtttatcttcagtataggactttaatggaacttaagagctatcactgtattttaagtgctttcttttttatgtttagaaatgttaatttcataaacagccataaagtaattgaaataaaaagatacattgtaaaagctttttatttctatgaaacaactttgattctaataccaaatagttatatcgggaatgtgctacgtttgctttatctgtaaaatgagagatgtcatttttcaattggaggctatggattccaaatcttccatggagttacttacgagattctgtacccattttattataattgcaattttaagatgcatttcatttatttaaaaatgtatttttaaaaataatatgtacactctaattacctgccagttggacatcacagaataaagtttttccaccatctctgtgtatatatttgtactattaataaatgtacacttgattaaaaacacaaagatcgcttcttctgatgtagtcttttttttttttttaattggagttacatacagtattgcagaacaaactatagcacataggtcttgtgcctaataatagtaataataatgattcaggcagagctcagttgtatgagctcaggtgttaactgaactattataatagtgaagtgggtaattaattcatctctatgtagtaatactgtattactggtttagtatgtgtaccagaagtttctgttcttttgtctcacttttctatttgtgtttacatattatgaggaatgttcatagttgtttttttctttctttctttctttctttcttttttttttttggagacggagttttgctcttgttatccaggctggagtacaatggagcacaatcctggctcaccgcaagctccgcctcccgggttcaagtgattctcctgcctcagtctcctgagtagctggtaatacaggcatgtgccaccacagccggctgattttgtatttttagtagagacggggtttctccatgttggtcaggctggtctcgaactcctgacctcaggtgatccacctgcctcggcctcccaaagtgctgggattataggtgtgagccaccgtgcctggctgaagaatgttcatagttttaaacactgaaggtaactggctttgaaacaaatatttgtgctattctttcaggctctcgtctcaatttatttgaataatgtcctgagattattaggcaaacagtgaagctgttattatttgtttctatttatttgtgtgaatcagttcttaaaaattgattcttgtctacggccataccaccccaaacatgcccaatatcatctaaaaattgattctctgcaataaaacacaacatagaaataaaccagatgctggctgggcgtggtggctcacacctgtaattccagcactttgggaggctgaggcaggtggatcacctgaggtcaggaattcgagaccagcctggtcaacatggtgaaaccccatctctactaaaaatacaaaaattagctggtgtgatggcaggtgcctgtaatcccagctactcgggaggctgaggcaggagaacagcttgaactcaggaggtggaggttgcagtgagctgcgatcacaccactgtattccagcctgggcagcagaatgagagtccgtctcaaaaaaaaaaaaaaagaaaagaaatataaaagggttttttttttttaattaaatctactccgttcctgtttcactggttttatttcctatcttggccttataagcatccaggactccagcatcttttaaaaactcacagctctactaatggatgcttgtcctttagggtaagtagttaactgcctctggaaagccttccttgactgaaatacgagttcctattctgtgctgcagtagcaccctgttaacactacttattcaaacctgtattgtcatcttacttaacttgcccttctctccttactaattaaaaacagggactcttttttttttctttctgaaaccgagtctcactttgtcacccaggctggagtacagtggtacgatgttggttcactgcaaattctgccatccgggttcaagcgattctcatgactcaacctcccgagtagctgagactacaggcgcctgccaccacgcctgactaattttttatttatttatttttttgagacagagtcttgccctgtcgcccaggctggcgtgcagtggtgcaatctcagctcactgcaacccccgcctcccgggttcaagcgattctcctgcctcagcctcctgagtagctgggattacaggcgcacgccaccacaccctgctaatttttgtatttttagtagagacggggtttcatcatgttggtcaggctggtctcgaactcttgaccttgtaatctgcccacttctaccttccaaagtgctgggattacaggcgaaaacagggactattactcatctcagtatctgcagtgtctgaggcaaaacagatgtcagtaaatatggccgtgcgcagtggctcacacctgtaatcccagcactttgggaggctgaggcgggtggatcacctgaggtcaggagttcgagaccagcctgaccaacatggagaaaccctgtctctactaaaaaatacaaaattagcaggatgtagtggcacatacctgtaatcccagctactggggaggcggaggttgcagtgagccgagatctcaccattccactccagcctgggcaacaagagtgaaactccatctaaaaaaaaaaaaaatcagtaaatattaacttgaataaaaaattaaagatggcactagctgtaaactgtagcaggaaccatgccctgttcatttgtctattaagagggtttggttgagtttaatgtgtgatctaaggtaggatgctcagtataggttaattagatgatacagagttgccctgtgttttattttattaaatctcacattgtgatagtgtaaacaggaaaagagctttatggtttttttcctctctagggtcttgttttccttacctgtaaagtgaaggagttggataatatgatcttttaaagttctctccgttttcagcatcccactaggaggaacagccataatccctggatccaaactatatgaaatacagtctaagattgtattccatcacctccccatcctgggtttttttttatttaaagcagttccctttatcatactattgggttatattaaacctaagatcaattataaaatggccaaaccttgtacatgaattgttgttgtctcccttctagtcgctgctatgcccttggttttcttgaacttcagcataagacttataggtatcctagagccaggcatggtggttcacgcctgtaatcctagcactttgggaggtcaaggcatggggatcacttgaggtcaggaatttgagaccagcttggccaacatggtgaaaccccatctctaccaaaaaataaaaaaattagctgggtgtggtggtgtgcgcctgtaatcccagctacttgggaggctgaggtgggagaatcacttgaacccaggaggcagaggttgcagtgagccaagattgcacccctgcattccagcctgggcaacagagtgagactccatctcaggagaaaaaaaaaaaaaagacttacaggtattctagttaaattttgtcctgtgagatttggtgcaggcttctaaccttttgagatttctttgagctttaattcttccatttatggcaataactgtgtgtcctccatttgtgtcatctacaaactagttaagtgcataaaaggaactcagatatttgaataaatggtcatatatctaacatatctttgctcaaatagctaaagcattagaatgtttaatcaaggtagagtctttgtcttttccattcctttcctttttttaaaaaaaaaaaagagacgaggttttgctatgttgcccatcctgaacttgaatttcaagcctcctcccaccttagcctcccaagtagctgggactataggcaccctctaccatgcctggctctttttctttcctttgcattttttttttcttaaagatttgtatggtgtagtagaaaaaccacttaacttggaatcagaagatctaggctctaagctcttgctcttctgcttacatgttggactggtcacttacttcctctggtcttcaaatttctaggctgtttgagaagaaaaaagactaaggtctctaactttctgtgattctgattcagttcgatcatctggcctgttcttggaagtcatatggaattgtggttgagagcaggttgagagtctggagtcagattgcctatgtttttatcctagttctgccactactggctgagtgacattagtttatctgggcctctgttttcctcatctgcaaaatgggtttaattatgctgcttggttgttttgacttagttgttttcccctctctccctccctccctccctctctctttcccttctttccctccttccctccctccctcgctcccttttttgatggagtcttgctttgtcgcccaggctggagtgcagtggcataatctcagctcactgcaacctctgcctcctgggttcaagtgattctcctgcctcagcctcccgagtagctgggattacaggtgtctgccaccacacccagtttaatttttgtatttttagtagaagtggggttttaccatgttggccaggctgaacttgaactcctgacctcaagtgatccgtccatcttggcctctcagagttctgggattacatgcatgagccaccacgcccagccttgacttagttcttagaacacattctgcatgtggtaaggaatatgtgattatttaccatcattattagaattttttcacataagataacattgaagacatagtgctttcctgtgaactgttgggatgaaacagtaattgtccttattttttaattttttaaatttaaaaaaaatttcatatatagagaccgggtttctccatgttgcccatgctggtctcgaactcctggactcaagcaatcctccacgtcggcctcccaaagtgctgggattacaggcttgagccaccggcacccggcctgtctttatagttagtaattaagaaatgtgacatgccgggcatggtggctcacgcctgtaatcctgacattttgggaggctgaggtgggtggatcatgaggtcaggagctcaaaaccagcctggccaagatggtaaaaccctgtctctactaaaaatacaaaaattagccaggtgctgtggtgggcgcctgtaatcccagctacttgggaagtggaggcaggagaatcgcttgaacccgagaggcagaggttgcagcgagccgagatcaagccactgcactctagcctgggcaacagagcaagactctgtctcaaaaaaaagaaatgtgacagaacccaatacagaggtatataaaaagtaggtgatatattatgatcactgttttatacgttaagaaagatgtttgtgtcttttatatccttaatagtgggtgattttggcattttaggaaagacattaagtatataccttcaattttctttgtttctgtaagaaagccagtagctgtcaattctcagataacttctgaccacatgtggaaatactggcctgaacctcttccctccactcacccttttcaagatctgcaggtagcagccagacttaaactttttcctacctttaacaggaaatgacaaaagttgggaaaaaaagaaggggaatggctcggatgactctactggcccatctcctctggatagttaagagctgactgtcctaatcaaagtcctctcctccattgcagcagaacttgcctctttttgaggctcaggacctcttgggaacttgaagggaaggcctgtctcctgtaggtagactgaccttgtccccaagactctaccctacttttctcagtctgcagtgccgttaggagaaataggttctgcttgagtgccagggaatttaggagatggcagattttggttcactttcctccaacttcacccagtaattattattttgatttttagagactgtgaattcagtatttctagaagttgccacatgtgttcattttggatgtgtcctaaatctctggtcaaccagttaagtattttttattttttattttgagacatagtctcattctgtcgccccggctggagtgcagtggcgcaatctcggctcacagcaacctctgcctctggagttcaagtgattctcgtgcctcagcctcccaggtatctggaattacaggcatgtgccgccatgcccggctaatttttgtatttttttagtagaggtggggtttcgccatgttggccagggtggtctctaactccttacctcaagtgatctgcccaccttggcctcccaaaagtgctggcattataggcgtaagccactgtgcctggccgagttaaatgtttttatttgttacccttcccaagaatatttcaccttcttacatatacaactcctatgcctttgtttgtttattctggtttaggtccttctcagagacagcagggtataacagggagcacagctttggagctggacaaatggacatgtaatcttggtcaagttatttaaccttttaaagtcctagaatttttatctctaaaatggaaatgataatatctttcttggagaattgttgggattaaatgaaatgatatttaaagtttttagcacattaactgtgaactaacagttatagtaaatgttcagttaattttagcttaggttattgagtaccttctaaatgtgatagagatggggttatggagacaaaagagtccctacactcagataatttatttttttattttttatttttgagagagtctcgctctgtggcccaggctggagtgcagtggcacaatctcggctcactgcaacttctacctcccgggttcaagcagttctcctgcctcagcctctcaagtagctgggattacaggcatgtgccaccacgcccagctaattttttttgtattttagttagagtcggggttttaccgtgttggccccagggtggtctcgaactcctgagctcaggcagtttacccgccttggcctcctaaagtgctaggattacaggcgtgagccactgcactcagtctcactcagggaatttaaatctgataaaggaagaggttactagatatgagtcaggaaatgttcattcctttttttctctcttccctatttcttatgcattccttttcccagtacgaggcaaattctaggaggacccttcatctccaaggctaaaaagagtcttataagagggacaaactgagtacagttgtcacaggttatcagggtgactgagagcttagtctaggcgggataaagtcagctgtgagaacctttattagtaagcagtaacaggattattagcagtttgtaggtgggagggatacccacttgggagtgaagttgtcaagcaactgaggcaggtcatagggcttgtttaaactgaatggtctgctaggaaagcttgcatttactttttttcatttgtagtcgtttgggctaatctctggaaacttgctttcctaggtgctgcccctcctccctccctgccttcaggaacaggattgaaagcagcattagcctgaagaagtcgttctatttagggagctagagcagagggccagtgattaggcccttatctgcagcggggcctttttgagtggtgtggggcagggctgcagtgtctgtcctgacacccacagaggctggacttttctgtcccctggttgggttagaactgtgaagaaccaatagaagggctgggccagctgaatgaaaaagcccttcattgtgtttcttcaacattccagtgtctggtacaattagccaagactcggaaaacaagttggacaaacaagcaggcagccttctactgatggatgaaaggatttctggcacagctgagttaagtgcactgactgtaaagacagagtaggaggatctgggaagaagaaggggactttggaatgccattcctggctgtgaggggaaagaatggagcaacaagcaaacggtatttttgaagctgataaaatttgctgtgataatctacctgggaggctggctgaggcgaggctggctgaggtggggctactctgtaaagtaggtggaatcactggggagttactgactcttcccttttggcagctgtaagtgcggggaagggaaactttctttggaatctagggatctgttcacagtggacggtgagtgtatgagcttgctccattatagtctctcccatcatgagaccttctcatttggttaacactatatgtacttctgcctgagaagaggcacacctgaggagcaagttgttgggcaatggatgcactgttcctgacttggcagtaaaccacttagctcaccagctctcctgcaactaagattcaccacattacaagcttctgctctgcaaatggagggtaactcaaagaccagtttcttcctactcaggtttactcacttcataccttgactggacttttgcatatggagctctcccctctgtacgctctattggtctggaaacacagagttggtgctacttttgaacagcatgcagcatgctatatgcctgagacatggacccagtttttggaagtgccctagggaggagcttcctctctgacctcaagggaagaaggaggtcagtaggaagtggtgggtggagccacttctctgttctgctgtctcctctctacacctcacagccctttttgaggagctgcgaagggtgcacaggccagtagctggaggttctttggtaccccctccttttaggtggggtcagcagacacaggggcgccatgtggccgagttaccaagatgaacacgagttcaacgcccacctggtttgtcgcatgtgctgtatgggttagtatgtgaagttttttttttttttgcttgtccgggcctgaggatcccaaatagcccttgctctcattgactcataggaatgcatggacttcgaagccttgtggtgttacaacctttaggcttgttaaaatgtgcagtggaatagattggggtgccctacttcctggggaacttcttaagcttgcagtaactggcagttaagagcccaagctttgggtgtagaactttttttatagagactgaattcatgctcatgcttctgcctgtatcaggaaaccacttttaaggtatgttgcatagtgctgaaagtccagagtgtatttttagcagaagttggttggttacggagtccacctctgagcagactggcgggaggatggggggtgggagggaggagtcatggcctatgtttcctctttggggcttattgctagttcttttacactttactctgccagctgtgacagagagagaaaaagactcaaagatgatctggggtcagggacctaaataagagaggctaggggaagagtcatgttagctgtgacttagatctctcttgataaggcatcattaaataatgattatttaagtaatgtcctgtggccttgaacaagtgacttaacctttttggccgtaggtttccttggtttcaaaattgtagggtatacagactggtgctagactgagagacatcaattctctgtaaaatgaaaaaagataaagaaaatgtagtgtgtctttcataaagctaaacttaaagaattgtcttttattctgaaattgtctctcctactttctaatgttaaaatatcctttattttatgaaagaattgttattatatggtagtgtgtttttaagatatccctacttagcaaaatgaaaagtgacaacttctgttaggctttctgatttattgtggaacatgtatttgtctatgaaatcttagtttgggaaccactggtttggtaatctactatcttttgattttatactttgagtctctaacaaggagcaaaattgtgacccaaataggcagattttcattaaaattgaagtaactagttgtttgatgaagaggagaccttagaaaaatctcagagaaggagagcaacagaactagggttctgatcagtctcctgactcctaggctagtgcttgcaagtatttaggtgctttttgaggaaaaaaagctgccatagcaataatgcttggggcacagagggggcaattttagtggtctactttttttttttatctttcctgtatcattgagatttcttccctggaacctagaagaaagaattgcctatatctaaaagtgcttggagataaacgtatagcaaaagggcctttcctgtaaccaacaaagaagtataggaaagtctaaaatctttattgaaagtttcagggcaaaaacgtaatgtagccccatctcccccaatcccacataatcccctaaaggcactgtagactaatagctaagaaaatgggcttggcatcaactgtctacacggggttcctactccaccacttaacaacaaaaccaactggggacattgcttaacctttctctagctcggttacctcattttttatttttctttttttcatatcaccgtaaaataaaatcacttgtatagggagaatgaatgaagattagcagtggattttcatgttatatacttttcacattatattactactgtaactaccagctagcatttattaacttattatgtgtgagagactaggctaagtgctttcatatcatatactcctcacaatcacttcatgatttagggtctattttattttattttattttattttattttattttattttattttattttagagacggagtcttactctgttgctcaggctggagtgcagtggtatgatcttggctcactgcagcctccacctcaggggctcaaacgattctcctgcctcagccttccaagtagctggaattacaggcacgcatcaccacacctggctaatttttgtatttttggtagagatggggtttcgccatgttgccttggctggtcttgagttcctgacctcaagtgatccctctcaaaaaaataaaaataaataaaattactattcaaacctcattgcttaaaaaagggattaaaacagactctaaatcagccgggtgtggtggctcatgcctataatcgcagcactttgggaggccaaggagggcggatcagttgaggtcaagagttcaagaccagcctgagcaatatggtgaaaccccatctctaccaaaaatacaagttagcagggtgtggtggcgtgcgcctatagtcccagctactgggggtggggttgggggcgcggctgaggagggaagatcgcttgagcctgggaggcagagatttcagtgagccgggatccactccagcctgggtgatagagcaagaccctgtctcaaaaaaaaaaaaaaaaagaggtcggtcacagtggctcatgcctgtaatcccagcactttgggaggccgaggcgggcggatcacgaggtcaggagatcgagaccatcctggctgacacggtgaaaccctgtctgtactaaaaatacaaaaaattagctgggcatggtggcgggtgcttgtagtcctagctactcgggaggctgaggcaggagaatggcgtaaacccaggaggtggaggttgcagtgagccgagatcacaccagtgcactccagcctgggcgacagagcgagactccgtctcaaaaaaaaaaaaaaaaaaaaaagcttcccagatgattttgagatggctggtttacagactgatatttaggaactattggcctaactcctcattttatttgcagagttggagataaaaataaaattttaaaaataacaaaggacaaatgcctaattttatagatgaaactcaggctcaaagaagggaaatgaatgtcatgcaaaggtatgaaccatagactagacaccaggaaatccaagttatagacctagttctgcccctgtgtgaccttgtctaaattatttaatctctctgggccttggtttcttcatctttaagatgatttttgaggactcttaaaactctctctttgtatttatgaaatgcttcgtttttctgactgtgatattcccgtgaattctctaagaactattgagcttttcttcctcttgtgttcttatatgtgcctccctctcactgtggctctcttcttttgttaccgtgcttacccctggatttctttatcttacttctttcctttattctgtgattcttaatagtccaaagaattatcattataatattaggttttcctaagaaataaggtaaatttttgttttgttttgttttttgagacagagtcctgctttgctctgttgtccaggctggagtgcaatggggcgatctcggctcactgcaacctctgcttcccaggtccaagtgattctcctgcctcagcctcccaagtagctgggattacaggcgtgtgccaccacacctggctgatttttgtacttttagtggagacggggtttcaccatgttggccaggttggtctcgagctcctgacctcaagtgatccacccatctcagcctcccaaagtgctgggattacaggcatgagccatcacacccggcagaaataaggtagaattttaattttgcattgaagcttctacagttgtcacttccttaaaaccccaaatctcaatcctcattggtactttctcagcctacaccagtcattggtgataaatgcctttcatgaatccctattatagttagtacttttcctttaacttgattatataggactgcattgtattgtcttctaataaatttatggaggttaaaagtctatgatctgacagacttggatttgaatctcaattctgctgtatactgcgtgactttgggaagattactaacaagtctttctgagcatgaatttgctgaaccatgaataagcatacttgagagagttgtgaggattgtcaaatactaaatgagataagcctcaaacagcacctgatacataataaacacaataaatatcgagctccaccttatctcccaaagtagacttttgtagccttctgaggatagcaatcatttataatgtttgtgccattatacattattgctgaacacattttaattgcttgacctccaatttcaccaatttcctttgcgcttacattgggaacattaagtggttcaaaatccccaggatcaagatgtggcaaggagaatttaggaaagctgaatctgtagagggaatatctgagtgggagtacctgctccctgctgaaaagcagtctttttttgagatggagtctcactctgtcacccaggctggattgcagtggtgccatctcagctcactgcaacctctgccgcccgggtccaagcagttttcctgcctcagcctcccgagtagctgggattacaggcttgtgccaccactcccagctcatttttgtatttttagtagagacggggttttgccatgttggccaggctagtctcgaactcctgacctcaggtgatctgcccacctcagcctcccaaagtgctgggatggcaggcgtgagagccacagtgcctggcctgaaaataccatcttaatgtgtcttgtagctataaccttgacacctagaggactgtgattatatatttgttaaatgaatatttttcaatacctatggttgtcctaaatgttggatatttaatgaaaaaaaaatttttttttgagatggagtcttgctctattgcccaggctggagtgcagtggcacaatctcagctcgcaacctctgcctcccaggttcaagccattttcctacctcagcctcctgagtagctgggattacaggagcgcaccaccttgcctggctaatttttgtatttttagtagagatggggtttcaccatattggccaggctggtctcgaactcctgacctcaagtgatctgcccacctcagcctcccaaaatgctgggattacaggtgtgagccactgcttctggcctttaatgaatttttttttttttttttttaagacagaatcttactctgccacccaggcgggagtgcagtggcgcaatctcagctcactgcagcctctgcctcccgagttcaagcgattctcctgcgtcagcctcccgagtagctgggattacatgcgtgcaccaccacacctggctaatttttgtctttttttgggtagagtcgaggttccccatattggccaggctggtcttgaactccggacctcaagtgatccacccacctcggcctcccaaagttctgggattacaggtgtgagccactgcccctggctggcctttaatgaagtttaaagcatggatcttgacttgaaagagctcaattcagatacagaaatggacttagatacagagctttctaatgataggttttatatgcttagtgctaagtaaattgaagaaactttaaagtgccataggcatccaaaggtggctgacatgtccggaaaggtgtaacagaagcaagacttcagctggactttgaaaggaggttctaagttagacaagccccaagagaagagggtagatattccagttgggggaaaggttgctcctagtagagtaggacagatgcgaaaggtatgtttggaaacagtaagaagatcggaatggttgcagttgagtcatgcaggggagagtgaaaggtagatagattgtaaatttcttcaggtcagagaccagttctttatcttcttgaaccaccgaaaacgtagtgaataaaaactgcaattgaattttatagggttgtagagagctttgaattctaaaactaaagtgatcaaatccgtaaaggattttgaatagagagagaggtgatgtgggctaagtggtgattaggaagatttgtcgaaataggctgtttgctctctatttgccacagctatcaatttttaactccaattccttatcttcagttctgactgctcttctgaactctagaccaaagattccaactgtctgtgagaagatcctcctaacacctcactctttgtcttctcctttacccaatgtaccctcaccaaatcggtaacctctttctgttttcattatcttgaagttctactctcctcccagttgctgtggctagaagcatgagaattgtcttgaactctgccattccttacccgccaccacatctaaaggctatttaaaaggctatttaaaatagctaaaggctattgtttctacctctacattgcatgacaacgtagaggtacctgccctcttctttactttcctgctgcctctgccctaattcatgctatttcaagatgtttctcctggtctgtcactggagacttctaactggttcttctgcctcttagtgtctttctggtataatgtggccttcagtccaaagccagattagtcttcccaaaacatactgtgggtcagaaaatttcagtggttctgctttgtctacttaattaagtacgtactccttactctagctttctgggtcctttgtgatgtcagctagctgttctgttagcctggttgctcatcacactgctaactgcatggtatggtcatgcatgtaatagccatactgttccctaaaacacatcctgtatacttacatgtctccaaatcactacttgtgctttgtaaattaaaaaaaaaaaatttctttttgagacagggtcttgctgtcacccaggctggagggcagtgacacaatcttggctcactgcaacctctgcctcctgggctcaagtgaccctcccacctcagccacccaagtagctgggaccacaggcgcaagccaccatgcctggcttatttttgtattttttgtagagacagagttttgtcatattgcccaggctggtcttgaactcctgagctcaagtgatccacacaccttaacctctgaaagtgcagggattataggcatgagccaccatgcccagcctacttgtgctttttttaagtttggaatcctttgactcctttttgggctgccagaatcctactcgttatccaaggtttagttcagacaccgttcacttcgtagccttttgtctaagatcaggtatagttctatcacgccttccatgaacacctcctacctctctgtgaggattaatcaactctatgcttgtgctatagtgtcattttgtgcagcttgtgtctggtgtgttatttgcttggtgttattgttaattatttacatgttgttctccaccactagattgtaaacttcatgcggtcacaaaacaggactattccaactctacttcccttctgtgtcagctgtggtatatcctttttagatttccaggtggttggtgtttctgggcttcttgaagcacttgtcatttttctgtggcctttggaaacaggagaggctcttctctcacttgttttttgaatggttcgtaatgtactgggactatgtgggtaggctatgttggatcagaacatagaattttgcccctcaaatgcaggctttcatttgacgtcaggcctactctcaaatttctcctagtagagtaggacagataaacaagtaaacagtgataccatgcaataagcacacaaactagtgtgtgtaagagatgggaaaagctcctggaggaggggatagttgagttgaaggctgaagaatgagtagtcagagaaggggagagctatattcacagagtatgtgcaaaggcatggaactgagagaaaacctgccccatttgcaggaaattttttaaacaaggctggaagtttttatggaaaggtagagggatgagtggaaggtaggcattccatcataatggatcttagctcccaagctaaaaagtttgactgttatcccaaatggaagcatcaggctttggaactgggtagagctgggttcaagtttgacttcatgacttaccttgtgatcttgggcaagctgcttcatctgtctggactttatttttctggctaacttacagagttgttgagcattagaaagaatagatacaaggtgcttagcacctaagtaggtgctgaataaatgctatttaattttttttttttttttaagacagaatctcactgtcatctaggcaggaggagttcagtggtgccatcttggctcactgtgacctccgcctcctgggttcaagtgatcctcgtgccttggccaaccaagtagctggtattttacaggtgcctgccaccacgtctggctaatttttgtatttttagtagagacaggggttcaccaagtaggccgggctggttttgaactcctgacctccagtgatctgcccgcttctgcctcccaaagtgctgggattacaggtgggagccactgcacccagcctaaatgtcaactattaataatattgggagaataagggctcactgaaggattttaagttacaagattaaccttgccagaaaggttgctgacaccattgagaaggatggattacagcagggatatctgtcagaagcaaggagaaaagaagagttcagttttagacaagttgagtttgagatgagcatggaagttttaggaggccattggatatatgagagtggtaaaggcctgagctaaagatacagatttggaaattatcattgtataggtcacagctgaaactatggatgttcattaaatcattaagggagaatgtaaagaacagctatttttaatttttattgaaaagctatggacatccccctactcccccccatacacacatgacacaaaacattttgcatgtaattttaggtggttcctgaacactccctctccaaaacccattagtggactcttgggtccttggacatctgaagaagctataatacagaatgaaaagaaaagagggctaaggatgagtaatgtttaagggatgaacagaagagaagaaacaaccaaagaagaaggcagaaaactagggtagaatggaatctcagattcaagagagagagtcaatttaaaaggtgaaggaatgatcaccagtgtcttctgctacagagagtttaagtgagatagaactcaaaactatccattgggttggcaattaggtgactgtggggagagcaatttcagtgaatttgtggggctggaatccaggtcacatagaataaataggaggtggggaagtgaagtctgagtgttgtcatcatacttgttcagaagccaacaggagagaaccaggagagagagagagcagttgaagatatacagactagggagtattgttggattaagtttcctatggagaagagcagcaaagagatccagattttaggtagaaggactgacttagattctgaaaagggacaactctggcaatgaaactaaaataaaattaggataggtattgatagcatgatgctcagagacccttgttgacgaagatcagtaaagttggaaacaagtattaaatccttctaattaggccggatacagtggctcatgtctgtaatcccagcgttttgggaggctgaggtgggaggatcacatgaggccaggagtttgagatcagcctggacaacatactgacaccctgtctctacaaaaagtttaaaaatagccacacatgatggcatgcacctgcagtcctagatacttgggaggctgaagcaggaggattgcttgagcctaggggttcaagattatagtgaactatgatcatgctgctgcattccagcctgggaaacagaatgagaccctgtctcaaaacaacaacaaatagcaaatttttcttttttcttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacagggtttcaccttgttagccaggatggtctcgatctcctgacctcatgatccacccgcctcggcctcccaaagtgctgggattacaggcgtgagccaccacgcccggccatagcaaatttttctaatttaagccttctaattcagtaacccccaagtaattaataaggtttaaagtgttaaatctgaaacttagatggacagtagggttctctgcttctgtagagatgctggtggtggggagtgggctctctcttgtttgtttatagcctttggtggggctgagattataaagaacattaaaatgaatattgccttttctttgcccgttttcctctcacataagggtactttctgagacttttacctcagttttatctttctgcctaaccttcaatgttagtcagaaagatctttgctaggcctgggttaaactagggatttatgtgcaaggagccaatataaaacttattaaatagtttgagagtctgagctattattctgaaggtcagcataattcttaaggttgcttcttggatttccttgctaaaaattaagatattaaactccaggcactgtaatattcttttatcctgaagtttaaaccaggaaagaactttcatgtaattgatgggcataccaacataggatcctaaaaaatgatcttccagctcttaggggcaaaggaattctataaaacccttttctgaggagcttatggctcagctctaagcaggctagctagtcttgggaagggcttgtaatcatgttgcctttaatgattatattcacaataagtacttaaacgtctttctcctgagcttaaagtcagctttttagcttttggaagcatgattggtatgaggccatcaggtttccttagtacattaccgttatggaagggcttggtagatgaacagaataatttatggatagtattttttttttttttttgagatggagtcttgcgctgttgcccgagctggaatgcagtggcacgatctcagctcactgcaacctccgcctcccaggttgaagcagttctcctgcgtcagccttccgagtagctgggattacaggcgtgtgccaccacgcccagctaatttttgtatttttagtagagacggggttttactatgttggtcaggctggtctcgaacgcctgacctcgtgatccacccgcctcagcctcccaaagtgctgggattacaggtgtgagccaccgcgcctggcctatggatagtaaaattaaaaagaatcatgctactcacatattcaggtctaaatgaaatgaggcagtggactaaaaggaaaccgaatgaattccacctcctttaaatacttactagtttaaaagaaaatctgttaactttttcctttttcatctgtgtgttgtttgacctattacagcaaacatacatagcttttataaaaaaaagaaattataaaaaaaagaaaaaacacttctatctttagagtgagaatttttaaaattagaatcagactgtttttggctatgaaggtaatgaatatagtgaagcacagtgggcctgatatcgtgtgaaaatgtaatggacacaactttagttagctctgatttttccaccctgccttcttatctcagcacacaagtgatactggcgtgttgtgattttgttttttcaggcagggtctcagtctgttgtccctgctagagtgcagtggcacaatgatagcttgctgcagcctcaaactcccaggctcaagtgatccttctgcctcggcctcccaaagtgctaggattacaggcataagccaccttgcctggcatggttttgaggtttttagatattgaactggattcttgtaggtaactcagttctgatttcattttgtgtgtttcttttaccaatcttctaatcatacttggccaattgagaacgctctccggtggttttatgttttagttcttactatgtagaactttaggtgttgcaagttgtgggaaatacaaaaaagtaaatcatgttctcttcaaggagttaatgatctccctggtaatataagaataagcatattaaaagttcagaacactatataattatataagtgctgattgagtgattagcccagtaagtaacatagatatttggaggacacagagactgttgagaactggagttgtcagaaaaggcagccaaaatttttcttaaacacaaatctgagcatgtcattctccaatttaaaatctttcaatgcttccccttacctataggataaagttcgggttccttaagcttgtcatgaaaggtcttgatttggcccataccatcctatctcgccactacctagttgtctttcagctattcctaattatgtgcagttctttgaacataagctttttcttgtctccatgaatttgcattagctataactttatgtagcaactttattccttcccttctctttctggcttatactcatcttttaaggttagatagagtcactcctccttgaaacttcattaagtcccccatatttcctgtccctacccaggtaggcttaacctcttatgttcatgagcactctgtgcttacctgttatagcacttaatcaacctgttttgaagttgtttctcttatttaaagaataaatgaggccaggtgcctgtaatcccagcattttgggaggccaacgcgggtggatcacctgaggtcaggagtttgagaacagcctggcccatatggtgaaaccctgtctctactaaaaataaaaaattagccggacgtggtgggtgggcacctgtaatcgcagctactctggaggctgaggcaggagaatcgctggaacccagggggcagagttgcactgagccgagatcgcaccattgcactccagcctgggtgacaaaagcgaaactctgtctcaaaaacagacaaaaaaagggaatgaacgaggtggattttaaagaataaataccatttggagagatgaagaggaagagaagtagccagtcatgaagggaaaataagtagtatgagcaaagagtcagtgatttcgatgagactatagttggaagctgattctgattcagtctgcagatgacacgggcttggaaaggttgatgaagatgttggataactgaatcagcatctaaaaagatcaaaatatgttggaatgacagtgatcaaatctaatgagaatcctggctttagatactttcaagactccattaagtgaaagatggattaaacttttaagtctaataataatacttttttatttttttgagatggagtcttgccctcttgccaggctggagtgcaatggcacgatctcagctcactgcaacctccgcctcctgggttcaagcgattctcctgcctcagcctcccgagtagctgggattgcaggcatgcgccaccatgtccagctaatttttgtatttttagtagagacggggtttcaccatgttggtcaggctggtcttgaactccccacttcagctgatctgcccacctcagcctcccaaagtgctgggattacaggcgtgagccaccacacccagcctaataataatacttctaacagtcccaaatgagagtcaataggcagaagttacaaggaaagcagattatgacattttatagaattattacattggtactttgtcttatgaattagtgaattctctattatcctaaattttaaacatcaagaatattgtagatttatgggagatttggagagacctttcaatgtgaacttatgattctttgttgttgaagggatttgtgtgtcagcagagaattagactatataatttctaaggtccataccttagtgctgtagtttatagtaggaagaaaattgttccttgcaaagcaagaaaggattcaaggccgaaaagaaggatgtgaggataaaaccagagaccaagataagaaagtacttattgaatggctataaactcaaaaaaaataaatagataaatatattcacctgggatgtagaacaagcattgacattgtttggaatggcagtatgttggcttttcctaggggatcaataagaagaaaataactgggcttggggagagaacctggctgaagcttgtatgaattactagtgaaccagatttatatacctctgcaactttcttccgaaatgttctctgtcttggaaaagatatggaagagtcaagcagcgggcagttatggtaatttaggtttgcagattgtcatggtgaatgtagtagtaggcagttaggcagggggagttcctggggtattagtgagggcagctttgaattgcataaccatgttgtctagcatggactgggataatcttagatgttctttttctttttatgagattgtgtcttactctgtcacccaggctggagtgcagtggtgtaatcacggctcactgcaacgtccacctcccaggttcaagtgatcctcccaccctcccacctcagcctcttgagtagctaggactacaggtgcacaccaccacctggccaatttttgtatttttagcagaggtggggttttaccatgttggccaggctggtctccaactcttgagctcaagtgatccaccggcctcagcctcccaaactgctgggattacaaggcatgagccactgcaatatgtgtgtcccaaatgccaaggcctggctgtagatgtccttaatgaatagggtaaaataagaatggagtgattgaaggttgagaatgattaggagagggtatgagagactgataatggtaagtgctaaataggtatgtttggggaaggaataaggcccaaaatgtggcagtgtggtggctggacatgaattggagatgagtgccagtggagccaagtaggcacagatgcattgtcacatatatcttcacgtatatgtagagatgataaatgaaccaagtcatcggggaaggctaaggtagatttgccatgtggaaggggataggccacggagcatggtcaatgacagtgaggatgatttgaacaagaggttatatgggatggtgtgggctttcagaaatagaaaaggaccaggactgatggctcactggtctagaaatggctctggggaattggcaggagtcggagaaagtaagtcctttacaggataaggcctctgtggagcagtcattgtcaagcattgacagtcatgtttttgttaaagaggtaaaaaaaaaaaaacctggagaaaaaaggagtttgctgctgtgacaggagaaggtagagagggaagagatgtgcagtgggggtaagctgggcagctttgagagtttgattgttttgataatggctggtaaagaaattggaatgaaggaattcctggggtaggagagggagggagttgggcattcctcaggcagatcagcacatgaagagtgaaatttaaccactgcaatatgtgtgtcccaaatgccaaggccaccctgtctgttggtggtatcacggctttggctttttgaagcttgttgtgagggaagtggggaatcagtctgctccctgctctgctcaaattattgtgctaaggagactttgccatggtatgatttttgaggcacgtggtgattctgtctgatttgtaaactgacaacgtgatcagggccaaagaggaagttcagctaggccaaaccttcctaagaagaagtcactgtcccacagttatgtgggtaagttgttctagagaaacagagatgtgggcagggcagcagcgtgggaacctgttacctgggtagcactaagccagtgccttctctgtgtttcctttacagatgaacgggaccgggttcagaagaaaacgttcaccaagtgggtcaacaagcacttaatgaaggtaggaccctttcatatatatgctgccccagcacctctcactgctctcatctggatctgtcattccttctttcagatggtttagattgcttgctgtgtgctcaagtctatgaagatacacatgtgacttttcttttctcttcttttcttttttaatagagaaggggtcttgccatgttgctcaggctgttctcaaactcctgggctcaagcaatcctactgcctcagcctccaaagtgctgggattacaggcatgagccaccatgcccagctttttgaaaactaatatagtcataatggcatggaaacttgtattaatctgcttcttggtgaagacattattacctaccattacatcaggaggcagaggctgaagataccatgggatgattttaaaaattcgaagaacagtttattcctagctttatacattgctttataagcctgtttctttttttttttaatttattaatttattttaaaatagacacagggtctcactatgttgcccactctggtatcaaactcctgggctaaagcgatcctcctacctctgcctcccaaagtgttaggattacaggcgtgagccactacacccagtgtatttttattttttaatctgaatactatggaaggatgatagagggggattttctctctttctcttaaagtgcatgaatcttaaatgtttaacttgatgaatttttacatgaattttaccaccaggtagtctaaaatacagaatatttccagaatggttagggctgaatgaagattattattatcattattattattttaaatagaggagaaaccataacagaggcatgttaagactcacctaaagataataataataattgttatatattagatatataaaatataataataatatattattatggtattattattttaaataaaagagaaaccaaaacagaggcatgttaagactcacctaaagataaacagtatgactactgtggcagttagaatctgaaaacaaagtttttgaattataataataattagtgcttctctgggaaagggaaaggtcaccagtgatcccttaattgccctatccagtagcctagttttatcttcctcttatttgatttctctgtagcatttgatactgtcgtctactccttaaaaccctctcttacaatgacttctagaacattgctttttcctgaattacctctttcctctatgaatgcctttttttctgcctgtttcactggcttttcttcctctgtctgactcttccatgatggtgttccccaggatcctaaccttggccattttttggttttgttctctgtattctttttgggcagtctcatccattgtagctgctgggattgttttgttgcatgggatgcaaagaaacataagtagaaatggatatgggatgatctcacagaatctgatgtctagatgcagctgggctttatgaaaactaaacagttatcagaaaactactctcatactctctttgttttttttttttttttttttttgtttgtttgtttctttgtttgtttgtttttttgagacagagtcttaccctgttgcccaggctggagtacattgggaagatcacagctcactgcagccctaacctcctgggcttgagtgattctcccacctcatcctcctgagtagctggaactacaggcatgcactaccacacccggctaatttttaaatttttttgtagagatgggttctcactgtgctgcccaggtctttcttgtttttgttgttgttgttgttgttgttgtgttttgttttttgttttttgagatggagtttcactcttgttgcccaggctggagtgcagtggcacgatctcggctcactgcaacctccgcctcctgggttcaagcaatactcctgcctcagcctcccgagtagctgggattacaggcatgcaccaccacgcccggctaattttgtacttttagtagagatggggtttctccacgttagtcaggctggtctcgaactcccaacctcaggtgatccacccacctaagtctcccaaagtgctgggattataggcgtgagccactgtgcctggccaacccaggtctttcttgtttatggggccttgtgttctttcattttacttctgtgtgcctcctatattcatttctctgcttttcgtttattgctacgagtgagccatggcggctgtgcctcaaacagtgacgtaaacccctgaggccacatgattctggatgcacaaacacagaaagtctgatgggcttaggtcttcttttcctccatgggccaattgtccatctatagttcagtaaaccgtgggtaaggaggtggttacataaatcacacatgtcttcttagggccacttgtttagtgggtactgcaggtgagcatgattttaacactgcaagatctggataaggaggcagtgatagagccttttcttggattcttgcctaagccaaaggcaagtgtcatggtgtattttacacattcatctgtatgttacctagccatagcttttttttttttttttttttttatttattttttattgataattcttgggtgtttctcacagagggggatttggcagggtcataggacaatagtggagggaaggtcagcagatacacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaatcttttccccacctctccctcctttctattccacaaagccgccattgtcatcctggcccgttctcaatgagctgttgggcacacctcccagacggggtggtggccgggcagaggggctcctcacttcccagtaggggcggccgggcagaggcgcccctcaccttccgggcggggcggctggccgggcagggggctgacccccccacctccctcccggacggggcggctggcctggcagaggagctcctcacttctcagtaggggcagccgggcagaggcgcccctcacctcccggacggggcggctggcctggcggggggctgacccccccacctccctcccggacggggcggctggcctggcggggggctgaccgccccacctccctcccggacggggcggctggccgggcggggggctgacccccccacctccctcccagacggggtggctgtcgggcggagacgctcctcacttcccagatggggcggctgccgggcggaggggctcctcacttctcagacggggcggttgccaggcagagggtctcctcacttctcagacggggcggccgggcagagatgctcctcacctcccagacggggtcgcggctgggcagaggtgctcctcacatcccagacggggcggcggggcagaggcgctccccacatctcagacgataggcggccgggcagagacgctcctcacttcctagatgtgatggcggcagggaagaggtgctcctcacttcctaggtgggatggcggccgggcggagacgctcctcactttccagactgggcagccaggcagaggggctcctcacatcccagatgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcaccttgggaggccgaggctggtggatcacttgcggttaggggctggagactggcctggccaacagagcgaaaccccgtctccaccaaaaccagtcaggcgtggtggcgcgagcctgcaatcgcaggcactcggcaggctgagtcaggagaatcaggcagggaggttgcagtgctagccatagcttttatttaacacaccctaaattgttaagtattttcactcatgtagccagttgttcaagttaggaacctatttgattcagtactgcctataatctctcccttgttaccaagtccagttaatcacttgtagctcagaaagattgcatgcatctgtcttctcttctccatctccatatcgctgcttttgttcagggcctctgtgtctgttgccttgaccattataatagtttcctaataaagttttctataataacaatggtagtaatagtatcttgaagacttcctgtaaatcagacgtattctctctctgtgtgtgtgacagggtttactctgttgccaggctagagtgcggtggtacaatcatagctcactacagcctccaactcccgggctcaagtgatcctcccaccacagcctcccaaatagctaggtttataggcacatgccactgtgcctggctaatttttgtgtgtgtgtttgtagagatggggtcttggtatgttgcccaggcttgtcttctactcctgacctcaagtagtcctcccaccttggcctcccagtgtcttggaattacaggcatgagccaccatgcctagtctaaatcagacattctgtatactaagtcctttacatggattatttcatttaatccttcagtgatcttatgctgtgggttctgttaatatccccattttataaattacttagagagggtaagtaatttgttcaagatcatgctgctagaaaaaggcagaactgaaattttaaaattcaggcaacctaaagtctagaaaccgtgctcttaacccatgcagaactggctctggttgctgcctacctttccaggctcatagcaccaagtttccctcataccttgagttcttgctgaactatgtgccatgctattttatgactctgtatctttgttcattctgctccctgtgcttggaatatctttcccaagtttgttctgcctggataacacaaacttaacacctcttcagtaagtattttcctgacttctctgatgtggaactgactagcctttctttgtgcccctgactatactccttatgtgcttttgttaaagcatccagagtgtttatatacatggtgtatctttcagctatattatcactggagggcaaatattgtgtcttattgtttatagtgttaggacaaagaagaaagagagagaagtaaggagaaaagaaattgtaatttccttttttttctttttggagatggagtcttgctttgttgcccggctggagtgcagtggcgcaatctcagctcactgcaacctctgcctcctgggttcaagcgactctcctgcctcagcctcctgagtagctggaactacaagcatgtgccaccaaagcctggctaatttttgtatttttagtagagacagggttataccatattggccaggctgctctcctgggcttgtgatctgcctgcctcggccttccaaagtgatgagattacaggcatgagccaccgcgtccagccgtgatttccttttgtaaatttcttccatggctactagttgcctctagagtttgatgtcacctaactctttcctgatgtagagcactttgcagcgtttccaacccacctgtctagcttcatttctaagcactctgttttttgtagcttgcgctatagccacatgagacaactcactgccccctaaacactgtgtactttcacacctccttgcttatttatttctctccctagaatgcacgtcccagcctcctctgcctgaccatcacccacttcaccttctaggcccagctccagtatcaccttcctgagattctgacctctgttcctcagattaaatcaattgcaactccatctgtatttcatactgccttgaagagatgcctgtgtgttcactcatcgatgttctctgttacagtactcattgaggactgggattgtattatgctactttctctgttaagtgctgcacatagcacatgagaagtatccaataagtacttgttaccttgagtaactaatatttcaatagtgttatagcgtatgaagcacattcttatctgtcttaatccttaaaataaccctgaagtaagtaaaggtgttttatccccttaattttaacagctagggaaaatgagaattagaggagtgaagtgactttgccaaaacgatacagctagtgagggatggagctaaggatcaatcaatcatgaatcttctgatcaaaattacttgttcttcctgctaactatgcccccagctgattctttttttttttttagacaatactgatattaattaaacgtaaggtaaactccaggcatccgtcatctttcagcctaaaaattagcaaaaactgttgaaacaaggcagttttttccccattatttcttacgttgtggctccagttacaaaaaaattttaatgaaaacgttaaacataaaaatagaagtttgagattttaaaaaagtatataaaaagccccacaaaacttgtcaatgttgttccttattctacaaaatagcaccagtaagaagagtaaaaggtgttaaaaaccattacgacagcatttctgaaatacagcttgtctcaactcccgttctccctaaaaacgacttctcatggaataaaaaaggatttaaaaattgccagagggagcaccgagctttgactgcagttttccctgtcatctcttagatgaagggaaggtgtgagaaatgtgcgtctgtccctgactgctgtcaccgcttctgagtttagtaaaaagatgagaaatgaaggtagcagacttctcatctggggacctgtgcctgtggagggtaggtctcttggagagggaatgggtttgaggggttgtcttatctaagctccttccttcacacttgtctcctagggaagagggagatacagaggagccaaatatatgacagcttatattatagaacttagcacaccccttcctgagctccccagagggttctattgcagtcactgggagggatttagctaagagtggcccctgcccttgggtttggcccctagctgattgtttcatactttgtctctaaccgttggaggaactgaatcaatcctaccttgagcttgtcccctgaactttgtagttgaattccagtgctctggctccttgctgcctgtttgtagctgatgctgcctgttggacctctgcctcagtgctgtgtgatgacaggaagctcagggagggagaagctagaggaacacatcatagcattgttagaaattggaggccagccaaagcttttcttaaatccttggtgatttttcatctcttcccaggcccccagccttacagtttcaataacatttgctcatcttgggatatttcagagagagattcactgctaatcagagttattgctctaaattggaattatttgattttgggctgagaattagggattgagatttttttttgcgactcaagcatcctttgctttgctccccaagtacaccccagattaatgccatctttggcaggtagaccaacgtaaggacaaaaccaaccaggtggctaggcatggtggttcatgcctgtaatcccagcactctgggagaccgagggggtggatcacttgaggtcaggagttcgagaccagccaggccaacatggtgaaaccccatctctactaaaaatacaaaaattagctgggagtggtggctggcgcctataatcccagctatttgggaggctgaggcaggagaatcgcttgaacacgggagatggaggttgcagtgagctgagatcgtgccaccgcactccagcgtgggtgacagagcgagactctgtctcaaaaaaacaaacaaacaaacaaacaaacaaacaaaaaacaccacaaaccaggtctcccaacttctagatttagttgatcttggaatctcttggattccctgataaccttttgggaaacagcttactttgggataagcaaattaattcctccttattgagaacacttctgatccaatcttaaaagagatttgttaaggatataagcatctgaaataaacaacctaatttagaatgtaaacatacatatgtaagggttctgcttatataccagaaccatcaaaaagagaaatctaggtttctaaatgaggtcttatttaaattatctatgccatatctctgggtgctgttagctgataaagtgtatccccctaaagagaacatgaaagtatgaactccttaggagggagaaaaatgctttttctggtcagttcctgttgacttcacaggttagtagttagaaaggaaaagcccagtatttaatctagcagatagagcagttctttccatttttgtatatgcaatctagaagcccctggctttcctggaattttagataaaatttccatatataccagcaaaagttttcaaatttttaataatgcttacaaccaacccttccttccttccttccgtccgtccgtctttctgtctttctgttttaagagacaagttatccctatgttccctaggctggtctcaaactcctgtgctcaaggaatctttggccttcccgagtgctaggattacaggcatgagccaccacacctggcccacttacactttctctatttctgtttgagactctctagttgaatatggggtagcactgattccaggtattctgtcctatacagcctctgttttggccacatgagtcaattcactggctccctaatcactgggtggaacttcatactttttgcgtattcatgtctatgggaaataccagaatgagacgggcagtggagtttaatttaagaaattgacaaagtagtgctggttagatgctaaggaaaggagtgttacctttgttgcctacatgtgactatatggtagtggtttgtggctgtctttgcctggacctgattttttagggcttaatttcactctaaatgcttctcaggtctacatatgggcctatatttggacttgggctttactctggattttctattccctgtgcttaagtgcctgcctatcaaagtaaagctacattttgtggattttatttttttaagatggagtttcactcttgttgcccaggctggcatgcaatggtgcgatcttggctcactgcagcctccgccacccgggttcaagcgattctcctgcctcagcctcccgagtagctgggattacaggcatgtgccaccacgcctggctaattttgtatttttagtagagaacagggtttcttcatgttggtcaggctggtctcgaacttctgatctcaggtgatctgcccatcttggcctcctaaagtgctgggattacaggcgtgagccactgcacccagcctgtggattttagaatcatccacattcttagagaatctgttaatccgggttgaccggtaccactgttaaatttctcacaatttagggaattctcaaaacagagatatgataaaattcttatatgcaaagaacctcacactttgttcccctcccacccccgctctccaacagggattcccagctgctacttttattccctgcatttaagcatagttctttccagagtaaagaagtctaggacaactataatctgtttttttttttttttttagtgttgggcttttccttgaagacaaatttggccaatgaatcaatatcggtttctgtttttacaatttggagatctgccattcagaaatctatctgaaattactaggctcactttccctttccctgtatcttttaataagtgtaggagagagtaaataacattacttttctctttaaaactttctcctctgccctatatattgctcttcaacatagtttgagtcaaggaaattgggctgcttacgtttccttttaattgtttagaggaaagatttctagatcaagttttcggcaggtgtcaatactacgaggccaggcatggtggctcacgccagtaatgtcagcactttgggaggccaaggtgggtgaatcacttgaggtcaggcgttcgggaccagccttaccaacatggtgaaaccccgtctctactaaaaatacaaaaattagccgggtgtggtgatgcatgcctgtaataccaactacttgggaggctgaggcaggagaatcgcttgaaccctggaggcagaggttgtagtgagctgagatcacaccactgcattccggcctgggtgacagagcgagactccatctcaaaaaaaaaaaaaaaaaaaaaaagagtactacgtgacaatccttgctcttttttgtgtatgtatggcggggaggggggactcttattatttaaaattgataatctgtcattttgaccctccaagcatcatagaagccttgttaagagagtcaggagacaatgatctggacccagctctgatactttccagctaagtgatcttatacaagttatttagcttctctaggcaatggttttctcatctgtaaactgagggtattagaattaagtaatctttaaagtccctttgggctaagattaggattccaagcacgtaagtgtaacttactccttttgttaaagccactgagaaattgagggaagctgtttattttttcatagctttaagctaatctttaaaaaatggaggccgggtgcagtgctcacgcctgtaatcccagcactttgggaggctgaggcgggtggatcacttgagaccaggagttcaagaccagcctggccaacatggcgaaaccttgtctctattaaaaatacaaaaaaattagctgggcgtagcagcgcatgcctgtagtcccagctactcgggaggctgaggcaggagaatcacttgaatccaggaggcggatactgtaatgagccgagatagcaccactgcacgccagcctgagcaacagagtgagactctgcctcaaaaaaaaaaaaaaagcagacagcagacccctccttgacttattaatgcttgggcactggggaggattggacttggtctctcaaaatctaattattcactaattttaagaaatcactatatggctgggtgtgatggatcaagcctgtaatcccagcacttcaggagggtgaggctggtggcttgaggccaggagttcgagactagcttgggcaacatggcaaaaccccatctctacaaagaatagaaaaaactagccaagcatggttgtatgcgccttgggagactgaggtgagaggatcacctgagcccaggaagtcgaggctatagtgagctgtgatcgcgccactgcactctagcctgggtgatggaagtgagaccctatctccaaaaaaaaaaaaaaaaaaaaactttatggccagcacagtggcccacacctgtaatcccaacactttgggaggctgaggtgagatgatctcttgaggccaggagtttgagaccagcctgggtaacatactgagacaccatcttgcccccgcaacccctgtctctatgaacattcatttacaagtttttgtctggacgtatgttttcagttctctttaattacatacctaggggcagaactgctgggtcgtatggtaacttgtgtttaacctgttagtaaccatcacattattttcgaaagcaactgcaccattttacatcctcaccagcagtgtatgagggttctagattctctgcttttttgctaacacttatctgtcttttataatatagacatcctagacagcgctaatcactgcggttttgatttatgttttccttatggctaatgatgttgagcatcttttcatgtgtttattagccatttatatatcttctctggacacatttactaattttgacaatgattttctcagggagtgcaaacaggcaaggccctgaattgcagttttttactcatttgttgacagaatggtataattatttgttagaaagaagcatccttattgatgattcctgaacagtcttgcttcagttggctgcttctaaaactttttctttttttgagacaggatctcactctgttgtccaggctggagtgcagtggtgtgataatagctccctgcagcttcagtcggctgggctcaagcaaccctcccacctcagactcctgagtagctgggattgtaggcatgcaccaccacacctggctgacttttaaaattttttgtagagatggagtctcactgtgttgccctgactggtctcaaactcctgggctcaagtaatcttcctgtcttggcctcccaaagtgctgcaataacatgcttgagccaccgcacctggccttctaaattttgatgcttagtccactggtcattttcctaagagatttgtggaaaacttcacaggcaaactagtatgagcagaagagatgaggattttaggatggatagatctggatttgatcagcctggcaatttagtagatgtgtgattttggggatgttaattgagccctccaaatccgatctctgtgtctgaaaaattcctgacacagaagcacccagtaaatgttagctagttctttactcttctttaggtagagctgtgtctagtatgcttcagaaacagactgctgttttctttattgacagttttccaggcaaggaaaaaaaaatctctttgcattctcctctcccattacctctctctgtatctctttgatagttttatttatttattttttattaaaaattttttttgggggggacagagtctcactctgttgctcaggctggagtgcagtggcacaatctcggctcactgcaacgtctccctcctgggttcaagcagttctcctttctcagcctcctgagtagctggaatgtaaggcgcgccccaccacgccccgctaatttttgtatttttatttatttattttttgaggtggagtcgtgcactgtcacccaggttggagtgcagtgtcgtgatctcggttcactgcaacttctgcctccgaggttcaagtgattttcctgccttagcctcctaagtagctgggattacaggtgcctgccaccacacccagctaattttttgtatttttagtagagacgggatttcactatgttggccaggctgatctcgaactcctgacctcatgatccacccgccttggcctcccaaagtgctaggattacaggtgtgagccactgcacccagccattttttttttttttgaaatggagtctcgctctgttgcccaggctgaagtgcagtggcgccatcttggctcactgccacccctgcctcctgggttcaagcaaattctcctgcctcatcctccccagtagctaggattataggcgtgtgccaccatgcccagctaatttttgtatttttagtagataaaaggttttgtcatgttcactaggctggtctcaaactcctgacctcaggtgatccatctgcctcggcttcccaaagtgctgggattacaggcgtgagccaccaccctggccaatttttgtatattcagtagagcgggggttttgctgtgttggtcagggtggtctccaactcctgatctcaggtgatctgcccacctcgacctcccaaagtgatgggattacaggcatgagccaccgtgcttggccagtagttttatttttatagttatttggttactatagtcagacaaagattgagaggcataataagctagttctcatctaaatttcttataatatgtacaagttttgctaccacaggtataacacataaccagaattttgagaaagaaacattagggccttggtgtgaaattaactttacatttcaagttgcctcctttgtcttttcagtactctgtagtgtttaatatctgttgataagatgacctcacttggtcctcaagaccaactgcaatttatttttattattattatttttgagatggagtcttgctctgtcacccaggctggaatgcagtggtgcgatcttggctcactgcaaccccctccagcgcgattctcgtgtctcagcctcctgagtagctgggactacaggcatgtgccgccatgcacaacttttttgtatttttagtggagacagggttttgtcatgttggccaggcttgtcttaaactcccaacctcaggtgatctcccagcatcagcctcccaaattggtggtattacaggtgtgagccactgcgcctggcaacagcaatttatttaaatatttattcaggttgggagtggtagctcacacctgtaatcccaacactttgggaggctgaagtgggaggattgtttgtacccaggagttcgagactagcctgggcaatatggcaagactgtgtctcaatcaatcaagcaatatttattcattcatttatttattcattcattcattcagtgtcctcctgatttttattccctatgttcagatcttatctatcaaaaataaatccctcatttaacttagttctcttcttaatccttaatgtcaagtatgtaatattttctgactttttaaaaaacctaccattaatttataatctgattttcactctaccactctcttgagaaatagtctcacaaaagcactcttacttatttgtaggaaagttaaaaaactttcttagtctttatcctccttgacttctgctgtagtatttgataccggtgatcattcctatcttgattacactttcttgtatttttgcttacctctttcactgttattgttttgttttgtctttttcttctgtcctttgttgattgcttttccatctcctgccttctaattttggctgttccctgaggctcagtccttagcactctgctcttctatcttactcctaatccagaaagcccatttccatgtctttagctagcacctctgtgcatgtgacttctaaagttaagttctcagctgacccaaactgaattctggtatttccagctgcttcaagaacattttcatttgtaacttctttgctgccattttaaattcaacatatttaaaattgaatttatcaaatccactgcccttttaacaaaccttatgacctgcctatttctgttaatggtccactactgttgttccacactgcaaacttgaaaccttgggtctatttgagggaggggtttttgtttttgtttttgagacaaagtttcactcctgttgcccgggctggagtacaatggtgtgatcttggctcactgcaacctctgccttccgggttcaagcgattctcctgcctcagccttctgagtagctggaattacaggcgcccacgaccacacccggctaattttttgtatttttagtagacacggggtttcaccatattggccagactggtctcgaactcctgacctcaggtgatccacccacctcaggctcccaaagtgctgagattacaggtgtgagagggaggggttttgaaatcttggagcccctggtatgctggagccagcttatggactcatgagagccaagtgttaaattttcagcaattttgtgagctggttgctaaacatagcttttttttttttttgagacagtcttgctctgttgcccaagctggagtgcaatggtgtgatcttggctcactgcaacctctgtctctgaggttcaagggattctcctgtctcagcctctcgagtagctgggattacaggtgcataccaccatgcccggctaattttttttttttttttttttttgagacggagtttcgctctgttgcccaggctggagtgcagtggcgcgatctcgactcactgcaagctccgcctcccgagttcacgccattctcctgcctcagcctcccgtgtagctgggactacaggcgcgcgccaccatgcccggctaatttttgtatttttagtagagacggggtttcactgtgttagccaggatggtctcgatctcctgacctcgtgatccgcccgtctcggcctcccaaagtgctgggattacaggtgtgagccactgcgcccagccacagctattattaaaaattaaattatgtaaacatacaattaaataaattatatttaaagtaaatgtaatacatcctcaaagctgttcatttcataattgttttgctgcatgttagtattgtctgtactcttgaggttatgtctgttgtgtctctgtgatggaaatactgtacataatggtgtgctactgtatatttcttcccaacattgcatttagtgatattatattagtagcttgaaattggttgtattgggaatatttacatcatggaaatcagcaaattctacaagtttgagttagatgtcttgttttgtttattgtttagacttaagaaagtgatggggaaaatgttaatattgcagattaaatttaaaagtgtgggccgggtgtggtggctcacgcctgtaatcccagcacttggggaggctgaggcgggtggatcacaaggtcgggagattgaggccaacatggtgaaaccccgtctctactaaaaatacaaaaattagctgattgtggtggtgcgcacctgtaatcccagctactcgggaggctgaggcaggagaatcacttgaactcgggaggcagaggttgccgtgagccaagattgtgccactgcactccagcctagtgacagagcaagactctgtctcaaaaaatgtatatattctttcagtttttaaagctattttccagttcatcatgaaccatcttccccagttgtataacgtacctgtcaccttcttatttctttacacacatacatacacacataccttgcatatgtccatctctatgccaagtcttatgtggtttttccgtcttctttctactaaaacatttgctaatcctccaagtcccgtttcttcgaggaagtctttacgtatgtttccattctttatcttgtccagtttccattcttatcctactttctttttttttattatttttttcagacagggttaaaaaagaaacccctcattacaaaagggtcttggtttgtcactcaggctggagtgcattggtgcaatgataccttactgcagccttgagccttaaactcctgggctaaagcagtcctcctgtctcagcctcccaaagcactggtattacaggtgtgagccattgcacctggcctcctgctctactttcagagctactttgaatattataattggaaaggacttcagttttccactcaaatgtaaaaatccccaaatccccagcctctactcaaaattatagtaactaaaattctactacttctgaaagtagccctttctagcgttgtctggaaaattaatatattaaaaatcaatcttccttataattttcacaagtcttcccattctgtgttgtgaacatcaccttttttttcgagacagagtcttgttctgtcgcctatgctggagtatggtggtgtgatcatagctcacttgcagccttgatttcctgggctcaagtgatcctcccacctcagcctcctgagtagctgggaccataagcatataccaccatgcctggcttttttttttgttttgtagagaagggggtctccccacattgcccaggctgatctcgaactcctaggcttatctcaaactcctagggtcaagggatcctcctgccttggcctcctaaagtactgggattgcaggcagaagccactgcacctggcaatgagtatcacttaatgaagtcgtcactagactgggactgaatcagaaatccaattgccacttaacttatagctaagtgaccataacatctcagaacctcagcttccttggtttctttgatggaatggtggtaataagtaaacttcacaaggtaattgtttggattaaataaatagaatgagatgatggctgattataaagcatagtagttaatggcaaagactaaaatcagatgaaactgaggccggtttttccacttggtgaccttgggcaatttacttaacctctttgtgccttatttcctcatgtgtaaaatagaaataataatactacttaccttagagatgtgagagatagataacatattaaacatttagtaccatgtttgatattaaccacactttctcccaaagtgagatctgtttttccatagttccaattttaaagttaattggaatttcccacaaagaaaattattctgaaattcgctattagaaatatttggtgtaagagaagggttaaattggaaatacaccccaggaaacactgggtgcctagcatttagtttcctttgcagcactctagaaggcttttctgactctggctggactcatctacccatcattcgccatgctattacattttggctcatagtaactcctaagatgtctcaggataattaagactccccatcttcttgtccaaactttctaggacgttgttgcatgttggttagagtgtgtaatagatctggcatcaatttaaaaaacacacacgtttctggtaaagtattatcatttcacatgtattttattccaatctgaaacttcctgaattttattatttaattgttgcttccacttttaaattctttaatttgtgtttacctagaaccagagatttttatgtggatagtataataattcaatatcaaataaaaatctgtctgtttcactctcattcacaggtccgcaagcacatcaatgatctttatgaagatctgcgggatggccataacctgatctctctgttggaggtcctctcaggcatcaaactggtgagcttctcctaatgaatggcctcacaattgtggccctacaaatgacatattggtccatctcattgagtgcaagggcagcagccatcactgtttcatctattagaggggaggaagaagtagaaggaaatgttgggggactttatttctaactcagacttagaatttacaaattatataatttaaattgatgtattatatgttctcatttcttgatgaaatgagaaattagttataatcctttttatatctgcatgtttttgcattactttttctttattttctagatactaatatttcagaaacagtagattcatgtttaaaggtttttttgaattaggtgtatttttcttcctagagctctagtctatatagacgcctctcattttccaatctattgtgaatttttaaaattttatgtattcagctaaagacctgaagtttacatttaaaagcccaggtgtatgaagttatttttttttccaaatcatctcactttctcccttctgtgattcattgagtcttacagatttggagagctgccaaagttgtctgagcatagccttggatatagaacatctgggctccttgattaattaatatgcctgcttcttcccaaaatgttctaacattgattatgggaaacacctacatatctgagggcaaatcctgtctgagcttcttgccttgccaaatgatagttcttctacttgctttgagggatggaaatcacccacttgtaggcctactgttttctatatttgagcctaatgggagcaggtgattccatatggttcatactctttctctcatgccatagacaacataattttcatttagaaaagtccagggttgaatactggaaatatctgtggagaaatagagaaccaaagagatgtatagctcaagtagtctgtgaagaccagcccactcactgcctttcttagtcattgtttgttgtgtttaagtaacagaatttggcacatttgattttactgcctaagtgatattcagctccttctaggattggggcttggcttccctgggtcctttgttttggtttcgtatctttttttttgccttgcaatagaattaattatatattttttaatggcctaaaattgacagaagcttttattagcatagccggcacatttaatttctagttcttgctctctggctcgtgtttataagtctaataagtaatcagaattttactttcattgtgctggactttattcttcaccactcacacagttacattttgggcaatgtgtctggtacatttaatgaatttgtaatgattttatattgaaaagtgatcttttttggttgtattgcttacgtaataagttgaaactatgtcaatctaatttcttttcctaacctttgaaaacctttaagtgtttgtggagatactgataggatatcatctcttcaccaaaaaccatccagatatctctttgacagttattctcaccatgttttttccccatagttgacttagaaaagcagagagggtaggaggctaaggagaattgaagatgtgtttcatcataagaagtgttcaatgtaaccatctgctctggttttgatttagttttgtatctttttcggaggtgggagggtattttcatatttgtttttccttttttttaagtgttgcattcatttcctttccatctttttattgtgaatttcttgttcctctattgtgtctttgccttggttggtggccaaaggagccagcagggctgaagaccctccgtctggtgagcatgccctcctggtgccatacaaacaacgaggagcaggcggaggaagatgatgatgatgtagtaggtcctcctggggatgccagcatcccagctggcactgctggcactgcagggccatcagagtctgaggttctccaggtctcgaagtagttcagttactatttgccaccttctcatttcaactgggaatttgggtcccaaagaaagtagttaaaactaattgtgccttttgtcactgttaggtgctcatggactgggaattgtttttcttagctgagaagggttggcacaaaaagaataatggtttttggaggtgtcaagttctcttctgacctggagacccatagctttctggtggccttgctgtgttttctgagtccagattgcagaattgtggaaaatttagttgacagcatgacaattaattgctcacaactccacagtctagactaactggtactctccacctctctggcctctaggttatcatcatacaccccgtcatttgttttcaaaacagcctgtttgcaaactcactgcatggagatactctggctttgctcaataatatctagttgctatagaggacagagatttaacttgcatgttcttagggtatttatttttggtgaggggtacatatgagtaaagattagagtataagaggagtgtattctgcctgcaggccctaaattatagtccaaaatctttttccagaaacaaggattaggcaatatcctcattctctgtcctcttaaaatcattttaaaaatatcatttgtctcccttctcattgccttagaatcttccattttataggcactatcatcttctaagccatattcacaattaatttagctgaaatgactgagaaaaggttcttgctaaaaagatttttcctaaacctttgactgaagaagttatcctgtgcccagagaggccttgacatctctgtgaacagattctcctatttgagaagtgttgcttagaagtgttggagagtgcccagaagatgcttccatccttatctctccatgtgttagggtactttttgcccattttaatttggagcaatgttgttctctgcagacacccgcaacagagctaccttatattttatcagcctttaattagtgtcaatttgacacttacaaaagaagtgggtataatctagtgagagtgatatttctctccaaattttagtaaaatataagcaacgttagaaagtaagcagaagaaaatgttctaggggtagatatccctttctgtgatactcagtaggcaaagagactgcattcactttccaactggtaatagttgagccttggacggggtaccagaggcactgggtagagatggggttctctccagtgggttgtatgacatctgggattgagtgactggcataactttctcaggagtaattatgttgacagccctacactatcaaagttttgtttgctgtgggtatttcatgctggagtaaagggtgcccttccttcagtggcagctatgttcctgggaaactggttgcttcctaatttttgcctcccattttggattttttcacttgtttcttgagcatatgtaacttctcatttcctatggttaaaaatcagctatctgtattttttttttttttttttttttgaggtggagtctcactccatctcccaggctggtgtacggtggcatgatcttggctcactgcaacttccacctcctagatttaagctattcttgtgcttcagcctcccagatatctgtgattacaggcatgtgccaccacgcccggctaatttttgaggagccaatgaagggacgggatttcaccatgttggtcagggttgtctctaactcctgggctcaagcaatcctcctgcctcggcctcccaaagtgttggaattataggcgtgagccactgcacttggccaaaaattggctatcttgagctccttttgccatgtttgtaataaagttggctccatctactactatgcaatatgtaattaggactttccaccctttctctacgatagcatttaactgtgattttaggagtcatagagccaaagtctgttcccattaacctcacatccagaatcaagttctgccacatgtgactgcagatgaacctgaacagaagctgtggcattgattcggcattagtggtcaaacagtattctgtgtttgcgagatgcgtagtggtacacaagacatttggggacctcagagagcctggtcgaaacacgtacaggcctggtcttagggggtgctttgtgtaatgctcccaggcctggcttctactgtaaggaattcttgtgtggtcctttagtcctggaaataaaagagaaagggtctgtatggttaaattgtgtagccagaattaacatccctttttttgtttgtttgcagccccgggagaagggcaggatgcgttttcataggctgcagaatgtgcagattgccctggacttcctaaagcagcgacaggtaagaccatcacatgccttccccattcttccaggctgtgttggcattggggccctattcagagatgtttttagtgcccctagtaagctctcagtaaatgctaaatctgattgacccagttctgagtcttaacttgctagtgagcaattgtattctggttagagaaatcattcagtactcacacagaacttgtgacctccttgagaggaagaatgttcacggagaagaacatgatgataaagatggaattttgtggatgcaccttaggtgggggtcaaaatgaagatgaaaaataaactagaaaagagatggaaaaaaggtgtggcatccaggaagagagagaaccagattgctatatcaaggtgaaaatgagataagggggtagtgtggattgtggaatgccacatcagatctgagaaaaaggtctaagttgttaagcactgataacttaagtgagcagtttaatacaggagaaagatatttagagtatagtagagctagatataggaagggagaaagaagcttttccttccctggatgaggaagacaacaacccatttttagacataggaagaggagccaatgaagagagtaagaatgaaaatgagcatgaggaggagtattggtagtcatagaacgtttcaccgagaagataccctaatgttgtactagtccagtttcttattatagataaagaaactgagacctggacaggtaaatgacctgcctcaaatcacaagtcagagcaaagctgagactttaactcaggccttctgacatgcagtttagtgcaccttccactatccatgctgctttctacacagcacccttcctcctttgcttcctaactgaaggaaccaaatccagggattgatggatgagaagcagagcacaagtggtgtggccatctttgaaaaagaaaagaaaaatacctcttttgagagacaaggagaatgacagagggaggggtgaagatacagagatggtttgtggtagaaagaagatggatgagggagtcaaagagttcatctgcttagagtgagccatatggaaaatatttgggatatctagggttgccaagcaacaacagggtcaacgtgacattaaatggtatgcatatttttggagtcagttcatttttgacactcatatcagtaattctcattaacttctaaaattctctgtttgctctcataacaatttacttctggtataacatttcttattttcttgttatttctctgtttgctccaatgcattataggctccgtgaggacggggaataagatcttaacatttcaccttcatctctcataatgaatggtcctcagttggcacttaataaatatttgctgaaataaattgataaataaaagtggtagaagtggaggttgctgaagtgtttagggtactggagaaagcagcattgaaatgcctgtgtgtggagctagaggaagctggggtgggggccttactggcagggtttatgagaagaattgattagctagaagtctaaatcaggacaaaaagtggctttggttactatgatagaatgaaaacgtggacaggtaagaacagtggattcaaagaagggcagggagattactagagccgttcttggtaacggtaaagtccaagatgtagctgtgcagatggccaaggtagggaaaaacgaaagtcatcagaattcaaaaggcaggcaatttgtgcagatagtgtaatatttgggatatcaatataaatgctaaatttccaggaaaggtgatgatgaggcaggaaaagagaataggagctaggtagtgaggtcattgagaaaaaggttagcagagattggaaggtggtttggccaagggaggtagacttcacaatgaaaggggaaggctgacagaggtaggactgaggaatgtggacttggctggtactggtaacccaccaactgtcaactgttagtgattagaaaaattgaattctcggggaggggacaggttttcccacttgcatcctactcccaccgtatagaagaggagaccaagatacagaaaagggaaagaacttgcccagatgaatgtcattgtaagggagaaatgaggcctccatttgagaaggtcactagggtcctctggagacacacaagtttcagttcagtagaagagataaagggaggacagctgaaggacactgtgtcgcaggactctgagggtatgattgaggaggctaacagaggtgaagtagaagtagggtggtttgcccaggacactcccagttttaaagttccacgtcccaggaaattcctccgttcccagcacactggggcagtaagtcagcctgggaagagggtgtgtcagggcacattgagttgttgggatgagattttaggagtaaagcaggtgctgcgggaggcatggcaggtatggatatctgtgacaaagatgggataatggaggtgagagcaggccaaagactggtgagggaagagaggcatctctcttttctgtctttctctctcagaaccttaagaaaaaaaaaaaaaaggcaaagaagaaagaaatcttggccctgatggcaataaaaaagtgacccacaataccttgtgcttgcgaggttgcttttctggtgagaaagcaaaatggcgtagctactctgatgacttcttataaagctaatcatatatcatataacccagcaatcccactcctaggaatataccctaaagaaattactgtgctcacacaaaaacctgcacatgaatattcataattgccaaaatctagaaataattcacatatccttcgatggatgaatgggtgaacaaagagtagcatatctctataatggaatactactcagcgatcaaaaggagcaaactgttgattcatgcaacagcttggatagggatctcaagggcattatgccgagtgaaataaaaagacagtttctttttttttgagacggagtctcactctgtcgcccaggctggagtgcagtggcacaatctctgctcactgcaagctctacctcccaggttcacgccattctcctgcctcagcctactgagtagctgggactacaggcacccgccaccatgcccggctaattttttgtatttttagcagagacggggtttcaccgtgttagccaggatggtctcgatctcctgacctcgtgatccgcctgtctcagcctcccaaagtgctgggattacaggcgtgagccatcgcgtctggccggcagtttcaaaatcttgcatgctgcatgatcccatttatccaacactctggaaaaagcaaaacaaggaatcaggatcagatcagtggttgtcaggaattaggggtgagagtagggtttgattacaaggagggggccagcacaagggacctttttggggtgatgaaactgttttgtggtggtagttgcatgaatctatacatgtgttaaaactcatagaactgtacaccaaaaaagaaatcagtttaactgtaaatcaataatgaagtgatgcaaaaatttaatcaaaacaaaaagtcctagagctctgagccgtgcttttatttctttttcaggtgaaactagtgaatattcgcaatgatgacatcacagatggcaaccccaagttgaccctgggtctgatctggaccattattttgcatttccaggtagggcatgtgaagtttggaattcctgttgctttgtttggacatggcctagaaagttgcactgccttccacagacagcattgagccttccttctctctatttgtcagtgaacaaaggtggatgggagttggaaaggaaaattaagattgatctgcagacaagctgttgtatcgtaaacgcaaaacttcctaattatttgcttaattaaatggagggatttttttacccatttgtggtttggccctgtcctcagcagtctggttattagaggtctgtttgctcagctgaatcaaaatgaggctcttgaaggactcagaatatgagggttgagaaaagctgttggtgttgatgctttagaatggtggagtgaaggttcatagtcctgctctaatgtagactttttctcatctctaataacctttaaacaagcctcgttaattagaatactttagtatctgggtttgtatatgtgctggcaagcacaaccttgcagcggccatcacacccaagagcatcttgaagaatattcacatggtcacatggccttcctcttcctaagaaggcaaatcctttttagatctgaattgctattggaaaagtacagccctatttttataaaaaggctgttcttttacatcccttttaggtcagccaaacaaagctatttctcagacagctctctctgatacacagttgctgcacatgaggctgatggattagaggctgatagctagtgggaatagaaggcagggtgccgacttcagggatgaggccaaggtgacatcctagctggggagttggcgctacctgctggttaaagatagaacaacaggtgtccccgaattcctgagagaaaaatctgagtgcttaggcttgtttcttgaggctctagtttggaagcaatgctggcagtcaccagcatggacagggctaggattgtgtggtggtaatgtatttttgtggaaccacagggtatcctcaggcaagctttgggcatagggataaccaggaacatgaacttggtaggtgtgctctgtctggcaggatgggaaactttgttgagctttcatggaggactacagttatccctttggaactcttatgaacagaggagcttttagagaaatttgtttgttttttggtcacaaacctgccctcactgtgagtgcccaatgtttgtctcataggtgggaggtaaggagaatttattcactgtctctattcaccccaactactacaactaaattaatttcctttttttttgaccgagttttgctcttggattgcaatgatgtgttcttggctcactgcaacctccgcctcctgggttcaagagattctcctgcctcagcctcccaagtagctgggattacaggcacctgccaacatgcctggctaatttatatgtttttagtagagatagagtttcaccatgttggccaggctagtctcgaactcctgctctcaggtgatccacccacctcggtctcccaaagtgttgggattacaggcgtgagccaccgtaccaggccataacaaatgtttaaatagagaaaacattttcttttcttttttctttttctttttctttctttctttttttgttttttgagacggaatttcgctcttgttgcccgggctagagtgcaatggtgcaatctccgttcaccgcaacctctgcctcccgggttcaagagattctcctgcttcagccttccgagtaactgggattactggcatgcaccactacacccggctaattttgtatttttagtacagggtttctccatgttggtcaggctggtctcaaacttccaacctcaggtgatccacctgcctcagcctcccaaagtgttggattacaggcgtgagccaccgtgcccggccagaagaaacatttccttgaagcatttaaaaatttcatttctttctgtttactagttttcagaataattagttggttcgctaagattctccaaaggtgaccaataatagttcctttgttcaccattttttttttagtatcactgtgacttgtggatttttaagcagacttaatgttccaatcaaatacagttattattctttttaataaaatcaaatagctccatctttggctgtaaagaggctttcaagttgactctgagtcctttggcatgaccacagtggtctttgataatttcctttatttcttgtgcgatgaggtattccagactctttttttatattttctgtcccaggcctgaaattcttaatctcccctaggaactggttctctatttattgaccacagtctgaatgctcctaggttgcccattatttctttctttttcttttctttttttttttttttgaagcagatttcgctcttgttgcacaggctggagtgcaatggcaccatctcggcttaccaaaacctctgcctcccaggttcaagcgattctcctgcctcagcctcccaagtagctgggattacaggcgtgtgccaccacgctcagctaatttttttattattagtagagacagggttgttggccaggctggtctcgagctcctgacctcaggtgatccacctgcctcagcttctcaaagtgctgggattacaggcgtgagccaccacacgcggctggttgcccatcatttctaggctttttctgtgggcagagctaggcaatacttgtattatctctaaaaacaacaacaacaacaacaaacaaacaaaaaaccccatgaatttttactgatatttctaattcaaatttaggattgcagggttttgtttaacctctttgactttatatcattttttttcttatactgaaaatcttgatcttaacaacagtaatgtggttacttactcttttcctacacacacagagatctgtaaaatcatatatattatttgtaatatatatgaatccaagtgacaatatgaatgttattgttagcagtatgattactttgaagtcacttgaaataatttctctctattgttgttaagccacaaattcaatacacaattaaggttcatttgtttttatttgctttcagttttggggggttgcttttttcctttcaattttaccttacattatgtagatcatttatattgttccaaagggaaattttaaaaagttaaatacaaattgtgttcagagaggtctagcttccatctctgctccctccattctgtatcttcccattctctgtagttagctaaatgttttaaaacacctttttggttataatttctattgtttgtttattttaggaaaatgcattcataaaaaaaactttactgaggtgtaatttacataccatcaaatcaactaatttaatgatttttatgagttgtacaatcatcaccataatctagtttggggacattttcatcatccaaataagatccttcttgttcatttacagttactgcacattttcatcaccagcctcaggcagccactaatttattttctatcttgatagatttgcttattctggacatttcatataaatggaatcctatgatagatggtcttttgtatctggcttttttcacttaacataatattttttggttcatccatgttgtggcacatatcagtacgtcattcttttttattgctgaatattctgttgtatggatatatcatgtattttgtttaaatattaagccagttgatagacatttgagtggttttcactttttcactgttataaataaagttatttgcataccagtctgtgtgggtttatgttttcatttctcttgtgtatacatgtatatacctaggaatgggatttcttaattgtacagtaagcatgtttagcttttaaagaaactgccaaattgtcttgcaaaatggtgtatcattttacattcctaccagcaatgtatgtggtttcctgtgtctttacatcctcaccagtatttattgtctgttttagattatagctatcacagtgagtgtgaaattgtatctctttgtggttttagtttgcaggaaaatgtattatttaattgaattccacaaacattgactgggaatgttatgagcaaggtcttagatagagtgtatggaagatacacggctgagtgcaatggctcacacctgtaatcccagcacttcgggaggcctaggtgggcagatcacttgaggtcaggagttcaagaccagcctggctaacatggtaaaaccccatctctactaaaaatacaaaaattagccaggtgtgttggcgcactgtagtcccacctacttgggaggctgcaaagcatgagaatcacttgaacccgggaggtggaggctgcagtgagctgaaattgtgccactgcactccagcctgggctacacgagactccatcacaaaaaaaaaaaaaaaaaaaaaagaatctactacagaagatacaaaattgaactagatacagaccatctagttggactcttattgtttaggagagtgagaacagacataccataaaataacttgacagaggtttagagaatgagagaggtatgggttaggatgatggaacacagtatgaactcaacagtgggcagcagttactagtaacaacttattataattattaattgaccttataacttccagggcttttgacacagcccactgttctttttcctgttaccaattttacagaaaggtaatagcagctttggcctagtctgtcttctgcatgcatattggctgcctgcttttctctgttatttcagcacagccaaatgcctatttatttgtcttcttgtaggtgggagcaccgctcccagaatattttctcagttttaactatggattccttttctttgccgttctgagggcttggtatttgcctatactagctaagtgttctggtgtgtggggaaaggttctctgcttgtgaagcttttgattgactactgaaggatcatgtggagtgcccccccaccccccgcctcgtcttgcatcagatttggcatggtatgtcttttgctagttatctgtcattgtggttttctagtctttcattattgagtatctattagctgttctcaccaagaacatatgctatgtaaagccaaatggaaatgcagagtagaactgttacatgttagggaatcagcaaaattgttattatggtcagtctgtgttattggtgttaatgaagtagaataatgatgtacctgtagacatggatggtagttttcacctcaagggaatattcagttgaaggagaagggagaggctggatccagattaaagatttgtgactgctgatgaggctggtaatattgataacttcatgcagaggtttatggtttctaaaatgctttaacacattttttttaatgtgctaaatggtagatgttctttttaattttaatttgagtttttagttttgaaaatctcaaatactcggaagagtatataacagatccttatgtgtgtagttgccttcagaatttaacaggtgttccttttgttatatttgcttcagggttttttctctctcttcctctttaaagtaataaaacatctcagatacatccaactttctttgccctctctgctccccaggtaaatattatcctaaagttgatgtgtatcattcccatacatgcttttgtacatttacagcagatgatctattcataaacaatatgtactgttgcttgtatgtctttatatttgacacacatagtatctttggtatatcctttctttcatcttttttcttttttcttttttttttttttttttttgagacggagtctcactctgtcacccaggctggagtgcagtggcgcgatttcagctcactgcaagctccacctcccaggttcatgccattcttctgcctcagcctcccgagtagctggggctacaggcgcccgccaccacacccggctaattttttgtatttttagtagagatggggtttcaccgtgttagccaggatggtcttgatcttctgacctcatgatccgcccacctcagcctcccaaagtactgggattacaggcatgagccactgtgcccagcatgatttgttcattttaactaatttaatgtaagtggtgacccctgcagctgtgtaacacatctattatttgtaacgtattatttaattgtatgaataaaacattcattgctacagtgaacatctgtgtatatgcatccttgtgcctatagcaaagagggttttgggattgatacctggactggaattgctgggttatatactttccttcagtttgcctatattttgccaaattgctctcaaaggtactgtatgacttacagtattgtattgggtaacatttactactatttgacatattacatgtttacttgtttatttgctgcctggatgcctgcattagtatgtaagcttaacaatggcagggatttttgtctcttgttcttttctttgcctggcatagaataggcagtcagtaaatatttattaaatgaatggattgtttcatgaatttgatcttctcaaagctttggagtaggtagaccaaataaataggctgtaatgtctgttttcttatgcccatttctcagataaggaaactgaaacacagagaccgactgacttttttgggttacacacccagataggatttcttttttttttttttttttttttgagacggagtctcgctctgtcgcccaggccggactgcggactgcagtggcacaatctcggctcactgcaagctccgcttcccgggttcacgccattctcctgcctcagcctccccagtagctgggactacaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccaggatttcttgtcttttggctttgtccaagcttgttttaaggtataggttaagatttatagttcttctaaaagatactataaactctttataggcagaatctgacaaaactagttttccaaccctcaaatgtttgttaaatactagtgtatgcctagcattttgaaattttcaaaaaatgggaggtcttagctggctagacttgaggtttacagttttgtgcactttatggcacttggtgcttggcatatagatgaggcaccatttgtgtttttggaatgaatgaatgaatgagttcttttgctttggagtctttcactctggctgtctctgtgggagacctgtgggcagtaaacagttatctacaaaaagccaaaggagaaggcataaagaatgtataggcctcaaagtgtgctttcccagaaggcagcaagtcttgtgttaagagaccaggttagatgagaaaaggtcttggggaaaggtctcgtaatcagaattaacttagttgaaaatacatctgatatacctactgaaaactatagtttagcctatcttaaatgtattccgaacacttatattagctaaccgttgagcatttggccaaaatcatgtaacacaaagcctgtttgatagtaaagtgttgactagctcatgtaatttattgagtgctgtactgaaagtgaaaaacggaatggttgtgtgagtacttgaagtacagtttctactgaatgcatatggatttctcaccactggaaagtcgaaaaataagctggaccattttaagtcagggaccatctatatcttaggatccccccgggggctggggatgtctcataacttttagttccagtaataaatgggaagaaaagaaatttactgtaggtcaagtactgagccaagtactttatggacattatctcattaaccttgtctacaatcccagtaagtaggtggtagtatgcacattttacaagtaaggaaactgaaccatctaataaactagttaggttacttaacttatgagctgggaagttgaacctaggtccaccttactgaaatctctgctccttccctagaccagtttttctctggagcagaaggaaatgaaggtctgattggtctgacatatgcagaaattttaaaaaaagaataggctcacagaagtaaattctcagagaaactctacagcagtagtagtcatattaagcagctatttctcttgcctctaagtttattagtttcaggattttggtttgcttgtatgtcattcataaaattcaagtgcatcttaaagttcccatagttccaggtttcttcactggaggagtgaaggcctggtacctgcctagagaacttcatattgtaatgtcagattctttgttaattaaatgatttgcagtagcatgagtttctctcccatgctctctgcttatttcttactatagtttgtgatggccataagatggtgctgcagttttgcagtcagccttaaggataaggcttaggggaagaacacctactgcagttgtgaggcagatgggacatcaggagggtcttagaagggattgtgtaaaagccgttgctttagggcttcttgttgctttccttttgtggtcttttcctttttttttttttttttttttttttcaggtctccaggaaagatagttaaggctatgctagtgtaagtctttatggcttgcatggaaccaggcaggctactgctttctgctgtgtggcctggatccttttgttgtagaataaataactgcaataggaaagaaacacatatataattttattctccattcacagccctttgggttatagtcttttcccatatagcagatactatactaaaaaaaattggggtggaggaatcttcactgacatcacaaggtgatttttgaatccgacttttacagtctgaaattcagacttcctgccctactgcaatgggagtaaaaaccacctgaacctctttttggcagcttcttctcttactcccaaatggcaacaagtgttatctctttgattgagctcttggtccatgcagtctaattaccaattcagaacagtgggggaacttcttattttacacaactggcaactgagtacagatttccactactgcagtagttagaagagagtagttggggttgaaattaaaagtcttaaagttaacagaagttcatgttctggctttgtcacttactagctgtgtaacctagggctattaatcaactttcttaaacctcagtttcttttttcttttttggagacagagtcttgttctgttggccaggctggagtgcagtgacatgatcttggctcactgcaacctccacctcccagttcaagcaattctcatgcctcagcctcctgaatagctgggactaagggcgcatgccactgtgcccagctaattttttgtattttagtagagacggggtttcaccatgttgcccaggctggtcttaaactcctgagctcaggcaatccgcctgccttggccttctagagtactaggattataataggcgtgagccactgcgcctggccaaacctcagtttctttaccgataaaatataaaataatagttttgacctcatatagtgactgtaagaattaaatgagaaagtccatgtaaataactttacacagtgcttggcacacagcaagtgcaaaaaatatattagatgttagcagtggcagcatcaataattactattgaacatttttgtcaaatattgttcatcagagaccctgttcatctgttgtatttagaagtggtattctttttaccaagcactcatttactgtactcaaaaccaacttccagatttttcctgtctgtgtcattggctggcagaattaacagatctttcttttcttttataggaaaaaggagggaaataaatgctccagaaggctagatctttaaagtctgtgttccttttcttaactgtaagaagaaggctctggtttcttcaggttataatttcattaaaataattttattgttttctgacctgaaaaaattcagaatatgtatatctgcttgatattttcttttgggcatcttggtgcaacacttaaaatctatttcattttgtagtttgggagccataattgcagcttcaccaggcttggttcttcttggcccgggcccttcccttcccttgctggttagtaccagccgagctggtttgctttttccctttttggtactattctcctcctccttcctccacgttaccttctgccacggcctctcttctttttccctccattttcaatttacacttacattttccctcctcctcctggccctccctagtttttcccctcccctggtttctagctcctttttgctttctgtttgtgttactgagggcagtgctccaattacctcatatttggagagaggaagctgcagccaatccggtttctgtctgcttttaggtcaagtgatttctgaactgcagtgagatgctttgaatttgtcttgttgcagctctgagcctgtaagatggctgtctgaatcggcagcggctggaagagacagagagaggcggggagggagggagaaagaattggagggattgccggcatagtgcatgtttttaaatgtgcatcgaatccgatgaggccaaggttgggatttctgtgggatcccaggactggcttagctgcgtttttgctgagattaggagaggaaggaaatgggaaattcactgggctgttttaaggagccgaaagagtcaatagctattcctgagaaggctcccatatctcctaagaaaagggttcggttcaaaaggaggtggagagggaagaaaatccctactccagaggcatctcaccaggaagaaacctcagaaggaactggagtcattgaagagactgaaaccctaacgaagttaacagagagtctccaaaaggaagacggagtgggaggggtagagcatacccccccagatattttgctgcctggggactcagcccccaactcacgggtagtcgatcgggggatgatagtacaggtaaaggagagattccaaggggaggtccagaccgcccaccttttgttagagaatgagtcatcagttgctggaggggtctgggattccctggaagaggggatgactgtcattgctcacctgcttgataacccagcagaaaggaactgcgagaagtcagtgagccaactggtggaatttcctaggacagcatcctgcagcagcagggctgtgttgctgcctttgcaaggagagactgcagtggagaaaggaaatattcagcgtgggtttcggagctgtgctttgcctaggacagactaccccactgataaaggaaatcaagaacaattttcagagggctggagtgtggaggaaggaaccaagagtgtttcaggtgcccctcagacagcttcctggattatagaatgttctgtttcttcattactactggaccagcctggaggccaaagacgcacggagccttcccatgtgggtcaagtgcccccccaggattccagactgcctacttctcagagtgatttgtccatcagtggtgtgactgtgagcattttgccctcctcctctggctatggcagtgatgggccacacatacatgggatccagcctaaagatacagaacctgaaaagagctctacttccttctcagaagaggatggcactctttctctggaggcaagccacaccccatcatggggtctggaagaggtaggtgggcatgttcaagagataatcaaactgctgtttggattcttggccctcaaacatattaaagctgagtgtggtgagcagtgaggatgttggtgcctctcaaacttacccccatgtgggttagtatctgctggagctcagcaagcagaatctatttcaggtctgccccttgatgcttgaaaccaagacttgtctctggggaatccctgattctgagtagccaagtggcgtaattgctcaagctatctggtgggatgatctctcaaggtgcaatgctagatagtacttactctcaggcaggtctgtttaccagcttccctgctacgagaagttgtaatgtagcacaagagacgatggggaagggcctaactgaatctctggaatgaatctctggaataaatgtggaaggggtcaggcagctgttgtcagtgtacttgctcttcctcacaggagagtgatattcttactagagctgatgcaatcccatccctgttgggaaatttctgacggcagcactcattcagtatttgtataggtggagagggctcatccttctttggttcctaattccaggattagaggagagggacagagttatctggggattagttgagagagagagagggaggttagggcaatttgaaggtttaaggctagaaaagtttgttttgtgactggatgtatttagggctttaacatgattttgttttgaggaatatattgaggcatggatggtgctgctggtggtggtggtaatggcagtttctgtgaatgttttaaaggtcaaggagcaagtgagaattcagagatgtgaacactgagataaggactcagcaagaccatgggtagcacagcatctggcatgtaggtgtgtgattgtgtgggtgattgaagttataattcaccaatggctaaagaacttttactgggatgttggcctctgcagcagaagaaataaaaacattaggacttcaaagtgcaaaatttataaaatgaggtagggcactttccttgcctagatgggggccactgatactgtacaggggccctgatgtttgcagagcagggatatggtctacctactggtgccctgcctatcactagcagcataaggctgaggatagatacaaattctgagcaatctgtgcctagaatttcctctttggggatacattttccccacagacagccccatcttagtgccctctgttattagagtttggagactcccaacaggttgaagaaaaagtggccattgaaaaaatatctattttatggatgggcaagaggtttcttgggcctcatataaacatggatatgtgtggtggggagtgtgatagttgtgttatggtaggaaggaaggcagtgaaactactgggatatggggcgcatgaatgtattaagctattcttgcattgctataaataaatacctgagactgggtaatttacaaagtaaagaggtttaattggtatacagttctgcaggctgtacagaaagcatgatgctggcatctgctcagcttctgaagaggcctgaggaaacttacaatcttggtggaaggcagaggagcagtaggcatgtcacttggctacagcaggaacgagaggttgtgggtgggatgtgccacacacttttaaatgaccgaatctcatgaaaacccacctaccctcacgagaacagcaccaaggggatggtgctaaaccattcatgagaaatccactttcatgattcatgatccagtcgtctcccaccaggtcccacttccagtattagggattacaattcaacatgagatttggtagggacacagattgaaaccatatcaacaagtatttgggtttcatcagataaaaaagaatgtcaaagtcaacttttatcttgtaaaagttggaacagatagagtagttgggggtaaaaccagctgtggaactgattgttgtacaactggcattaaaattgaaattgtgtagtcatcataacattataggacacatgcttgtaactgagtgtgagattttcagaaatttggcatataaagttttaggaactcctagtaaaatcaatcctagataatagaccatagatagcaatggcacctttgtatgggctggatctccacactggcaagggaatgttctgcatgagtctgtgaggagtcttaaagaaaagattgttaggagaaacctttggaccatgatctgtagtgtgaccatattggcaacagtatgattcctttgctgttcagtatgattcaaattggtgtgtggcattttctgggtagccaacctctgcatctattccttctaccttttcactgcagacacagtcatactacttatgtatagccaaggctgaaaaactaagtgaccgagtctcagctcagacacctggcatatttccaggttttgtgtccatcatgtgatacagggaccacagactcaccatcctatatgacagataagaagtaacttatcaagataagtgtgacattccttcagaatgaaagtccttaaggccaagaggctgcaactctcactggtccctgaaggaactgtcttcagggagctgctcccctccctaacaggctgttcacaggcttgaggacagtagcagccagagaaacagagagggcaacgcatactgaaaccgataggcagggcaagagcatctctgctaaagtgggaaagctgggagggcaagggtcagaagagcagctgctgctgttcacacaccaactcctgtctaaacaggagacagctggcagtccaattgagttgttttttgcttgcttttttggtggtggttttgtttttaatatgtcagagtagtaactatcctcagaaaataatttgagttccagccagactgtctcctctgttgattagtccagggcttgttgatgagagtgagaccaggctatggatagacataaacttcaccatgggttttgttgctttttaggatggagagaaatgggaactgattgtgcttcttgctagtgtagggtttagatagtagaatatacatgatctgcttttctattcacctagtacagttaatacttcttttgtcaagaaatagttaacacagaagcaagatgacaagggtcagctgacaaatatgttttcagaatgacaagtagactaggatttggagctggatgggaacaggctaatagcaatcgctctttgatgtcagacaaaggccttcttctctggcccatttcttctctcaggactccctattcccagctgctttcaatatccatactactaatacctggcttatttcaacaaggaacatttttgaaaatcccttcctcctccccatcttgacttctgctgccaagctcctgcccaccttgttagcgaatcccatttaatgaagcatttacctctataccaatttttttttttttttttttttttgacacggagtctggctctgtcaccgaggctgcagtgcagtggtgcgatctcggctcactgcagcctctgcctcccgggttccagctattcgcctgcctcagcctcccgagtaactgggattacaggcgcccgcccccaccacgcccagctatataccagtgttcttgccacaacccttcgagtctctacaattttaggtgaatagtcagataacactggggcctagaaatgataagaaagaggttggttggtgtattatcttctgggctcagccttttcagtttacaagtatccctctcccagttttcctttttaattatagggagagttgttttactaatactggctttgtactgaaagaagaaagcaaaattaaccagatgacactattgggggaatgcagaaggtaaagttatagtttagaactttaagaaaggattttgtttctttttctttttttttgagacggagtcttgctctgtcacccaggctggaatgcggtggccctacctcagctcactgaacctctgcctcccgggttcacgccattctcctgcctcagagtagctgggactacaggcgcctgccaccatgcccggctaattttttgtatttttaatagagacagggtttcaccgtgttagccaggatggtctcgatctcctgacctcgtaatccgcccgcctcggcttcccaaagtgctgggattacaggcgtgagccaccgcgcccagccttgtttctttttaaaaaaattttacttaattaaaaatgttactaaagaatcattattttttaggtgtaacaatagtgttgtggttatgttttaaaaaaggccttttacagatacatactgaaatgtttttagagaaaaacaggagatttactttatcataataggggaagggtgaagtgggtgggatgtagatgaaacaagattagctatgagttgataatggttgaaactgggtaataggtacatagggacttattatactattctgtctccttttgtatatatttgaaaatttccatttcaaatagaaaattaagaaaaaaattgtataaaaataaaatgaaattaaaaaataaaattgtataaaaataaaatggaaagttaggcaaaataagttgtataaaaataaaaatgtaataatactggtaaaattatgatataatacatatacagttggctctctgcattgtgggttctgcgtctggggattcaacccataacggatggaaaatattctgaagaaaaacattgcatctgtaatgaacatgtacagacttcattattccctaaacaagataacaactatttactaacatttacattgtattaggaattataagtaatctagagattatttaaagtagctgggaggatgtacacaggttgtatgtgaatactacctcattttgtatctgggacttgagcatttgtggatttcagtatctgcggattttggtatctgagggaggtcctagaaccaattctccatggatgactactgaaaaggggttactatcctatagataaagtgattaagagcatggagccagattggctaggtttgaatcccaattctgcaacttactagcagtataacttggaacaggttactaaacttctctgtgctacaatttccttatttgtaaatggaagataagaatagcatatgcttggtagggttgttgtgagaataatatgaattaatacaagtaatcacaataaatgctagttaatattattacttaaaagaacaagaaaatgaataagaaaaagacaaacacccttgtagaaaaataggggaaagcccaggaataagcaattcacaaaaaaaggaaatccaaatgcctcatatacataagaagactcctttttactaataaggatatacagatcaaacaacaataagatactttttttttttttttttgagacagagtctcgctctgtcgcccaggctggagtgcagtggcgcgatctcggctcgctgcaagttccatctcccaggttcacgccattctcccgcctcagcctcccgagtagctgggactacaggcgcccgccgccatgcccggttaattttgtttttgtatttttagtagagacggggtttcactgtgttagccaggatggtcttgatctcttgacttcgtgacccgcccgcctctgcctcccaaagtgctggaattacggtgtgagccactgcgcctgtaattttttttaaagagatgaggtctcagctatgttgcccaggctagagagcagtggcgattcacaggtaccatcatagcgcacagtagccataaactcctggactcaagcttgtagctgggactgcaagcacaccaccatgcctagctaagataccattttatacccatcagattggcagaaggtaaaaattctgaaaataccaagtgtaggcgaggatgaagagtgatgggaaaacctcttcatagcacttaagtggaagtataatttgctactgttctttagaaagtagtttgacaatattttgtagagttgaaaaatgcccatgttctattacctagggtttccattctaattatattccctagtgagacctccaggactctgaatgtgaatactgaaaggagcactcccttttacctaactctaatattggtaataaacaccttctttatctctgttcctcaccaacatagctgccattagatccctctagctgggcatttgtagaaccactgcattgtgccttcatctgcttcttcttcttctttttttttttttgagaaagaatcttgctctgacacctggctggagagcagtggtgcaatcatagctcactgcaaccttgacatcttgggcttaaacgatcctcgtgcctcaacttgccaagtagctggcactacaggggagtaccaccacacccagctaatttttaaattttttgtagagacaatttctcacagtgtttcccaggctcgtcttgaactcctgggctcaagtgatcctcttgcctatgcctcccaaagtggtgggattacaggagtgagccactgcacccagccctcatttgcttcttgaaagttttcaaggtctgatgctttatctttagtgggtgatgaggtcagctagaaacttgaggacataataatcaagtacttacttgctcagaacaactcgtctcatccactgagagacttaccaagtccaaactcctcagctgggataagataagataccaagtcgaaactcctcagctgggataaagataagatagattaccagttcctttgtaatctatcttatcttttctatcggttcccaatttaaaccttctcattttaacagatcagtcccttaactactatttctgtttcaccttatctcagtttgtttacatccactttctacgtggaattcctttcttccttggctttcacctgttctgtaacacccttcaaggatgagtttatatggtacttctagaaatcctccagcccacagtaattttccattctgctgagattctgtattggatattactataattattggtcgtttttggctataaatttgtttaactatttcatgtgacctaccatagatatgagatttttttcgtccagaaattaaccttcagaaaagagatattctctttatattttacttcttataaagcatttcttgttattaggcttccagggagcttatagtcagttcatgaaaaagggtgaataaatctatgtcaccatctgctagttcaatcactatcatttttttgtagagatcaactgacataattgattaaacaaaaaagaggaatgaaaaatctaagaaagttttagttattgttcctgggaatataatctcctaatttgaagtgttgaaagtaattgtatacaagccttaacattaaaatttttttttgaatcactcacattgcatatgaaacatacacatacattatggggatcacaaataaacacagcagaatgaatgaaaaaaaaaaaaaaccctaatccagtgttatgtaactggactcttgtggtttgaaatgaaatacccagagacaatgtagattcagaaaagtgctgttattaactttaaaatcttagaaaagtagacagtattttctagaaaattcactaaaaagatagctttattgaaggaaaaaacattgatgttaaagatgcatgtgaagtttgaataatacagttttttgaaattacaaaggcagaaaatacattaatactaaatgcttaaatatactgcttaattttaaatatgtgtatatgtgtaaataaatttctaaaagtttgggtattcaggaggactacagagcttcccttcctgtattcctgttttaccttcatacatctgttgttatctgggaaaatatttgggataatcatatgttagttatggcatgtctcaactaagttcttgcaggccaagcatgtcttctttttttgttttccacctttttacctggccaacttctacttattaaaactcagcacagatgttgttgttgctgagcaatcctctggcattgctagtttggattacttgcttacctctgtcacaacattgatctctttgtatagtaaattgtctccctgattaaattgcttgaacttgaggcctgaggctgtgtttttttattttgagatatcaagaatttaagcacagctcctagaatataatggttgctcaaaaaatattaacagtataagtaagtggtgtgtcttttcttgttcttctccatggtgccagtcatagtgctaagatgttgttcagtcaatacttattgaattattaggaaaacattcagcttctgggaatacttcagagaagcaattaaccaagctttgggaagtgtgagatgaaaggaaattcaagtggaatttgcatattctcaggcatactgttgaggctgttctccctctccaaatggcttcctccttaaaaagcccagatgagggagaaagatctctgaaactaaagctggatttctgcatttgggagattaaggtaaaagcttctgcatagcccagagcacagtactgtgcacacatatcatgtgtgagtatacagaaagagattgatgaaagccaaatttaattactgagatggttgtgatgataatcccatttttctcatccagtttccagtctaggtaatggccctaatccaaacaggtattttatttttctttcccttagggatccaaacatctatctcattacaactatgtttaaaatctgaagtaaagctgttcattgaagtagttttagtgcaatatacagaaatactaagaaatgagagatgttattagaaagattatggctgtaatgaacatacaatatcaattaactaactggaatttcatttttgggtgaagaacccaaatactcagattttgttttgcttattcaagttctgtcttgttttacatcaacaaatctatttcctgttcccaataatgttttactttaatatgtacgtgaagcagctacagtgaaggcagtgggatatatcaatgttgcatttagccagtgaaataggtagctagaaatgttaaggggaactgaaatagaattggtactaggaagaagctgtttataggaagagccgtgatccattattgtgtccttggctctgcagctccatagcttctctccccactaccgcccctcccccagccccaggtagatctggagttgattaatagttttagtaaactgactcacactgatcacatttgcttgagattggtctatgtgaatttattaatttacaaaataaattttaactgccaagtgattcaagaatttgaattggccacttactgcttttgttgctttagaatatctatatgggaagcaaataataatctgaaggttgtcaggtgaacatgcagtcagagcagagaggtggtgagtagaggaatgatttgtaggatgggcttattagctggcatcatcaaagtagaatagtctgatttcttctgtagaaatgtacctgtcaagggcataagatcctatgtcccttgaatctgctgggtagggtacagtttcaccttcacaggcatggaggcagtacttcctggcttcccttttctgtactcaatgcaagcttcccatactcttctattctcacggtctttcttcagacatcttagtaatatttagtagcctgcagctttcttttattctaaatatagtgttaaagttcctggcccttttttttttccaattttaaaatatcatctgatatttaatctcatctattatgagtttgtaaattcagacacttggagatgacttattattgacttctcccttgtattgatcacaagggaagctactactttcatggtactgcacctgatagagacgactaagagacaggatgttctattgacatgccggtgttttctctgccccaacacccagaccaaaaattgtgttgggtatgctgtcttattattatgggaagggaatacatgtaccctcggcactatctacatcatcttatttaatccttataatgatcctttgagaaagttattatcctattttaaatatggggaaaattgggccaggaggcttacatggtttgcctgaggtcacatttctagtaaatgccttctttcaaacacatatctgtctgaatgaaaggcttaacatttttccttgttaacaaggattgtttttatactttttattataaaaataaagtgtggtcattactcgaagtctgaaaaaaagaagagtaggaagaaaaactaaagtcattcatagtcccactccagaggagacaaatataaacttgtttactttacacagtgctttgaattagctaagtaacctgtctacagattctaggtgggctttatgccagaatactttttttttttgagacagagtcccgctctgtcacctaggcgggagtggtctcgaactcctgacctcaggtgatccacctgcctcggcctcccaaaatgttgggattataggtgtgagccactgtgcccagcccccaaaatacttttatttgcttatttttattatttcattttatttttattatttcattcataaaccaagttattattaattaaaacatgttaaggtcccaccatacaaccagcacaacactaagtgcaatgggcaatgcaccaaaggactgtgatcaatgattctcagatttggaagttatttcgttcacagcatcttagtttctgcttgacacgtccagtggcgaggagctctcccacatagggtttgctgttcagttttatattgctctggttgttaagatgtggtgccagcccccctcaggaaacgtgcagtctaggggagataagattaaatatatgaaataatagtccataatgcaaaataacatttatttatttatttatttttatgtttttgagacagagtctcactctgtcgcccaggctagggtgcagtggcacaatttcagctcaccacaacctccacctcctgggttcaagcgattctcgtgcctcagcctcccaagtagctaggactacaggtgcgtgccaccatgcctggttaatttttatatttttagtagagatggggtttcaccatgtcggccaggctggtctcaaactcctgacctcaggtgatctgcctgcctcagcctcccaaagagctgggattacaggcgtgagccactgcacacagcccaaaataacatttaattagatgatgatacagactgtcagtgctgtgggagttagacaagtaagaatcgaaggaagaccagccttcaaataaggaagagataagggaacccttatttgttgagcataaccctgagtttgggttaggtgctttaatgtgtaatctcgctgattatcacagcaaccctgaaaaggtggtattagtcccactttgcacacatgagacatgcactttttcctcacctgcattatgatctccctaaaataggtcttgtgctgtattttggagatttcttaaaatagcttttttcttattataaaaatgtacaggatgcagaatatttggaaaatataaaaatcccctgtaatgttactccatagaggtaactatgattattagtttgctgtatttctcacatacgtacagtatttgcacctgtattgcatacataggtgcgtgtgtatgccttgtacatatatatgactgtatacttaaatgtatattttgtatgtcttttatacaaaataatcaagattactatattattttgtttatattctttttcttaaatttggtaatcattgtcctatgtcattaaaattttctttgtaaaacttttttatttacttttttgagatggagtctcactctgtcactcaggctgcagtgttgtggcatgatcatacttcactgcagtcttgatctctcggcttcaagtgatcctcccacctcagcctcatgagtaactgggactacaggcatgagccactgcacctggtgtgaaattttctaaagcataactttttaggtgctacaaagaattctattctgctataattgtgctatgatttataaccagtcaacccctcattagaatttaagctttttataactttttgctaagtcatgtttattatgctttgataaatattcatgcataaaattatttgtttatatttctgatgacttcctatcaagttgtatgtatgttttaagacttgattcaaaactgacatccagagaagttatgccattttatactctcactagtggcggtgtatgatgatacccagttgtagatcttctctccaatcgtgaataatatcattaaaaacaaacatttcctagtttgataggtgaaaaattacctctcatggttttaatttgcatttatttgactagcaagagggggaatatatgttggaatagtcctctaaagtgcttccagccttggaccttcgttttactaagagccataatgtatggagaagagaaggctaaaagactttgtcttatttataatgaattattctgtgtcccatcttttggcagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccggtaagaacagtggaatttctgtgctcctgcagggctttttctcatctcttgtttgtaattagttataatactgtttccatctcctcaatcaaaaatcaaagctttgattcatttgttcatttgaaaaagaaacatttatttaactacttttctaggaactgggtacaagtagcagtgaagaaaacagcgaaagttcttgctctcatggaacttatctttcagtagggagaataggtaataaatgtatgccatcaagcagtggtaaatgcaatggcaggattagaaagtggcagaggtttgtggtactttggacagggtggtcagagatggcctttttggtgagcgtgttaaagcagagccatgagggagtgagtcatccaggcttctggggtcagagtgttccagtcggaagaaatacaaatgcaaagggcctggagtgagggcttgcttagagtggtttagggacagcaggtggctgaagtgaggtgaggacgataggaattctgaatgacaaaaataaaaattgttgagttcttagtggtcataaacatgccccaattttcagttctaaccgacgatatttttcccatgacattcaacaaacctaaactgtatgtttaagtttagcattagggagcactgggcccctggtgtatacttaaaaatggaatttgtactcttctaaacctcctgctttttctctaactcacttagtgtttttcagctctgggaactttcaggaggttttctttgtgtaaactcatgtgtgatgtgtagatggtggcgtttcatgtgccttgctggacttttacagacccgatctagtagacatggagagggtgcaaatccaaagtaaccgagagaatctggaacaggcttttgaagtggcagaaagactgggggtcactcgcctgctggatgcagaaggtgagagggagtttactgaacttgagtaaggaacacgtattcagtattccttcttctggcaagttcctttgttctgactaagaaatttcttgtccattctctctcagatgtggatgtgccatctccagatgaaaagtctgtaatcacttatgtgtcttcgatttatgatgccttccctaaagttcctgagggtggagaagggatcagtgctacggtaaaagaacattttcctagaaggccttctgactttgattcatttgggtgaaatgcattggttagacactttcttaagcacttatggtatactcatggtatcaaactatatatccagtatctttatcatacatggacattatccttggccctggaaatgagtctagatattgctaattttgtaacaattagcatagactatttggtgctaaatgccagcaaagaatgtctctttcatccccagctgtaattcaagatgaggaagtgttttatcagtcacttatgtatcagcttgattaggtagatcatggctcttttcagaatatttttagtagcttggtttgtagcctttcttagtgtcaggaaattgaaccccatcctgagagcccttgaggagctttgaagctagtactgtgagcattaaactgagcagcatctaggcaattaaaggaaatggattttatatagtttggagtggcctgagctactttctcttgtgcttgttttggatattgctaatcaggtgtgtgatgtttaccttctggcaataggaagtggactccaggtggcaagaataccaaagccgagtggactccctcattccctggatcaaacagcatacaatactgatgtcagataaaacttttccccaaaaccctgttgaactaaaggtaaagtcaaggacttaaatttttttggtaaaatctttctagggagtaagtctccaagcttatcactgctggcttctaggtgaggtggtatgaaaaattgggtcctatagtttgtgtccatttattcaccaaatattaattttataggcactttataaccaatatatacacttcaaagaaacagaaattctggccaaggagagagaaaaaggaagaattgaggaattatataaattactagaggtaagtgagcttatcctttgctgagacttggggtttgctggtctgtactgttgttgcttcttgattatagattccttgtattcttttcccaaactgcattaatagaagtactctcctggtgacaaataatagcaccactctcaggctggtcttaaaatgttgtggtaaaggggcaatgtcagccatctctgttttttaaagggcttattgaaaaatgacatgtatttattcagaaatcttgagttttgtggacaaatttttctgcttctcagagggaagctaaatctttccctagggtggaaagaagagagacttctattcagaatttgattcccagagaatttgaagttgtagaaatgagaatttaaccttgccagaataaaagttattgaggggaaaggaggatttatagaaagtgtaaaaggaatggaatgacttagagtaggtagtccctacattctagaggtgacttttctgctctttaactcaagggtgaagaacctgatacatatttgattgtttttccatgttagacaataggaaaaactgctgaatggctgggtaaagaagcaagaagtgatgtgcaaataataaatcaaaactgggacaagagggcatggctgtgtttttggactgaaagagtatctgtttcaggtgtggattgaatttggccgaattaaactgcctcaaggttatcaccctaatgatgtggaagaagagtggggaaagctcatcatagagatgctggaacgagagaaatcacttcggccggctgtggagaggtgggtccagatcctgagagtggtctgacattatttattgagctgctgtgaaccttgcacatgactatggttttatcttatttcaggctggaattgctgctacagattgcaaacaaaatccagaatggtgctttgaactgtgaagaaaaactgacactagctaagaatacactgcaggctgtaagtctctgactgttttgtccaacatctgtgtcacatgtttcctgcttctcaccctctgctctaattgttgaagttagcaatcgaggaatccagatgtattatttccctttttttttttttttggaattgcagtagacttcttggctccctctgtcctagtgagtggggcaatggaagttttcccactgttattctctcttcctgtctcaggatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttaggtgaggaacaagggactcaaatggagggcttgcttgcttactgctgaggctcatggatcaagagtagagcaagagtcaggcacttaatcttttaacctggacatttgaggtcagtgtctcaatggggatactacaggtctcttgggcaggaatgttttgtcagtagaggacagtttccccttattgcagctccatcccactaagtacctataggattacttcaatcattgtggccttttgtaacatcccacatactttattttaattaatcaaagacagggtctcactttcgttgcccaggctggagtgcagtggcacaatcatggctcactgcagcctcgacttcctgggctcaagcgatccttccacctcagcctcccaagtagctaggcctataagtgcaggctgccatgcccagctaatttttgtatttttagtagagacggggttttgccattttgcccaggctgatctcaatctcctgggttcaagcgatcctcctgcctcagcctcccaaagtgctgggattataggcgtgaaccactatatctggcccattctcatatattttagaacgacctgcagggttgggacacaacacaacttctgatttagaaacattggtgatccatcacattctttttataggggggaaaattgagacccacagaagatgaaaattatgtaaagtcatgtggctagttttttttttccccttttttttttgagatggcatcttgctctgtagcccaggatggagtgcagtgacacgatctcggctcactgcaacttctgcctcctgggtccaagaaattctcttgcctcagcctccggagtagctgggagtacaggagtgcaccaccatgcccagctaatttttgtatttttagtagagacggggtttcaccatgttggccaggctggtcttgaattcctgaccttgtgatccacccacctcagcctcccaaggctagttttacagagccaagactaggacccacatctcttgacccctaatccattgtttattatatttgggagttatataaatagtattgttagcttccctccagttaacactgtaatttggcatttgtcttaaaaacaattctgaactagatgaagatgttcataatatcaccttgtattcatataacactttctaaacacttttccttctatgatctcatttttatttttatttttatttttatttttttgagacaaggtcttgctctgtcacccaggctgggacgcagtggtgtgatctcggctcactgcaacctccgcctcctgagttcaagcaattctcctacctcagcctcctgagtagctgggactacaggcatgtgccaccacacccggctaatttttgtatttttagtagagacggggtttcaccatgttgtctaggctggctcatttttatttttatcatatctttgtcaaatggataaggaagattttatttttaaaaactatactatagatttaaatcctttccttttttctcttcttccatttcagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcaggtgggtgcatatccaaaagcttatgcagtacactgatgtttactggatctggaagcttatctaagaggaccaaattgctttgtgttccctgtgcagattcccttaattattattattcttttatttgagtgatggggtcttgctatgttgcccaggctggactggaactcctgggctgaagtgatcctcctgcctcagtctcttgagtagctgggacaataggtatatgccaccatacctggcttgactttcttaattattgatgctgcctgagacccaagcccccttctccttaaatcttgcatggatgaggttggcacaaattctcacagtcccgtactgaatagcatacagttttctcatttgaaaccctttggaatcttttccctcagctaactgtactctgagtgagagcttggtgaaaattgcaatgtctttacatctgttacctttttttttaattaaaaaaattttttgtgggtacatagaaggtacatatatttatacgatacatgagatattttgatacaggcatgtaatgcataataatcacatcatggaaaatgaggtatccgtcatctcaggaaatttatcctttgtgttacagacaatccagttatactcttttagttatttaaaaatgtataggctgggtgccgggtgcagtggctcacgcctgtattcccagcactttgggaggcctaggcgggtggatcacaagctcaggagatcgagaccatcctggctaacatggtgaaaccccgtctctactaaaaatacaaaaaactagccaggtgtggtggtgggcgcctgtagtcccagctacttgggaggctgaggcaggagaatggcgtgaaccagggaagtgaagcttgcagtgagctgagattgtgccactgcactccagcctgggagatagagtgagactccatctaaaaaaaaaaaaaaaagtacaggctgggcgtggtagctcacacctgtaatcctagcactttgggaggccgaggtgggcggattgtgtgagtccaggagttcaagaccagtctgggcaacatgcgaaatcccatctgtatggaaaactaaccgggaatgatggcgcgcaccggtggtcccagctacttgggaggctgaggtgggaggatcacttgagcttgggaggcagaggttgcaagtgagccaagatcgcaccactgcgctccagcctgggcaacagagcaataccccatctcaaaaataaaacattaaacaaaaaaatgtacaactaaattattttgactatagtcatcctgttgttctatcagatgctaggtattattcattctttatttttttgtacccatgaatcatccccacctccctctgatcccgtaatactcttcccagcctgttttgatttatacatcccacagctaagtgagaacatgcattgtttgtctttctgtgcctagcatatttcacttaacataataacctctagttccatccatattgttgcaaatgacaggttctcattcttttttatggttgaatagtactccattgtgtttaagtaccacattttctttctccattcatctgtgatggacacttaggttgcttccaaattctggctattgtgaatagtggtgcaacaaatgtgggaatgcagatctctttgatacactgatttcctttcttttgagtatatacccagcagtgggattgctggatcatacagtagctctattgttagtgatttgaggaacctccaaactgttctccatagtggttgtactaatttacattcccaccaacagcatacgaggcttccgttttctccatatcctcaccagcatttgtatattgcctgtcttttggataaaagccattttaactggggtgagatgatatcacattgtagttttgagttgcatttctctgataattagtgacgttgagcaccttttcacgtgcctgtttgccatttgtatgtcttcttttgagaaatatctattcaaatcttttactcatttttaattagattattagtttttttccagtagagttgtttgagctccttatatattccagttattaatcccttgtcagataagtagtttgcaaacattttctcccattctgtgggttgtccttttttttttttttttttttttttttttttttgagacagagtcttgttctgtctcccaggctggagtgcaatggcgcaatctcggctcactgcaacctttggattctaagcaattctcatgcctcagcctcccaagtagctgggactacaggcacgcgccaccatgcccagctaattttgtatttttagtagagatggggttcaccacattggccaggctggtctcgaactcctgacctcaggtgatccacccgtctcggcctcccaaagtgctgggattacaggcgtgagccaccacacctggcctgtccctttcctttgttgattcactgtgcagaagcttgttaacttgatgtaatcccatttgttcattttagctttggttgcctatgttggtgtggtattattcaagaaactttttcctagactagtgtcttggaaagtatttctggtgttttcttgtagtagtttcatagtttaaggtgtttatccattttgatttgatttttgtgtatgatgacaagggacagggatcaagtttcattcttctacatacagatatccagttttcccagcaccattaattgaagagactgtccttaccccagtgtatgttcttggcacatttgttgaaaatgagttcattgtaggtgtatggatttgtttctgggttctctattctgttccattggtctatgtgtccatttctaggctagtactatgctatttggttactatagctctgcagtataatttgaagtcaggtaatgtgattcctccagttttgttctttttgctcaggatagctttggttattttgggtcttttgtggttccatataaattttagaattttttttttatttctgtgaagaatgtcttgtattttttatagggtaaatctgttttttttttttttttattctctcattgacagaggagtttattcttcgtttttcattgttgatgtaactttttttttttttttttttgagatggagtttcactcttgttgcccaaactggagtgcaatggcacgatctcggctcactgcaacctctgcctcccgtgttcaagcgattctcctgtctcagcctccctagtagctgagattacaggcgtgcgccaccacgcccagctaattttttgtatttttttttttagtagaaatggggtttcaccatgttagccaggctggtcttgaactcctgacctcaggtgatccgcccaccttggcctcccaaagtgctgggattacaggagtgagccattatgcccagtctcaacttttttttttgagacagagtctcactccgtcacccaggctggagtgcagtggcgtgatctccagtcactgcaacctctgactcctgggttcaagccaagcaattctcctgcctcagcctctcaagtagctgggattacaggcgcccaccaccatgcctggctgatttttgtatttttagtagagatggggtttcaccatgttggccaggctggtctcgaactcctgacctcaggtgatccacctgcctcagccccccaaagtgctgggattacaggcgtgagccactgcgcctggcaatcgtaactcttaagtttaagcaaggctactgtattccgcagttccaaggggcactatttacatgtgttcaatgatagtggttcaaatttgatattgcccttatctttctaacccttttgttttatattaaattcttcctatgtctgcataatatattccccatgtaacaataaataaaaatatcccaaagtaacctgttttaaaattatcttccattggccagtagttgatgtcatgaaatgaagctaaatattttcagatacttctttgttatatcagttatgattgtgaaatgaaaagactccataaagagaaatgcctaaactgtaaagttaagcattttaagcctgtgaagttccctttcccttttggttgattactccaggaatgtatactaataatgcagcagcaaaaggctgctctgttgtataattggtgggctctgttctcctgcttcttagcggtgatgatggcgtaatttttgtgtaagaggctgtagattgaaggagatggcctggatgtccttttgctcagtcctctaccccttggttccttgtcctaacattggttctgaccattttcctaccaagccagcagtaaattatgtcatatatatattttttctttttcagatgaaactggagcgagcagagtggggcaatgacctgcctagtgtggagttgcagctagaaacacagcagcacatccatacgagtgtagaagagctgggctcaagtgtcaaggaggccaggttgtatgaggtgcgtagccttcagaatccacattacaggagggacgtggttggaacggatgaaaggacagtacacacaataaagctgtattgaaggaggagggtgctctggaaaagaataatgatgatgaagagcggtttatgacaaattcccttttcacatgaagtgtatctgttaatctttgaaataaacttgtgagaaaagtatttttattaacccctttttactaaaatgaaaagtgatactggaagctgaggtcagaattagtaagtagtggatgcagcatccaaactcaggccctctgcctctataaattcaggcactttttacttccccatctgcctgcagttgagcgctggtttagagaaactattcacacagtttcctctctccttcagtcactgttctatcttcccagtttatatttcaactcttcccttcaaaaaagcagttgagtgggaatcaggcattggttttgcttagaagcctaccagaattgctggaaacacaggatagtgaggtctgttgtttgtaattaccctgctcaactgttgctcacttagtgctgctccaagttataaaatatgactcagaaatttgttgtctaagcttctgttttcttagagcaaccaatccatatctctatctagacataatatttgcatagttgcaaccataacacgtagtttacttactctttctctaatgtatttttatttcattcttttttaatcagggaaagatgtcccagaatttccataccagctatgctgaaactcttggaaagctggagacacagtattgtaaattgaaggtgagtttctgccgattctcttacattctgctcatagagtctggttccccccaatcaactctcttccgtaattcagaaatctcctggtttggccctgttttggttttctgcttattaggttatatcatttactatgcacttattcatatctattataacattttcccaattttctaaatgggtcagaaactactgttcttgaacgttttaaataaatagaacctatcctaggtattgtgcttcaacaaacgtgtggctatatgtgctttgagacaccaaaactaaaagtttgagatttgtagagaggggactttccctctgatctgttgtttttcatccctgtttatcaagattgtccagagtaggacagcccaggaccattctttatccaaggagcaccacaaaggccttatgaattctgttttctacttaggattgaaaagagttctgggagtcttatatcaaacttgtacaaaacttgaatccatggggaaaaatccagagattaagagcaaattaatttcctgagttattctctcctttgatgtcaaatgtgctatcttctacagatacaaaggctgccagtctaatcttataatccttgctttgtctaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgtgagtctagcacagtagcaggcctgtcatacttatttaacagcagcagaaggagacagggcctagtctgctgaaagcttgggtggctggagttgcactctgctagatagaaataggggccctactcaatgcatccatgcatgtgagaagtgtaaatggagagagggacagtagaaccctagagttaatttatctagaatgcatttagaaaggcagtgtcttgggtgaatagagcagcaacctgtaaattgagtcatttcagaagcaatacagcattgtggttaagattataggctttggagtgcctaagttcaaattcttattcttctactaactagctctataaccttgggaagtcatttaatctctctggacctccataaaatgagataatagcaccacttcaaagctaccccctcccctaatagcacgtattccccaacggttgcataaaagattaagatttaataagctaatctagacaaagcatttagtctagtattgttcaactgggatatactctggactttccacaaatttctgaattctccttaattcatttattaacttttttgtttcaatctcttcgtttgtaaaaatgggaagggaaatttaacattggacaataggacactgctttttattcttttcaatgaaagatgtagacaagttaggattagtttttgctacttttagtattttcacactcagaagatttttaaagattttgtaaactatgcaaatagggagtttcttgtttttgtttttaacatgcactttagacagtttaattctattgatttagggttcttaaaaaatataggcttcttctgattggagaatggcatatgattctactgaattaaagaaggaagattggatactataatacaataaacaggctgtgtgagaactgaaattaggctataacagagatataaagaaagtgctctgaaagcatagtaaggatcagtatccagcttcacagaagagctatttaaattgagtcctgcagttaatagaatttagagtcagtggaggacattgtaggctgaatagtctaagcaaagccaaccagtcattgatacccatgtcctggtgtgtcatgtactggtgtgggtactgacgtgcaggaactgtccactccagccaagttatctcttgtctctggtccaatgcttattctgtgttcccccattttactcacatctgggtcaggtcccatgtcctttgtgaatcattttccaataattccagtgtttgtgcccttctctgcaatcctctggcatgcactgtttatacatctcattttgccaccaattctatattgtaggttcctttaaaatagggaacacagcttttatttatgctatccgctccccactgccaagagtgcttatgctgtaaaattgaattccattttcaggagttgacaatggaactggaggagaaacaggatgtgtttcgttctctacaagatacagcagaactactttcacttgagaaccacccagccaagcagacagtggaggtgtgtgacttgagaatgtgtgaaggtcaaatgctgagaggttgttgttataaaagtattcaaattagagactttgttccactgaaagacttggaggaagtgtcagggaacatttgtcttgggtcttctctcttttcattcctgactgttcctatgtccctcaaaagcctgcaaacatttttgttagtctaaggaaactactaagagaaacaatagaaggggcattggctcacagctttcagaggaaaagtgacttggaccatatttcttcaaataactatccagacagatcctgacttgactcttgttggtgtggtgcctttgccaaaagaagagaaacagtggaagaattccagaggaatttatttatgcctgggttttgctgcctagatcatttacttacaactgagtgtggaagagaccttttctatgtaaccccctctaacaaaaccattttggattaaaggaacacctcttactcgtgggaagcattgagcagatgccagtcaagtatctccacatcttttctgttggcttctctatcattagcagagttgtacttggaaaatagtattgcgcatatatattgagtctgttaaactcaagcccttctgtctgtgtgcttgtttattgcaggcttacagtgctgctgtccagtcccagttgcagtggatgaagcagctgtgcctgtgtgttgagcagcatgtgaaagagaatactgcttattttcaggtgtgatggatttctgtgtttgtgtgtgtgtgtacatatgtatgttaaaggtgaggttacaaacacatctgcgttagtgtgcttttgttgtataaaccaccaccttaaaatttagttgcttaaaacaatagtcatttagatagctcatgattcagtaggtgagcagtttgggcagggctcagctaagtggttcatcttatcttgcctgtcttactcatggctgcagacaggctgggggctggttggtcccaaatggcattgctcatgtctgagagttggctaggtgctgaagcaccaacccatgtgtctctagcatccagcagctttcttcacaaagtggctgtgtttcataagcagcaagagagagcgagtcctagagcacaagtcctttttttctgcttgtgtcacatttattaatgtgcctttggttaaagccagacatgtggctgtgcctggcttcaaggtgaggagaaatagactccacctcttgatgggagtagctgtaaaatattatgaccttttttttcttttttcaatctgtcagaacatgaaagagtgtactgctggccgggcaccatggctcacacctgtagtcttagcactttgggaggctgaggcaggcagatcacctgaggtcaggagttcaagaccagcctggccaacatggtgaaaccccttctctattaaaaatacaaaaattagctgggtgtggtagcacacacctgtagtcccagctacttgggaagctgaggcaggagaattacttgaacctgggaggcagaggttgcagtgagccaagatcacaccactgcactccagcctgggcaacagagcaagtgtctaaataaaaagaaagaaagaaagaaagaaaggaaggaaggaaggaaggaaaagaaagaaagaaagaaaggaaggaaggaaaagaaagaaaggaaggaaggaaggaaggaaggaaggaaggaaaagaaagaaagagagaaagaatgtacttcttattttcaggtgaggtgggaggagaaaataagctgttacctctgtttttgccctagatttttttttgagacagagtctcactctgtcgcccaggctggagtgcagtggcacgatctctgctcactgcaaactccgcctcccaggttcatgccattctcctgcctcagcctctcgaatagctgggactacaggcgcccaccaccacgcccggctaatttttttgtatttttttagtagagacggggtttcaccatgttagccaagaaggtctcgatctcctgacctcgtgatctgcccgccttggcctccgaaagtgctgggattacaggcgtgagccaccgcgcctggccttttgcccctaaattaaatagtttccgtgattatttcatagtatgaattgaaacatttgatcactcagccttaggtttttcatgaaatacaccccacagccaaatgctgtacctagccagaagtcaagaggaaagagcagtgatttctgagggggtgaaacaggctaacttttcggtagggtagggtttggggtagtcagcactaatattttgctgcatggctttttaagcccttcggtttatgtttcagtggtccttgtaataaactgtcactaatgcagtagggtgtaatcagctttgctaagctctgcacagtaaaattgttctttcttagttaatattccggtgttctaatgttttgagcagaaggcatccttactttgtattcccatagttcttcagtgatgcacgagagctggagtcattcttgaggaacctccaagattccattaaacgaaaatattcctgtgaccacaacaccagcttatcccgccttgaagacctgctccaggactccatggtgggtgttgcctcagtggggatgattacttctgagaaagagagtaaaccatatcagctgctgctgtttatatccttgaaagctccagggcaatgggccattgttgtaataaagtttggcttacattcaaatagagtttaatcgatgttgttctgtctctttcctttttttccttttcttttcttaaataagttgctaataagatttctttgggtatgttattgaagtaaaggcctagtcttctcctctgagccactttgagctcattgtactttctttgcatttttcttattttaatgtaatagttggagccaaggatgaggtgttgagcatgaagaaaaggttgaaggggattagttgatatcaaattcttttttactctcttatgcaaaaaaaaaaccaacaacaacaacaaagaaatacacctgagtcaaaattttcctccttggtagttttcttttggatgataattaaaattgattttaattcaaagaaacattaaaatcttatttagatgtaatatttgtgcagttatttatgaagcaatattaatttttaagaaatagttttacatttagtatttagttcaaatcaattttatattctttttctccaatgaattatttcttcaggagtgctggtaattaaattagcagaaagactacttatatttagtgaatgtatattacacagagttggcaagacaaggctcaagctacatctcaaattaaaatagaaatgtatatgcaatagggaacttacttttcctttgtgagaagtaaggggaatctcgcatttcaatagaaaagtctgaataagagaactagaataacccaaaacagttcattttttttgtcggtaaaatttgagcatttgtgaatttaagtttttttatttttatttttttacactttcaggtattgtaaacctatgagtggttttacattcacctgggcaaataatctgttaatttaattaatttggaatgaaggatgaaaacctgacttttcagatgttgtctctaaaatgtctctctcagaggtactgcaagtatgaaggaggaatataatcattggctattatctcctccctcccacagagtaccttctgtcatagggtaactcctctgcagtggttgtcatatcttctcttctcgagggtcgctgctctgttccctcctctccaggtcagggtcatcgggttggcggcgtcatcggggcatggagtcacctgggtctgctcctcagcttgtccgtcaggttcgggagcatctgtcctggcttctggttcttttcagaacttttaccacgctgagcacttggtctctggagcttgagctgtttggctgtgggttagacagaaattgacatcttattgcaaggaaactgaaatgggtagaccagctctcaagtatggaaatgtggctgtctccctgatatattccattcctctttcttaactaataagttaaagttgtatttcttccaatcatgctcccggggacaggcacaggtagtttatttaagcatttctttttctttacttgcatattcttagttctttaatggcatttcctaacattattaactctttactctcatcgcatctacatccatcctaagaaagccctcttctggggagacttttatacctcaaaatgggcttgaaacatccgggttaatggacaaagtttatcttttactctttaatggaattggtaatggtttactaccaattttgttaacaagaagtttattcatttttaagattattggatttgcagagatttgagagtttcaattttgcatgatacttctttctaaccaatcaaatttatatgaatatagcacagcaaatactaagaggtaaaccctaaatcatttgtcatgataccttcaccaacagcattgttggttgaagagctaagatctttctctagaaagcttgactcaatttaggaaaataaaatatttggagtagagcttgggagatataattatttttaaaaatttaaataagtataactagcttctcctaagcagaaagggaagaactggtttctaccagtgagaaattgactaataataatatacctattattgattttaactttcatgttctctgaatcatgtttagatagattttttattagctttgtagctgtatttggaagctagaagtatttgtttttattttgatttttgcatgtgactttatggttcattgaaagtggcacagggagaaagctgcaaagtttgagtgcgaaagcacttggtagaagacagaagcattctctccttttttctttatcattgtctaagtctttaagatggctccaccaaccatccctacttaactgagagatgacattctctgagggagtggagtattcagttttctttgttgacttagtcaccctgagtagcagcattaatgtcattttgtttttcttatcattttgtaggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgaggtgaggaggtagaaagggtacctctgggccacagggggaaggaagaaagaagggaagccttcagttagggttatgatgataaaagatcaaattacagcgtttttaaaattagaatttaaacatgctgaagtctctcctatcatttaaaaaaaaaaactaaactaaaaacttcaacactataatcttgacctgctccctgcctcagtgattggcatcattatctactcagttgcctaagtgttgacagagatggtactttgtagcacttgggagatatccttgactcccccacccctcttatcctccacagctaataggaccatcaagtttgtactaatttgtaaatatcccttaaacgtactttttctatccctgctaatattaccctaagagcataagtggctgggtggagaggctcatgcctgtaatcccagcactttaggaggctgaggcacatggatcacttgagctcaggagttcaagaccagcttgcgtctctgcaaaatatacaaaaattagccaggtacagtgacttgcagctatagtctactcgggaggctgagacaggagaatcgcttgagccgaggaagtggaggttgcagtgagccaagatcgcactgtttgcactctagcctgagtgaaactctgtctcaaaaaaaataaaaggcataagtttctttcacttggattattgtgtcagcctccccatttagtgcacaaaggatcctaccaccagcatgttctttttttaattttaattttatttatttatttatttatttgagatgaagtctcgccctgtcgcccaggctggagtgcagtggcacgatctcagctcactgcaagctccgcctcccgggttcatgccattctcctgcctcagcctcccaagtagcggggactacatgtgcccgccaccatgcccgcctaagtttttgtatttttagtagagatggggtttcactgtgttagccaggatggtctcgatctcctgacctcttgatccacccaccttggcctcccaaagtgctgggattacaggcgtgagccaccgcgcccagcctattttattttattttttgagacggagtctcgctctgtggcccaggctggaatgcagtggcgccatctcagctcactgcaacctctgccccctgggttcaagtgattatcctgcctcagcctcccaagtagcagggactacaggtgtatgccatcacgcccagctaattttttgtatttttagtagagacggggtttcactgtgttagccaggatgttctcgatctcctgacctcatgatctgcctgcctcagactcccaaagtgctgggattacaggcataagccactgcgcccagcgtttgtttgttttttttttcctttaaataacaatcctatgcttaaatcttataataattactcattgctcttgggaaaaagccgaaactccttaatgtggctttaagttcttgagtaatctgtctttacctctctagccaagactgggtcatatcctttattgcctggtaaattgcatttgtcacacagtattataactacatacaccaccagaatatgtggaaatacagactatgcttgtctgcttaccactgtacctatttatttatttatttatttatttatgttttgtgacagggtctgactctgtggcccaggctggagtgcagtggcactatcatggcttactgcagccttgacctccctgggctcaggtgaccctcccacctcagcctcccgagtggctgggactacaggcatgcactactatacccggctaatttttgttattttttgtagagatgaggttttactatgttgcctaggctggtcttgaactcctgggctcaagcagcctgcctaccttagccttcagaagtgctgggattataggtgtgagctgctgtgcctggccaattgtactgtttttatctccagtgtcctagcacatagtagacactcaagaaatatgtattatacaaaagaatgaatgaattaagaaatggaaaaaaaatttaaaaatgggactgtgcttttgtgtgtctcgatatttctgcctgtaagttagggataatagtcttgatcacttgcctctaagagaaagacttgataattccaaaatgcttaaacattttcaggggtttgggtgggatgataggaagtagggagaggaaatatcataaaaacaatgttttgattattcaccttccattagtttttactctagtagatttttgtgctgagatcgctcttgagcctttatagtcttattataactttcatagtctgggttacttgacatgtaacaggtatttaatacatacttatttccttgatttatttggtgtcacagtttttcctgtgttgtagatttatacccattatcttttggcaaaaatcagaagccctcactaagtgatagcagatcttttcttaagcagatttttttcttaaggatttgatagctttgggatgaggcaccaggaaataatgggttgttggtttatccattagcaatcactggtaaatttatctcttcagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcaggtaacttggctcagctgccactggtacacccacctctgctgttggcctcggtgaaccagtggagggatgagtgtgcatttgtgatgtttttgaacacagtggtaaagttcctcctgggagaggcttctcattggagatatcaagtctcctactaccagccacatagtagatcttcaataaatacttctgttcagctggagtatcttcagtgatatttcttttttaaagaactcctggttataaatagtttactctcagaagattgatttttttaccagcctggtcaacatggtaaaacctcatctatactaaaaatacaaaaattagctggatgtggtggtgcacgcctgtagtcccagctacttgggaggcttaggcatgagaattgcttgaccaaggaggcggagtttgcagtcagctgagattgcgccactgcactctagctgcctgggcaacagagcgagactctgtctcaaaaaaaaaaaagattgggctgggcacagtggctcatgtctgtaatcccaacactttgggaggccgagggaggcggatcacttgaggtcaggaggtcaagaccagcctggccaacacggtgaaactccatttctactaaaaatacaaaaaaaaaaaaaaaaatttgccgggcgtgatggcaggcccctgtaatcccagctactcgggaggctgaggcaggagaatcagagaatcgcttgaacctgggaggtcgagtttgcagtgagtcgagccgagattgcaccactgcactccagcctgggcgacaaagggagactccgtctcaaaaaaaaaaaaaggttgatttttttctgggtcattagttatcattagtttattataaaagagatatggaaattatttacatgatgaaagatttcagaacttcagtggaatgggcagcttcacgttgatgccatttctttcttttttttttttttaattatactttaagttctagggcacatgtgcacaatgtgcaggtttgttacatatgtatacatgtgccatgttggtgtgctgcacccattaactcgtcatttacattaggtatatctcctaatgctatccctcccccctccccccaccccatccccccaccccacaacaggccccggtgtgtgatgttccccttcctgtgtccaagtgttctcattgttcaattcccacctatgagtgatgccatttcagtagtgacttatttcactctacgtgctttccaagaatgtcaccgtctctaaataggaaataatccttgtcatctagaactactttggtgcctccatattgtgggagaagaactttatctccaactttcctgctaactggttgaccctctccaccctttcctttagaacctgatccaacagcgactactgttgcttgaaatacttttccttgagatttttctggaagcataatgcctcctttggttacagtttcagcaacactcctttcaaattttcttttctttctttttttttttttcttgagacagagccttgctctgtcgctcaggctggagtgcagtggcactatttcagctcactgcaagctccgcctcctgtgttcacgccattctcctgcctcagcctcctgagtagctgggactacaggcgcccgtcaccatgccctgctaattttttggattttagtagagacggagtttcaccatgttagccaggatggtctcgatctcctgaccttgtgatccacccaccttggcctcccaaagtgctgggattacaggcgtgagccactgtgcccggcctgagtggaagaaactttctaaacgtttgtcctgccatgactgtctctgtctcagactctgaattttttttttttaatggcagctgattttctttaatttttattaaagtaatatatgggccgggcaccatggctcacgcttgtaattccagcactttgagaggctgaggttattggattacttgaggtcaggagttcgagaccagcctgagcaacatggtgaaactccgtctcactaaaaatacagacaattagcctggcgtggtggtgcatgactgtggtcccagctacttaggaggctgaggcaggagaattgcttgaacccagggtgtggaggttgcagtgagctgagatagtgccactgcactccagcctgggtgacagagtgagactctgtctcaaaaaaaaaaaaaaaaagtgtgtgtgtgtatatatatgtatatatgtacatattttagaaagttgggttatactgcaaagtttattataataaaaattagctatcacctctcctttcccaaagttccacattccagagtcaagtgttttcagctgttttagcagattttgctgggttataaatccacatttccaaatgtaattttttcctgctatttccttgtttgttttcaacttcagaaattatctattaacttcttactctaggaaattaacatttagctttctatgcacacatatatgcaaacacttcttccgttttccaaatgtggttatgtcacagtttttgtttaagttgctatttttgttttattagtacatgtgttgtttaaagctgagccacatcttactctaggggactattgtgaggcgactgtgccttacctctctgaactcatcctctgctactctccttgcttgtacttagctgcagtcactctggtctttcctctgtttctcacacacagacagcatattcttgcctcagggcctttggacttcctgcttgcctctgatatttacatgtttcactccctcactttgttcagtttatcttagaaccctcatggaccaccatccccactaactgcatgccactctctgtcttctttactcattttatttttcttcagaactcttaatactgcctaacagattgtgtgtttgtttattctctcctattagagatttttgtccattttgtttacctctgtatctttagcacttagaaccattcctagcacatagcaggtattcaataaatggttattgaatgaaagaatgaatgagtaggtgagtgaatatatttatgaataaattattttatttactttctttacttttttttttttttggtttgagacggagtctccctctgtcgcccaggctggagtgcagtggtgcaatctgggctcattgcaacctttgcctcccgagtaagtgggattacaggtgtgtgccaccacgactggctaatttttgtatttttagtagagacggggtttcaccatgttggccaggctggtctcgaactcctgacctcaagtgatccacccacctcggcctctcaaagtgttgggattacaggcgtgagccactgcacctggcccctgttttatttactttcttatataatttttgtttccttggagtgggtaattgttttgttttttagtttgcttagttgtctccaaactctcctacattactgtaaaaggattcccaatatggccaaacaccacaggcaattttcatttttcttttggaaacatttattctggaccattctatcttttttttttttttttttagtccggacctgttctgtaggcctgattcagtcagtactgtctctgtgatacgtggacccactaattactagattccaagtcttatttattagtgtactccctggtttggtggattacactctccaatgccttactgaaaaaggctgagtaggaggtaaattttttgaaacctcttatatctgaaaatgtctgtcttcttcttcctctaactggcaagatacattttttgaaattattattattattattattattattattattgagatagagtcttgctgtgttgcccaggctggagtggagtgcatggtcttagcacatggcagcctccacctcctgggctcaagtgattctcctgcctcagcctgccaagtagctgggatcacaggtgcatgcccccatttccggctaatttttatatttttagtaaagacagggtttcaccatgttggccaggctggtcttgaactcctgacctcaagtagtctgcccgcctcggccttccaaagtgctgggattacaggtgtgagccaccatgcccgcctggaaattatttttactctgaactctgaaatcattgctctattgctttctagctttcaggatttcttgtttagatgtatagtgccattttcattctttctctttttttttttttagatttacataatagtaaaactcatcttttgtcataagcagtactattggttttgacaaaggcttagaattgtttatcgttcaccactatcatgatacggaacagtctgatacttttaccttttgaaagaaatctttatttctctgcaagtgtttaagtgcttctctttgtctctaatctttaaaagggatgctgtacctttgagtctttttgcattcattatgctaatgaacacaaactagaaactcgtctttcaggtctggagaagttttttcttggatgatgatgattattattattattttgagacagtctcgctctgtcgcccaggctggagtgcagtggcgcgatcttggctcagtgcaatctctgcctcctgggttcaggcaattctcctgcctcagcctcccgagtagctaggactacaggcacacaccaccacacccagctaattttttgtacttttagtagagacggggtttcgccatgttggccaggctggtcttgaactcctgacctcgtggttcacctgccttagccttccaaagtgctggaattataggcatgagccaccttgcccagtctggattatttctcttttctttctttctttctttttttttttttttttttttgagatggagtctcgccgtgtcgcccaggctagagtgcagtgacgcaatctcggctcaccgcaagctctgcctcctgggttcactccattctcccgcctcagcctcccgagtagctgggactacaggcatctgccaccacgcctagctaattttttatatttttagtagagacggggtttcaccatgttagccaggatggtctcaatctcttgacctcgtgatctgccctcctcggcctcccaaagtgctgggattacaggcgtgagccaccacgccagccttatttctttaattatttcattctccttgtttttagttcttgcttttaagaattcccatttgttgaatgttggacctcctgaactaattttctaatgttctcttattttctattttttttgttgttgcttttttatatttttattcttctttgggatttcctgaactttgaatttcaactctactgaaattttagtgggagttttggagagagggaagattaaacttacggatttaatgcctcctatttaactgatgtcctggcttctagttttccatcctgttctttatatctcacatttttttctcaacttgaagaaattcaaggtaacgtggtgggtatgtaagagagtgtgtctgtgtatttgtgtatttgtaagtcttcctgaaatcaagattgaattagacatgagatgcttgggaaagaaatctcaaacccttcatacttcagttttcttttttttttttcttgaaatggagttctgctcttgttgcccaggctggagtgcaatggtgcgatcttggctcactgcaacctccacctcccgggttcaagcgattctcctgcctcagcctcccaagtagctgagattataggcatctaccaccacacctggctaatttttgtatttttaatagagatggggtttctccttgttggtcaggctggtcttgaactcccgacctcaggtgatctgcccgcctcagcctcccaaagtgctgggattacaggtgtgagccatgcagttttcttttatataccaggtgaatttcttaagctgctattaatttctcaacattttagcatttttgtaaatatttggaacacagcaaatcagtttttaaacattgatataatcctttttcaacaattctggatgggatgttgtttatgcctttccctattattgttctctctggttatttcttctctctggcttgtaatcatcatattatatccaggtaacatttatgagattactaaatatgtgctaacgttaatatgcataatgctgtagcaaatccaagttgaagatctcaattaattaatgtagtttagtttttttttttttttaaatagagatgaggtctcactatgtcgcccaggctgctcttgaactcttgggctcaagcagtcctcccaccttggcctccaaaagttctgtgattacaggcatgagctaccacgcccagcctcaattaatttagttctaaaaattcctgagatgctagtatttgacttgttgcctttctctgctcaacatataagctcaattctgctaaggcaatcacatttttccttagaaggtctctaatgtggagctgaagtcttacaaaggtaatagtcaggttctgtgttatttctagggtcgaacaatcttatcagaaggttatggccctttggcatcagctgcatgttaacaccaaaagccttatctcttggaactatctgcgtaaagaccttgaccttgtacagacctggaacctagaaaaggtaattatgaaaaccttaccccaggcttacattccattggcaagattttttcagaaggagcttttttcattactgtgagacttttccccacccaaatggagtaaagtggactcaggaataccattttagagttcgagacctgaggttcttacaagctagaagcagcaatttgaatggtaaaggaaattcctaattagaataagtaacatctttggtcttcttggcaagggtagaaggttgcaggctttttctcactctgtaagacaatcatgtcttttgcataagaatatgtagtaggtgaatacttgtgaacaattattaagagttatgtccagtggggcacaaagggtggttctggggtgctggtaatgttctgcttcttaatctgaatgctgactaaatggaggaattcaaattataaaaatcaacatgtttacgattatggtttatgcactgttttgtatatatgttacttcagtaaaatggaggaaaagaggaagtgttacatttttattctgttgcaatttcttctggctttttctttctagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatggtgtgtgcactgggaagagggaaagagaatagtagaatgagagcctttcaaggggttgctgtgaaacccttcatataaatgagagagtaacatcaccacttttttccatttgagtagctacgaacttgagatagagaagaacttatagatgaattctcaaaatcagatcatggaagaagtctgttgatatttcagtcattactgctcatcaacctatcacattttcttgtggctgtaacatgtttggactctcaaagattagtatacagtatgtgaaatttaggatcaggtaggattaggcagaagattccctaaataaagccttgctttcattagtaggatatcaggtctgcttatctctgatgtcgagcttactggtcttttgtgtttgttcattcacagaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagaggtaagccctaagagccatgtggatgctggttgtggagtgaatgctttcagagttcattggatggcaagagtatggcacctaagaaatgaggcaatagactcaagacagtccttctcaggagttcttcttgcagtctataaatgtcttttacccgtggagaagtgtgatttcagctccatgtgtattgctaaatgttgattagtttcctacagagttgagaaggcaaacagactagtaaatttttctaagcagtatatttgggctatgtattttgaaactgcttagtagagatgctactcttttattctatcccttatgtgcctgtgttactttaaatgacttggttaccttcagtcatatgaccaataaatataaggaatgactctgatttgaatgtgggctctgatacatgctctgtctgtgactttgagcaagtgagctctcatccctagtttactttcttgtaaaatggagatggcaatgcacgatatagggttattttgaaaattaatggtatagtacatataatgagcttcctgaaaaagtaaaatactatgaaaatgtaggatagtattcttgaagtaaaagtagcaaatattttttgctttattaagtcctctgaggcatacaaagaaaagtaaataaagatccttgttttttggcttatagtgtagtgaaaggaaaataaaaagtcgaagttacaattggagacttcagtataagatataagaaatgtcatgaatagtaactagtgtatttccaagcaaagattgctgtaggaacttagagtgtttctagaacatttctaattagaatggtatgagagagctctatgaaggctattaaatttgatctgggagcttaaaggggatggaaaggaatggctaatgaggaggagtgatttttctaactttctattttttccccccaaacctgaagagaagagtgagagggaagtatgatttttactggtggagagggaggtaatatgaggcatatcatatgagcctgggaattctcatgtggaagctttttacttttctatagggtgatacaaaatctatttgtccctgaaaaatagaactcactaagaaataaaggttgactgcatgctttgggaggccgagatgggagaatcgcttgaacccaagagtttgaggcttcagttagctataactgcaccactgcactccagcctgagtgaaagagaccctgtctcaagatacatatatacatacatacatctaaaatacctcttcctttttaaaactttattttaaaataatttcagatatatagaaaagttttattctcttatacctttcacccagagtctccaaatgttaccatttttgtgcatttgctttatcattttattctatatattatacataataacattccttttttatcttgagagtaagttccagacatgaagctcctttattcctaaatacttcagtgtgcatcttcaaaaaacaagggcagcctcttacataaccacagaacaatgataaacatcaggaaattaacattgatacgggttgagtgtggtggctcacgtctgtaatcctagcactttgggaggctgatgtaggcggattgcatgagaccaggagttcgagaccagcctggccgacatggcaaaacctcatctccactaaaagtacaaaaagtagccaggtgtggtggcaggtgcctgtaatcccagctattcaagtggctgaggtatgagaatcacttgaacccgggaggtggaggttgcagtgagccgagatcacaccactacactccagcctgggcaacagagcaaacctgtctcaagcaaacaaacaaacaagcaaacaaacattgatataatactgctatccaagctcacgcctcattaaaatttcatcagttgaccaaataatgctctttacatcctcataccatccatccctagctaccccaagaaggaaggtccaggattcagtccaggattacatattgcatttggttgctgtgtatcttcagatttctttaacttgaaatagtttctcaactttccatcatctttcatgaccttaacattttttttatgagtgcagcccatttattttgtagaataaatgtagaatattttgtccttctgtttgtggttacctgaggtttcttcctgattagtgttaggtcttacaattttggcaggaatcctgcagaagtgatactgtgtccttggtatattagtgtgtcatataaggatacatatgacattactggtgatgttaattttcatctctggttcctattttccctttgtaattactgagtatcctatggggaggtactggagacaatgtaaatatcctatttttcatcaaattttcaccaactagttttagcatccattgttaattcttgactgaatcacttcttagtatcatagttgccaaaagctgcttttctaattctgtcgttccttctacataaaaaacatgtacattctatggaaaaggaaaaaccaggccttctttccttttctgtagtttgtcttccttctctccctccctccctttttttttcttccctccttcccttgctttcttctttcattatttatttatgtcaatatatactcatggattcttattttattcaatggtgtgtaatttgttactgtcattgttttcattgttttgatgctcaaaatttcccaaagttagccaatggaagccccttcaagctggcttttttgtccttttaacatgtccccatcattttttgagttatttccttctttctcttttttttaaatagagatgaggtctcactatattacccaggctggtctccaactcctggcttccagcagtcctcctgcctcagcctcccaaaagtgctgggattacaggcatgggtcatgatgcccattgaagttctttctttttgacaaaataagatcttccaggttcatcttgctttttccagtctcaaccctggaaatcaactgtttctccaaggagttctgattcttttgggcagagaatattatttagaaactaagatctgggtaccaaatgtattcattgttgttggagtattattgcttataggcccacttagcagacagagctagaaaacataggccgggtgtggtggctcacgcctataatcccagcactttgggaggccaaggcaggtggatcacctgaggtcaggagttggagaccagcctggccaacatggtaaaacctcgtctctactaataatacaaaaattagccaggcatggtggcgtgtgcctgtaatcctagctacttgggaggctgaagcaggagaatcatttgtacccgggaggcggaggttgcagtgagctgagatcgtgccattgcactccaccctgggcaacaagagcgaaactctgtctcaagaaaaaaaaaagaaaacatatatttacaaatatatatatgcatacacacacacacacgtgttacatatacacacatatacatgtacgtaagtttacagatatagatcaatatatttattgatctctcaatttctctttctctctctctctctctctctcacacacacacacacacacacacacacacacacacacacaaattcatatgtatttgtctccccatccagttcccaacccatagcacagggattattctagcctctttccatatttttaacccccttccccaagagagaaaaacctgctttatgttatccacagtatatttacttattgttcagtcctagcatttacagatagtagtttcagaattgttaactcactgcagtaaacaaacctaccaaactagagtttaacatttatttatagttccttatgtctttagcctaaaggtatatctatagttcgaatactgagttcagaaattgcttgtgtgtgttcttaccctttcttccccttcagtgtgattatgttatttatctgaaatacagttaggcttatatatttctgttgtgttccatttgagagccacccttaaattttccttatttatttctttacaagaatgtaaaacattaacatggttctaaaagtcaaatctatacaaaaagaagtgtattcccctctagctagtccttttatcccctttgccttccttcgatcctttcaattccatccttttcatctcattagtttctggttatcctttctgtctgtctctttgtataaacatatacacatatattttctcattttcccttcttttatatacaaaatataacatgctatagatactctgttgactttgctttttctgcttaaaaatatatcctaaaaccacttaattcacagaaatctttctcatttcatttacagctgcataattctccatcgtatgtctgcttcatagtttattcaaccagcctcctatatatgggcatttaggtggtttccaatatttagctattacaaatgtggacttctttctaccttttttgttcaattctgtctccctctttatgtgtgtcttgttcctggcagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagtgagtgagctgaggttttgggtccaagagcaatattttccattgggataagaaagagaaaggcttaaagtatttcatgaataatacagagagattatagatcctgaagagcatatactgataatgagaggtcttggcttcagttcctagtaacattaagtaggttcatttggactgcagtgaagaagtgccagtgatatgaaaggggaattaatttgcagtgttgggactatgatttacctcacttctgtttgattaaatatttctgaaaataatacttaatggcataaagacaaaggaagagacactaaagaataaaaagaaaagtttttagttacactaggtattagactttgaaggtcttccctcttcccacccatctctacctatgaccttgaagagtagcgcatcttaaactcttcatagtgtaaaatgggtttctggcttcatgcctttcttccatgagtccaccacatgtatgcatgttccaatgccacttagaactttattttgaattggcttaaattggcagcataaaaaccacatttacttgttttcacaaaaccctgtcaacatctaaaaatggtgacattgattttggttattatgttttatgaacctctctatagcactccaggtatataaccctggctcctaaaattcatgtgttaatgaaggaatgtgtatttgtccccacaggttaaagacagttgatgttatagtacgtagcatacaggatgctgaactcttggtcaaaggttatgagattaagctgagtcaagaagaagtagtactggcagatctctcagctctggaggcccattggtcgacattacgggtgagttgctctgagtttcttaggaggttgacctaacatattcattgctttgggttagcagagaaatgcaattttggatggcatgacactgatttaaatttgcatttgaataaggcagaatgtcattaaatatattttaatatgtattcaaagaagaagggactgagaagtatgtctagctagaaagggaagagaaaggactaggtttttctatttattttttcccttttcaccttaataaaatcatggattaattggatacagtcagtggttgtgccataagtttataaatcacttagctgttatctaatttgattctcacaagccactctgtgaggtggacaagaagagatttttctctccatttacagatgagaaaaccaacacttactctggctaaatgacttattttggtttcatatgttataagtggtgaagccaggtttcaaacacaagttctatgcacatttctctatagagtactgcctgtccttggcatcccagtgtgtatcaggaaagcagagaccatgacatgtggaggcagtcctggcacaaacattccagggcacaatcacatatacaatgtggaaatagctgtagaccgtgtccttgtttcccaccttagactgactcctttttagcatggaaagtatacaacctgtttctgtacttatgtttccacagcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcggtgagtggtggccccacctttttctcctattagagttcagggactaggtcttaaacaaaaacagagttatatctgtacatttatatttaaaggtggaaatggatagggaggggtggaaatttaaaaaccacataaattctggacaagtaagtgacagaaaggtgagaccggcaatctcaaagcagatgtaatgcctctcctgtgtcccaggtcttttctagttaagccactgatgacaatggcttcctggaatgtagacttgaaaggtccctggtgatcttttctcaaggacaaaacctatactctagttcttgttttattagctttgtatccaaatatgagccattttttatgatggagctttacagaatttcttgctttcatctcatttgctaattcagtaatttttcatctctgttactagaggtcctgcttctaatgacagatgtaaataggaaggacagaaactgcaccttttggaggctaagctggttagggaaatttgtagggagaggagcttaacaactcataagttttcattctaattgaagtcttatcacaaagctggttagactagagaagtgatatgacttattggaagtagcaggaaataatgactatttttcacttctctcccctctctccttgagaaattatagtgattcataaatcatagctgtgctgtactgacaggtactctgtcatcagggaatagaactgtacagccaatactaccttattggtcaccctggtaattcttggcaacctaggtgaaaaatttgacaaggattattgtgggatgctagaccacaaggcagcatccagggctagcaggtcacaactggtttctactcacttttttgaccatagggcactggtacatgcataggtctcactcagccttgcatcgctgttccccgtagataaagatggatcgtttgtggtcaagcccagctggatacatgggttaaagagggaattacctcatttactttattgtatttgtaccaaggtatctgatagcagtttccctttgttcttctagccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggtgagtgtggtagtagctctggcgagaagagttagaaatttaaattttctttatcataaaagaaaatgatgtactggcaattaaagcttcctccaaatggaagatatccaaattcccttttctttgagtggtttgagcaggatcgtcccaagatactggttttgcatttagactagagaacctgtaaggtaccttcagttctgagtttctgtaactgtattgaaaccactagatggacagattaaaattatctttattttgtttttttttatattacattttattttactaggattagatatggggttttgaaaaccaagggaaaattgtaagtagaagaaaatgattcttttttttttgaaaatgatttattttaagcattttttttttgttggtattttgttttgttttgttttgtttagcattatggttaagagtatgagatctggagttgtattgcctggattccaattctggctcacttacctactataagcctttgaagaagttatttagcttctcagtgttctacttccttatcagtaaaatggacatagtttgttatttatttaacctaccttatgagattatcgttgctaggattaactgaagtgatacatgtaaaatacttagaatagtggttctcaaagtgtggaccccagactagcagcatccgtatcacctggggacatgttaggaatgcaagttcttgggttgggcacagtggcttctgcctgtaattgcagcactttgggaggccgaggcatggggatcacttgaggataggaatttgagaccagcctggttaagaaagcgagaacttgtttctacaaaagattaaaaagacaaaaaagtgcaaatttgtgaacccaaacccactgaaccagaaactctggaggtgaggcccagcagtatgtgttttaaccaccctttccagcaattctgatgcagctaaggtttggaaactactgccttagaacatagtaaatgttcagctctttcaatggtggtaatggcaatgataatgttgtgatattttgcttcctaggccctatttgcagaaattgagagaaatcagacaaaactggatcaatgtcaaaaattttcccagcagtactctactattgtaaaggtaactttaccacatcccaaaaagaacatgaatcatcaccagctcaggaaaacctacatcttcactgtaggttctgtttctagacaaattaagcagagttcttatgctacaagctggcctgatccttcagttaagcagatgtgtatttcctgcaaccccatgtttggggttgcttggagaagtagcagacgttggctgtgatttgaggagtctccatttgcgtgaccgtaggccctttaaacttaacatggcaaaaacagaatgtttgagttttcttcttaaatatgcttcttacttgtctttcctatctcaggaaatagtatggccatttttttctaattgctgaggcaaaaaacccaggagtcatcctaaactgttctctttgccttaagctttatattctccgttggctcttgtcttcaaacatgtcccacatctgactgcctgccgttatctcccctctatttccctagttcacattccagtgaagaatcttctttagactactacagtaccctctgagctggtctcttgcttctgctctggcccccacaggctattttcccacagagtagccaaaatcccctttttagaacatattgcatgtcactgaatcttagactccattgattacaagctacaccataattttctgcatgccaaaaagaggaaaaaagaagaaactctgccagttatgtgacatgccattgattctaaaatatgttccaatttgaaagactaaaatgtggagaaaatgtgtaccttagaatagatgaaatacagcaaataagatcatgtcactctcctgctcaaaactgtccaatggcttcatatcatagtcgtaataaaattctaaattcttacatggtttataaggccgtgaatgatttagctctcccctatttctcttagaatatctttaaggaaaaatgacttgaggccaggtgtggtggcttatacctgtaatccctgcactttaggaggccaaggcaagagggttacttgatcccagaagtttgagaccagcctgggcaacatatcaagatcccatctgtaaaaaaaaaaattttaaattagctggatgtagtggtgtgcacctgtagtcccagctcctcaagaggctgaggtaggaggctcacttgagcctgggacattgaggctattgagccgtgattgtgtcactgcacttcaacctgggcaacagagaaagactgtgtctccaaaaaaaagaaaaaaataacttgagattattacatatttatttgtttattctgtgactcttactagaatgtaagttccaagggagcaaagtttttcctgacttgtttctcagtgtgtgtgtatagcactcaaaacaatggcaagtacatagaagatgcttaacaaatactttttgaatgaaggctttcctttagttaataacagaacactcactgtaagaaagaattgagttcaaacccttcaccattttccaggcttactttgagtatgcacttagactatgtttctgttactgtatctataaagtgagaacaataatacctcactgagtgattgtaaagattaaatgagataatgtatacataggaccatgcctcaaacttaaagtgcactcagtaagtggtagcaattgctttgattatattttaatgttcttactactatttttttatgggttccttcacaaattcattccttgttttccttctacccggagtttttttaagtagacagcagaaggacgttttaggcaaaggaactgcataatcccaggcagagaagaatgaaaatacttgattatatgaggaaatagagagtattctgatatagctagaaggcacaataaggagcagtgactatggaaaattagcggtgagattggggccaacccatgacaggccttgttccattgttgtggctttatcttctattcttgcttctcaaagtgttgtctttgaaccagtagcatccgtagcacctgggagcttattagaaatgtagaatctcagacctgctgaatcagattctgcattttaataaattatatggggatataatttatatgcatgttggtgtttgaaaagctctattctagatcattgaaagctttttaaggagaagagtgatgtggtcatctttgggttttagaaaaagtattctggtggaacaatagagaataaattgagattagactagaagcagtgaaagtacctaagaggctaccgcacttataaggctacttcatgtgagagaagaagagagtggactagagcagaacttgcagggttgcagaggaagtggcagaatagtatggtaaaatgagaatactggttcagggattagaaatctaagattctaatcctaactctgttaacacttacccacttagttaattagggaaattcacatcccctctctgggtttcactttccccacaggtgagatgaaagggttggtcagactgcaactaaggcgtgagcaaactatgacccacaggccaaatcttgtccacacacctgtttttgtatggcccatgagaaaaggttgaaaagaaaatcaaaagaataatattttatgatgtgaaaataatatgaacttcagtttttagtgttcataaataaagttttattctaacaaccacaccctttcatctatatattgcctatggctgctttcacttataatgagagagatagtatggcctgatattttctgtctggccttttacaggaaaagtttgctaacctccagcatgagtggtcaccaaaacgcttccagcaataaaaagctatgatttattacatgatgtatgtgaattataaaaccctgagtaactgtagcgaaattcatcctttcctaggactatgaattgcaactgatgacatacaaggcctttgtggaatcgcagcagaaatcccctggcaagcgccgtcgcatgctttcctcttcagatgccatcactcaagaggtgagagggtgggggaaggaaatacaccactgtcttcccttaaggaaagattcatttgcctgggccttacattttgatttagggctcacttttctggtgaacatgtgactgcatgaacatttcctcttattttgaactatttaaatttcattttctggcagacgatttatttaaattgttcttttgaaccacagttcatggacttaaggactcgctacacggcattggtgactttaacaactcagcacgtgaaatacatcagtgatgcactccggcgtctggaggaggaggaggtgaggacagttgggtccaaagtcatcttgaaagtacagtaaaacatcttagccagcacggtggtgtgtgcctgtagtctctggtacccaggtggctgagttgggaggattacttgagtctaggagtttgaatccagcatgggtgacatagggaaatcccctctctacaaaaaatatttaaaaattagctgggcatggtggcacacacctgtggtcccagttacttgggaggctgaggtggaaggatcacttgggcctgggaagttgaggctgcagtgaccatgattgtgccactgcactccagcctgggcaataggctgtctcaaaaaaaagcccaaaatatcccacataccccgtaaatatatacacctactatgtacccacaaaaattaaaaaaattttttaaaccagcaaaatatatgctatatatgtaacatataattaaattattatataatatatattttatttgagagacaaggaagttagaatactatgtataattatgatttcattaaaaacaaaactgtgtactacaaagacatggcatagaaagaagtttataggcacctataccaaatttctggggaaataacgttaacttacataattatgtattttagacttgtttgaatttattgtaatgagcatgtcatctgtttgtaactgtaaaaatcttctgtctttgtaaaataagtttctgcatattcagcctctcttataaaaaaaaagctgttaaaacattaaccataccatcttttgctttttaaattagcaagactttctttatatccatacctacataatgtaatctcagtaggcttcagtctcttctcttcttacagattcacctgtaaacctaagaattatgaaaatgagtaagatgctatatgtgaagagatttttttaaaaagcatcaaataattattgagtgcctattatatataaaacagtggtttgtatttttcagaaaggtattaaacctaggtataataaatttagctcacaaacacctgtgagcaatactgtaggctgggctaaattatacttggggttattttcacagcccacttatttaggtaactgtatctgtttttaggaagacttcatttaagaaaatctgaagtcgtgccagcctaataaaagacattgctagcatattgattttctatttcctattctagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggtgagaagaaggtccatctctgtttacctgggtagaataatatgtgataatacattaggtggaatagtagaagtcacatgtgggccattccagaagtgattgctacctgagtaaatgttaaagaaacttaagaagccatcttgtttgttcttgtacctttttatcagctgtagctcattggtgataataatttgacctaagctgcatattttctctaggatttaaaaaaataattttaaataatttttgactcttaattcttgggttttgaagctttttctctttatttctaccatgtaggttctgtcagaagagctgacaacaaagaaagaacaagtctctgaagctattaaaacatcacagatcttcttggccaagcatggtcataagtgagtattaaatgagagattatggcacatctggggcacctggtctatcagtctaaaacttacagccataatgagatttcagaatggagaattcagagcagcaagagccagattatggggaccctgtagttcatacggaggagtttgcatttaatttgttggctatgggaagagattttaaatgtgattgtgttttacttttaaaggttgctagaacagttatatgaagaaaggattgacatgtggtgagaatagaggctgagaggcctgttaagaggctattctgataatgtagacaagaaatgacgaggaatggaaacaaagagactaatattcaagagatgttaaggataatgaatctatgggtgtggttacacatgaaaattatcgcataaagtgacagagatttgaattatcagtgtattagaaaccatgtgggtagattactcaaaagggctttttggggcttctcagcctgttaaggaagcctcagagaaggaaaaggaaaattatgagtgataactcagaacccaagaaagaacagagttccaaaaaggagagaagttcagaagtcaagaaaagttgagaaatatctgttacatttggcaagttagaagtctttggtgcctctggtgacaagttgtgggatgaggtcagatttagtatggtgaggagcacattggaggcaagcaaggcgaaacagaactgctctttcaagaagccaggacataggagcaaaaaatataatagagtcaatatttaaaaatgaaatatatggtcaagaagggttttgttttcttaaaagatacaatggacttaactatgttttcgagtaagtctcaaggacaaaggggaggagataattagagaaaggtcccagtggacatgcaagaggaggaaactcattgatagttagaaagtacaaccttaaacaggaaattgggaccaccttttttctgaggtggagatgagggaaaggagattaagaaaggtatggatagaggtaaatttgttaggaccgaagccagaaagtaagagaattagtgcccagtggtctgtattttctctttgaaataggtggagaggtttgttgaaaggatggtgccgaggagaaaggaagagggacttggctgggaatttacaagaggattgtcaggaagtattgtgacccagttgagattggaaaccagtgggctctgtctatgtggttgtggaatttttttttctctaactggatttacctagcagccttagtgtaggagcagaagagactggtggtttgattgatttggggttgggcttttatcaggttagcgagtggagagtgcaaggataatggtaaggaactgatcaagaatatggattgtggggtctggcctctgaagaaaagaaacttaatagagaggactgatagaataagaggaaatggaggcattaaggaaggcttaggacatatccatgagttgatggatagatcccatttgaatcaacagagttcattctcagaaacataatgtggaatgaaaaaagaaagttgcgggattcatcagattcaagaggtggttacctttgggaagaaagggaaaggaatggacttggtgacaaatatacagtgggctttaattatatctgtaatgtcttatttctaagaaagggtctaaagcggccaggtgcggtggctcacgcctataatcccagtactttgggaggctgaggcgggcaaatcacctgaggtcaggagttcgagaccagcctggccagcatggtgaaacccagtttgtactaaaattacaaaaattagctgggtgtggtggcgggcacgtgtaatcccagctactcgggaggctgaggcaggagaatcacttgaacctgggaagtggaggttgcagtaagccaagatcgcaccactgcacttcaacctgggtgacagagcgagactccatctcaaaaaaaaaaaaaaaaaaaaagagagaagaaaaagaaaaggccctaaagcaaatatgtaaaatagtaaattgtgaaatgaaagctggatagctagacaacaggtaaataagaatgtgttacattcttctgcctgtttaaaatattttattttaaaaagaaaataggtatagaaggagtaaagaaagataaaactgaaaggtagagttataatcatatagtggattcttgaagtctaagatttcagaagcagaataatttcagatgataggatctaagtttgacatttgggggtggggctaaagtggagatgaggtcatttgaactacaagcataggggtgacatagcattgacatcatcaagaaccatgacttgatttgagataaacagaagaactgactgaaatgccaaagtctccgatgaatatggaagaagatcatccatccaagatgaagaagtagcaattttgaagcaatagagcagagtttggagattgtttttttttctcctaaaaaagctttaatgcttcatcttccaggctctcagaaaaagagaagaaacaaatatctgagcaattgaatgccctaaacaaggcttaccatgacctttgtgatggttctgcaaatcagcttcagcagcttcagagccagttggctcaccagacagaacaaaaggtacttttagttttcatctccaaatattgggtggataccttttgaatggtatgaaggcagctttgctgattcagagtcatgatcactagctttccatgaccaatgtgacttaatttttaacctcaccttagcagccatttgtcttgtgtttctttactggggttccatgatgtgttggtcagtcaaaagcactagaagacacttacaactaaccctttagacctggttcaccttttttgtcttatgccattttgtggcagacagcagtctaggagaacataaattctgtattatatgtgatcacagggcagtaacatactcccttgtggcattgtcactcaaaagttgatagccaaaagttctggatattgggaagaaaaacctgtgaacctcttccctctatactaaggcagtaagaaatattaagttccaaagcaaactggtagagtagtttcactgactaagacgctggttcccctcacccatagtcatctcatcatgtggcatcttgaccagttcccctccatattcatttcctggaccatgtgaaagtcatcatagttcctactggttgtcctaagttcttcctggatacttgtgcgtgtgtgtacacttaccatattatatacatgtgtctctgggatatatatgtgtgtttgcctgcttatttcctatgttgtgaagcaatggccaacttatgtggggcaggccaaaattaagctcacgtgatagtcaaatttggtccagatgatgctcaaaatgatattcagacaaagcatgtcttgattctgatccttggatataaattttgtgcaacaggagctagagttgtaaaaaccacaagacaaaaccagctatgatttgatggtgtatttccaaaaacaaagtgctggtgtaacattctccatttaaggtagcccacttccagtggcttgttgcttcaccatataagggagtatgtgaaaagttttaacaattgcttgctgagaacatccggttctcattttgaaaggttaaaaaagaggggggaaaaggaaaaaaagaaaaaaagaaagacaggacaggctgctgagcaccactacattgagcatgatgtgtctcctgtatgtgtgtttcatgtgaagtattgttctgattaactgacatccttgcttacaagtttcactaaccctttggagtttaagcacaaatgcacaaagggaaaagaggacgacctgtttggggttcttttttgcaaaaacaaacagtcgcatgctggacgctaacaccaagcttacactgtgtgtgtgatacggctgagctgctccataaggctctatcttttatctgcccaaggcgtgccctgcaactctggtaagtagaagccttttatgttttctttcctcctctccttctatctcttaatgcttgtttaggtcagaatgtccatgtttggtaggacagaaatgagtttctctggattttttcccagctgagtatttcctgcctatccttcaattatatgagggtgttggaagtaacagtgtagacttttctctttggctacactgcaggcctttcttcaatgtcagcatttttgagactccatgaatctcacaaaagaaatgaaaagttctcaaagggatgtttttctttgtcatattgtctgttctgaatagtctttcatggattttctaaaaggaatttttaaggtatcttgaaatttttcagttatcacattccagtgaactttttccttcaatttctttaaaacagacacatagtgagtttgtataatatatatgtttaaattatatgaattggactttctattcttggtcagaaaacatggggatagggaataaataatactttaaatagtgtagagaagtctgtcagttattccattgattgaacacatatgtagaaatggagatgagaaccaaatatactgttctttcatttgctatccattctgtattcttattgtatgcacctcatcaagcttgaaatcctcagtgcgtgtttctaacacctgaggggaaatggcttaatgattttaagggtttccttattatttatccatattcatcccatatttattaaatgacagctactgttcctagaccttcatggacaatggatcagctcttacagaacttactcactgagataaaatgaaatgccattatttaggaggcagggaaataattggaaattgcttccacaagatcctctatcaataagatagagagttaaataagtaatcagaaagtagcactgaccaaagagggacagataaaattatatacagaaaatgaaaataatgaacatgaaaagaagagctgaaaagttggagagtaataaaaatgatgaagtgttgtaagtggttaaacacttaaataatttaaaatctgaatgtattattctgtgataaaagatctcaaaaatgagaattctttaggagctgtttctaggatttgcaagggtaattttgacagcgtatatgccttattcactgaccttcggacctaactcctgtgttaagatgtgactctactgtacttgtcttttacagttttctgggtctgactctgggaggacaaacaagatttagaatcagaccttgatttgtttctggaactcactagttttgtgaccttggacaagttacctaaactctgtgcctcattttcatttcttcaaactaaagattcaaacaattgttttcataggattactgtgagaattaaatgtcagtgttcagtagatctagtaataagtgatagctgtagtcatggttattgtactacccattctagcctggatcagaagaaaagttactagtggttccataggcaagggtccccaatctgtttcttccttgacttgctacttccaagacctagaactaacttaatttagagccattgccttgggagaagctagcattgtccaagaatatgagtatcccacttgctaaatagttgcttgagtagtatacacaggcctgtttactgggatgcacaattgttctggagcttctgggctgcataaatctctcttattctatggaccagtcctgctgtgctcatcagcagggaattgctacttctagagtcttctgtgtggtttgcaacaccaaaaacttgttgtatggcgttgaattctcactttgggggaactgttacgtgtctttaagaacatttatgatgatttagtcttagaaataagattaaatcctatcattttcactgcttaccaccctgtagagcttgtcactcagatatgcttaatgccactatctctcaagtaatctaggaacttctgacctattaaacattctgcagtttagaaaaactcttttttagtcttaacaccgggtggcttgcttcagaatatttcctacatgttggggcttatcccatgctgggttttccttgtggtcagaattttatatactgtagtactttttttttttttttttgagacagagtctcgctctgttgcccaggctggagtgcagtgatgcaatctcagctcactacaacctccacctcccgggttcaagccattctcctgcttcagcctcctgagtagctgggattacaggtgcgcaccacacccagctaatattttgtatttttagtagagacgggtttttcaccatgttggtcaggctggtctcagactcctgacctcatgatttgcctgccttgggcagattataggcgtgagccactgtgcctggcctgtatactatagttctttgaatgactcctttcaatagttgtgctttgccattggctctgattcagttttctttttcttctcttttccttttttttttttttttttttttttttttaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcaggtcagtggtgtgcttttttttttttcttcctaaagatacaattagtttaatgctaaaattcttaactgggtacagagtttacatatgtgtaattgtatgcctctatacattttaaggcactagatgattctctaagatataacttagtttatcatcatctgtttgtagcaaagttgttggaaaattaggcattggctctgaatgtctttctgaaatctgcaagggttttaaatagaaacgagctaatagaaatactaggatgatgctacctgaaatcagaatagcttttggaaattttggtaaaatgatgcttgtagattgatagctctgagcttctgctctctgaggaaattggtaaaatcacctttgtctattgatttgaaatgacttaaacaaagtgttttattttatcccactctatgtgcagtaaaaattgcttctatttgtctaacaaaaacccctgcctgctttaaagctgacttacaggagaacgtcagaactgagtcagctttctttttggctccacagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtaggttcccagagacttccaccacagacaccagcttcaagatagctgcctccatcttccttgaagatttcaagacttactagaacctgcttgcactctattctagggtaaacaatctcagacccttgtcagataattatgggatgggctacatttggatagaccggataaaatttatacaggataaacttgaacagaccttggatttggctatcaatgtaattactaccatttttttttttttttttttttgagatagagtcttgctctgtcacccagggtggagtgcagtagcggtgatctcggctcactgcaacctccgcctcccgggttcaagcaattcccctgcctcagcctcccgaatagctgcgactataggcacctgccgccacgcctggctaatttttcttgtttgtttgttttttgtgtttttttgtgtgtgtgtgttttttttttgagatggagtctcactctgttgcccaggctggagtgcagtggcgtgatctcggctcactgcaagctctgcctcccgggtttccgccattctcctgcctcagcctcccgagtagctgggactacaggcgcctgccgccacgcccagctaattttttgtatatttagtagagacggggtttcaccgtgttagccaagatggtcttgatctcctgacctcgtgatctgccctcctcggcctcccaaagtgctaggattacaggtgtgagccaccacgcccggccctaccaattgttatctgcgtggttttggattgatttaggtaagttcaaaggcagagtgattggttaggaaactattgcagtaattcaagcaagaaatgttggaggcttaaaacagtagattagatatgtaagttaatctctcttacttcctaaaactatactaagacatcaggaaaaaggttttttgggttgttttttttttttagtgcataaattcataaaagggcaagagaggagaaaacagcagtaaaattttagaagttagaaagcagctggatgaggcgataactaccttagcaagctagagtaaaccagatcctcaacttaaagtggaggaagctaaggaacaacctgatttatactacagaactccccaaagcctcaaaaattgggagcaccagaaagagatgaaaatggatatgcaaacgggcttataattggtttaaagtctgtttaagaagcaattagacctttagattttcaacttacttcacatagcctggcaactgcttgtgctgtgctctaacgaaaggctggatgttcattctctgaggaaagtaattcaaagtatctcttgactagggagagcagccatttattgaaggtaaatattccatacagaaatcagtaggattaactggaagttcacatacatactgaattttgagctatatccttgctcccgctatggtttgaccagcccaagggggaagacctaatggtactgatataagtggtttcccaactgtatggcccagctccatcaccctcagtgaagactacagccagcagagtttatagtcagctttttagggcattacactccacttcagcatccagaaagcttctgatacaaaaggagaggctaaaacaaagaaaaagaaacttggacaaaatacagactatttaggaaaaaaaacatactgagggccagtcacagtggctcatgcctataatcccagcactttggtaggccaagacaagaggattgcttgagcccaggagtttgagatcatcctgggcaacacagtaagaaattagccaagcctggtggtatacaccctagtcccagccactcaggaagctgaggcaggaggatttgcctgagcccaggagtttgaggttgtattgagctatgaatgcatcactgcactccagtctgggagacggagtgagaccctgtcttaaaaaaaagaaagaaaaatatattcaaaagcactgccatttaaaggaccaacaaagaaacaacaacaacaaaaatagattgaaaaagtctaactggagatctctgaagaagacctggaaacactcgtctcacagaaaccaaaggaggaggagtcagccctagtaactgccacagggagattgagtacaatgaggactgaaggggagattcagctcctgaaagttattggtgactttgaacagtttcagtggagtgacgggatataaactaacttgcagctggaagaaatgggaggttggaaagtagagacaattaatatagatccttctttccagaagtcttaggtacaggcaaggaatgaggtgggacactacttgaaggagatggattgaaaggaatgttttgaatgggttttggactgaggagaaagaaccaattaaaagggagaacttgaagttagaagagagaggaagtgataactgatagaaccagtcccctaaaaacgtagaaagacagccttgagagggaggaagagtggctatttcactgaaattggaggttaagagttgtcataggattggagtcaccatgaagacagattgtagtggtttactggttctctcaatatctagtgtgtggccttgggtagggtggctgaaccggggctgaggatgatgccccaaagaactatgtcaagttcttccacagcttatttccggcttatctgttgaggaccagaatattacagactagatgagtggaaaagctggttggggttagctttgtattctttggttccatgaccctggaatttagagtggaagagtcatccgttcggtttattttgtagcacattaattctgcacagctgctccttggggaaaggcataatgacactctcagagaggcagcaagttacagtggagggagcacactgcactgagtgagaaaacctgaatccaagtcctggctgtactgcttaccagctgggtgaccttggacaccattcacattttttttttaagcaatgaggcatctcttctgtaaatccagaacagtaacatctaccttgcctacttcatgaattagtgattgtgagaaccaagtaaactaatgaatgtacataaaaacattttctaagccctaaagtgtgtgtagacatggggtgagagagaaatgtgttcacagctgattcccagagggtttctagtcttgcttttataggtaactccactttattccctcaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaaggtagcattttgcttttattcataaaggctcacaaagtctgggtggctgggagattttcataatgtgattttccatttatttcttagactaaagtgttaaatcagcacacacagctagaaggccgacttcaagatctgagagcctgggttggcaataaaaatcttattctgaacagcaagggatctaacagtgaaatagatgttgacagcctgaacctctgcctccaacagtatgaggtaaactcaagcacattttctttgtcctttgagttgtatcaattttatttccctgctaggcaaaccaatatccatatttatcttttttttttttttttgagacggagtcttgctctgtcacccaagctggagtgcagtggcacaatcccagctcactgcaacctccgcctcctgggttcaagcgattctcctgcctcagcctcctgagtagctgggactataggcgcctacctccacgcccggctcatttttgtatttttagtggagacggggtttcaccatgttggccaggctggtttcgaactcctgatctcaggtgatccgcccacctcggcctcccaaagtgctgggattataggtgtgagccaccacacccggccatttatctttcttagaaagtctgattttccattttataaataaagtcagctatgtttaggtttataattatcatatccctggccggccatggcagctcacacctgtaataccagcattttgggaggccgaggcgggcagatcacctgaggtcaggagttcaacaccagcctggccaacatggtgaaaccccgtctctattaaaaatacaaaaaaattagccgggcggtgtggcaggcacccgtaatcccagctacttgggagcctgaggcaggagaatcgcttgaacccaggaagcagaggttgcagtgagccaagaccgcgccattgcactccagcttgggcaacaagaacgaaactccgtcttaaaataaaaaaaatcatatccctggagcttcagtgataatgatcatttctcctttcagctattctctgagagaccatctactgaatgacctgttattatcaatctcatcctctctttataaatgagcatctaggatccgtcctttgtttcttttttgaccacgatccaatcctacgtgcacacacacataccagtttcaggagattttttgttgttgttttcaggggtacatgtgcaggtttgttatataggtaaactgcatgtcatgagggtttgatatacagataattttatcacctgggtaataagcatagtaaccaataggtattttttctgatcctgtctctgctcccaccccctcaccctcaagtaggccccagtatctgttgttcccctcctagtatccatgtgttcttgtttggcttccacttataagtgagaacatgccatatttggctttctgttcctatgttagtttgcttgggataatggcctccagctccatccatattgctttaaaggatatgatctcgttctttcttatggctggatagtattccataaaatgtggtgtccacattttctttatccagtgtaccattgatgggcatttaggttgattccatatctttgctattgtgaatagtgctgtactgaacatacacacacatgtgtctttatgatagaatgatttacattcctttgggtatatacccaataacgggatagctaggtcaaatggtaattctaagttcctgtgaaatcgccgcagtgctttccaccatgactgaactcaggagagtttttgattggttatttacagcatgggttggcaaacttttttttttttttttgtgtgacagagtctctctctgtcacccaggctggagtgcagtggtgcgatctcagctcactgcaacctccattctcctgccgcagcctcccaagtagctgggattacaggcacccaccaccatgccaggctaaattttttgtattttcagtagagaggggtttcaccatgttgcgtagagtggtctcgaactcctgacctcaggcaatccacccaccttggcctcccaaaatgctgggattacagacatgagccaccgcgtctggccagcaaactttttaaataaagggccagataataaacattataggctttatgaaccatatgcaaaagacctatttctgttgcaatcactcaaaattaaagcagccataaatagtacataaacaaatggctatggctatgttccaataaaactttatttacaaaaaaacacgtgacagaccagattttgcttgggggccacagtttgttgacccccctgctctagagagttgcttttcttcttcttaagccccagattaattgattctttttattagtcaataagagaaaagaccatgagacacatgtgagccagagagttttctccccaatattgttctctttttttgttctatttaagattatttgaggtattacagtggtttatcaaccctctgctatagagagatacccctctccttcaactttttagaatgtcagaacggaactagaaatgtcccctccttctattctatcttctccctcttccccaatcttaagagaagcagacataaaagtttgtccatgatcaaccttatacacaatctcatccctctttatcacgcaagagttgacctgcctcctctttttataccctttatccaaagatatcactgagggagagagtttcagactttattcagcctttatctgtttgctaagatattacaaagaagcaagcatgaaaaaaattaccatgacatagtgtgagatataaaaacatagagacatagagcatttcatgcattggtgccctcccctagttataacatatgaatcctcttgtagcagagaacgacagtctgagccttgtttttctagtgatagtttcctaaattatcatgttcacagaggaaggaagctttgtcttattgttagcagtggcaaatccatgtgagtctgcagcagctcggttcttgcctcctcaggcgaaagaatttgaccaaggggcataaggcagggggagagactgaggcaagttttagagcaggagtgaaagtttatttaaaagttttagggctgggcacggtggctcacgcctgtaatcccagcactttgggaggccgaggcgggcggatcacctgaggtcgggagtttgagaccagcctgaccaacaagaagaaaccccgtctctactaaaaatacaaagttagccaggcgtggtggcacatgcctgtaatctcagctactcgggaggctgaggcaggagaatcacttgaacccgggaggcagaggttgtggtgagccgaggttgcgccattgcactccagcctgggcaacaagagggaaactccatctcaaaaaaaaaaaaagaaaaaaagttttagggccaggcgtggtggctcatgcctataaatcccaacactttgggaggcgaaggcgggaggatcacctgaagttcaggagttcaagagcagcctggccaacatggtgaaaccccatctctactaaaaaaaatatataaaattagctgggcatagtggcaggcacctgtaatctcagttacttgggaggctgaggcaggagaatcgcttgaacccgggaggtggagattgcaatgagctgagatcgtgccactggactccagcctgggtgacagagcgcgactctgtctcaaaaaaaaaaaaaaaaattcagagcaggaatgaaaggaagtaaagtacacttggaagagggccaaacgggcaacttgagagatccaagtgtgctgtctgtcctttgacttggggttttatatgttggcatgcttccaggggttacgtttctcctcccctgattcttcccttggggtgggctgtctgcatgtgcagtgacctgctagcacttgggaggggtcgcatgtgcagtgtgtttactaaagttgtatacatgctcacttgaggcgtttttcccttaccagtcgagcgtttttagaggaagttcatataccagtttaaactctgccactttgcctcttagtgcgcatgcttgagcccactcgcccagctcctgagatcttacctggaagctgctaatcaccagctttaggtgttttctatctattgagagcctgcctttctctgctgtcgctgcaaccaattattattttagagagatggttgaacaaccacctgaccgtcacctgatggtcacctgacattcttggaggtgaccatcaggtgatgtggaggtgggcagggcctctcatgccctgctcatatctgcctaactacctactgtaacattatgataaatattcaagaagccctttctgcctgttctgcaggattgactactctcaattgatctactctcagtttcaaagtgatggagatccagtataacataattgataatcactagatgtgggaagattacttgtttttaatagtctgaaaacagatgattttagtgtttggacagtttttactactttaagggaaaaatataactataacaagaaagtctgagtgtaatctttcagtttaaaaaatagtataaacagcatcatttactcagaaaatcaaaatttaggctgggcatggtggctcatgcctgtaatcccagcactttgggaggctaagtggaaggatcacttaagcccgggagtttgagaccagcctgggcaatgtggtgagacaccatgtctacagataacttaaaaaattagctgggcatggtggtgcacacgtgtggtcccagctacttggaaggctgaggtgagaggattgcttgagcccaggaggtccaggctgcattgagttttgtatgcatcactgcactccagcctgggtgacagagcaagatcttgtctcaaaaacaaaaattttagcgaatcataaacaaattatatattttctcagtactggcctaccagtaactcattgctggacagatacaaatagaaatttgaacctaagaaagtacaattaggtacatctcagatcagaaattcatgttatactttgcaaaacttttttaaaagattgatggccgggcgtgtggctcacgcctgtaatctcagcactttgggaggttaaggagggcagatcacttgaggccgggagttcgagacaagcctggccaacatggcaaaaccctgtctctactaaaaatacaaaaaattagccaggcatggtggtgagtacctgtaggcccagctactcaggaggtagaggcacaagaattgcttgaaccagtgaggcagaggttgcaatgagccgagattgtaccactgcattccagcctgggcaacagagcaagactctgtttgaaaaaaaaaaaaaggccaggcatggtggctcacgcctgtaatcccaacagtttgggaggccaaggcgggcagatcatgaggtcaggagatcgagaccatcttgctaacacagtgaaaccccatctctactaaaagtacaaaaaattagccgggcatggtggcgggcgcctgtagtcccagctactcgagaggctgagggaggagaatagcatgaacctgggaggcagagcttgcagtgagccgagatggcgcccctgtactccagcctgggtgacagagcgaaactctgtatcaaaaggaaaaaattcacagatattttggattaacaatagtataattatgctagcataaataattgagctgcttactgtatttggaaatcaaggtaggtccagtaaagggaacttaattctaatttatgaggagtttggagagactgaaagtgagagagacttttttttttttttttgagatggagtctcgctctgtcacccaggctggagtgcagtagtgcagtctcggctcaccgcaacctctgcctcccgggttcacgccattctcctgcctcagcctcccaagtagctgggactacaggcgcctgccactacgcctggctaattttttgtatttttagtagagacggggtttcaccgtgttagccaggatggtctccatctcctgaccttgtgatccgcccaccttggcctcccaaagtgctgggattacaggcatgagccaccgcacctggccaagagagactttaattctaatttggccctagaatcattagtgccagttatgaaaatacaggaaattagcctctctgattctgttggttttcttcatgaactgagaaatggaagtatcatggttttttgtgttttgtttcctttttccatttaccttaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgccgctcaggtggatgccttgcagggccatcttcaacaaatggagcaggaagccctggtgaaggtcagactgaaccagcagctgggctcagtttgtctttggggatgtcctctgtcattgggttttctggccagactctgtgtatcatgattgcaggagcctgggtttaccaattttgaaatttcatgtcatgcaggccagtatggttctagtccaggaggcacttgttctggctgttgttcttgccatgtctttggttttatgtatgtgtgagagaatgtatgtgttgacatgtgtatacatatgcaagtgttttcttttagtgagacttttccttcgctgtatctcattgtctctgaatttcaaatgaaaatcatgtatctagtcctttccctactttactttctcctttagcattgttttgagggctcgtaagaacatctagataccctgagctcttgaggagaagggttctgaaatcagtttcattctatttaatctatttcaaatgatttaccataaggttccttgacaatccttaagtggctgacaaggaaattttattagaatcgtattaatttttggctctttaagaattaatattattttcttgcacctttcctcacagtatagtgcccagtgcttattcgcttattcaatcatggaaaacagtatgtagaagcaggatgatactaaaacaaacaaacaaacaaacaaaaaactaaccatcctaccatcttccatcacaactctcttcttgcaaagctcaactcaacataattacattaatagtaacatcaaaaccttagaatacccagaatgatgttcatgccatttctgctatttgaatagtaagttggcatatagcaagatgatattagaattgtcattatcaccataaaatttgtctcaagggctcctttattaaatgttgtgcaaaaaattgagcttttgagtcagactttaagggaattagggtagttggtgccatatgtcctgtattactgtctcattttttcaactatattgaaattgagatatattaatggaaagctttaggttacctttgaaaactgagcatgtgcaatgctcgcattcaggagtttatatagcatgatataacctttggataattaatgaagtaaaattcatctgagccacattaagacaagacccagcccagattcagggtagactcctgagctgcagcaggtgatagaactgcatgtgaacattctccctgagcatgtaattaattccacaatgcttattaaccttgttattgtcagaaatgctctgcttctctcaatatttgccttggatgtgtgtgtatgtctctgtgttaacttgtttgctttgcttttttcagattcagtctgcacccatcctaacccatgaagatcctgttttacagctgaagagctcttaggagttctcttccagagcccttctatttgtcctaaagagggggagagagggccaatttgggcacctgtttgtaagtgcaggtgactaaagcgccatcagaaggtagaaactggtggaaaatggttttagaaggatggtcaggagaacacatcatgctcaattgctcagtcaggtgcttcaatgtcatacaactgagataaaatctagagaaaggatcaggcacagaaacatattccctctctctccttgggcctggcctgttcctttgatattagtgtagacacctaaaggactgagccagttgctattcttgggcactttccttctcaaaatagccaaatctagcccttcatgcctggcgtgtaatcattttatttaatgagtctctggattgatgagacatttgatttataaagtcagctcaattattaagaagctcgattaacttatgaattatccaggtctttgatttttctttctactccaattcttctacttttgcatattatgtagcaaatctctggttctagtggagggattgatcagaaccactaaattattatcatcaccattatcatgtgtggatttcaagcatctgggctctttcttctccatttccaaagataataacagcagtctggtgaaggagctctcaaaccaaaacctgaactagaaacattctcataattatcctgattatccaatccatagacccagatcaatggactgtccaaatgaggggagctttccgaatatgatttctatgtcttttcctattctagtctcccaccaacttttccatccttgagatataaccttcctgttttacatttcagggagtttcttgtatttgcaaaatgtgaattacgaaatgtctcttgacccctttgcattttaattagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggtcagtgtgaatctgtcaattttgacacaaagtctcgctctatcgcttaggctggagtacagtggtgttatcttggctcactgcagcttcgatctcctgggctcaggcaatcctcccacctcagcctccccaggagctgggacaaagtcatgagccaccatgtcctaattttttaatttttttgtagagatggggtatcactatgttgccaaagctggtctcgaactctgggctcaagcaatcctcctgccgtggccttggcctctcaaagtgttaggataacaggcttgagccaccatgcctggtgattttttcattccttcgacaaatatttagtgctcaagggttagcaataatggtaaacagacatcatccctggccttgtgaagcacacagtctagcagggcatacagaaattatacaggttattataaaaatgaacataaaattattaactgttatatctgtgaaggaaaactcatatgagaacatatagcagagagacccaatctagtctaggatttcagaaaagattatcttgaagaagtgtcacctaaacttgagaaatgaaagatatgtaggcgttaatgcatgaagaggtaggaggaggaagagaacataccaggcagaggcttatatattggtcttgaggtgggtatggtattgagcacaacatattcaagaaccgaaagaaagctagttcgactggactgcaaaaaacaagaggaaaattagggaaagttgaagttggaggggtaagtgggacctgtatcacactggaccccgcaggccacattaaggataaggagtgatacccaagagagtataagggcccatcaggcctcgactctgctaagatcatgttgtcaacacttctttatggaaagaatgatctctttgaggataatgcattgcaaaatgaaaaatctctcatgttcatgtttatggacaacctccttttttggcttcactaaatatttgcttagaaaacaaaatcaaatttctttgcattgatttaagcctaaacctgaagcaaattgtagttagggactatatacaggactatatgtcatcctagccattccatctttataccattagaggacttagaagcactaaagtcgaaggctctgccattcctattttcttgtgttaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaaggtaatagactgctatgacgcttgatatttttcaaaaaagaaaattttggtaccaacacaaataaaagacagtgaggggaaaacaggcttatagcatgcacagaatcatgaggaagggctacttcaggagctagtctggtttttgttttttgagacggaatctctgtcacccaggctggagtgcagtggcatgatctcggcttactgcaacctctgcctgccaggttcaagtgattctcctgcctcagcttcagcctcccaagtagctgggattacaggtgcctgtcaccacacctagctaatttttgtatttttagtagagatgaggtttcaccaggttggccaggctggctagtctgtgtttttacaagaatctttatttttacaagaaatgtccaggaggagtttaagtcaggacagttggtaaaaagtacatattcctattcctccccaaacccccaaacatcttgctatctgtatactcagtcctctgactaactgaaaaatatcagaaagaacttagtgaggaagagtattattatggggagaaaaaaagcaaatggctttttttttttttttttttttttgagacagagttttgctctgttgccaagactggagtacagtggtgcaatctcagctcactgcaacctccacttcctgggtttgagtgattctcgtgcctcagcctcctgagtagctgggactacagatgcatgccaccacacccagctaatttttgtattttttagtagagatggggtttcaccatgtggacccagctgttctcaaactcctgacctcaagtgatcctcctgcctcggcctcccaaagtgctgggattacaggtgtgagtcaccatgcctggccaaatgacatattttaatatgagtctagactggtgatctaagagtactagggaaaaatatctatgaagtcttagtgagccaaaagctgtccccgagctgcctctatagttacgatgggaatcgtggcactcggataaaccaaagagaagccaaagtctcaaatgaccttctgcaccccactcagcactggcagattgaatttgaattctttgtttagccttggatgccgacactaatgaggaaagtggagaacatggaaaagaaaaataaattacctgaagatgaattttgaaatagattaatatataacttggcataacctatttaatctattaaaatacatgtagagccagtaaatataatttcagaggcaagttgaagaattaaatgtttccctgtagcctcaggtgagagaaaaaatttaaaaagagctaaatgttctgtttagttgaggaaaggatgaaagaagtttgtctttcctttaggaaagagcagcccggtaactgaatgtgactgtgctatttcttaccctaccaagccagtccggcacttctgtgtacctcaaaagattctgtgaagcttgctggggtggcaggactaaatgacctctaaataaaatatttctgaatcctaggatttgttttgttttgagacagagtattgccgtgtcaccgaagctggagtgcagtggcacgatcttggcttactgcaacctccacctcccaggttcaaacgatactcgtgtctcagcctcctgagtagctgggtctacaggcatgcaccaccacacccagataattttttgtatttttagtagagatggggtttcaccgtgttgaccaggcttgtctcaaactcctgatcctgaagtgagccactgtgtcctgcctctttttttttttttaaagcagtaagatataatgaaatgtagagatatttttaataatttttcaaaagattttaaaagatatgaattctcttttgtatgtgcaaagactgtttatacccagtcttagaattagcataaaattatctcctcccctttaccccattacttaacctgtggttgtatgattgagtatgtaaagccttctcactagactacctcggtggctttcagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggtaagggtgttagcttatcctcactatgctagagaaatctctcctgccctgagcaagtaaccacaatcaccttgcccctaaatccagtgagcacttctcagtttgtatcttctttgatgtctcagcagctttgacactgttggccactcctcttgaaatactttctcccttggtttccataatactactctgccctgaccatctttcttactttcctctggccaggttttcaaatactgatgtttccaggtgtatcctaggccctctttttatctttcagaacatactttccttgggcagtctcatctactcacaacactgtaattgccatttgcactaatgaattctgtgtatgcatttccttccagccctgatttctgtcccgagcttcaaaacggtatataaatctgtctgcctatttgcaacttgggcccataagcacatcagcctgaaaatggaactcctatttcctatgatactcctcccacaattaaacattctctttcctttattcccacttcattgtctgaactggacatcatcctagattccattctctctctcactctcctatgtcaaatcagtcatcaaatcttatggtaattatatttctttcaaagtcagctatacttcttcatctttattgagatattattgtagtttagaaccactgtctgctttcactgttattattatagtagcttctactggtcttcttgcctcttggtttttaccttccagtccattctccttactactaaggaatctttctaaaatgccatatccttgcttagccctttttatggttccctgttgccctcaagattacctggttaactctcctctcagcccctacccactgggatctagtctacttatttggccttatctgtcaccttcctttatacttgagcatctgcttatattgattcctttcagtttattggctaaactgtgctctcactttcctctgggcctttacatgctcttggaacttacttgcttctccattgcataaagtaacggagggggcccagctatttgttaatttttactcattcttcagatctcagcttagagttcacttcctctaggaagcccttaattcaccaccactcaccaaagttagggtatatattcccccatatgctcttctttcttttcttttatttatttatttatttattttttgagacagagtcttgctctgttacccaggctggagtgcagtggcacgatcccagctcaccgcaacctccatctcctggagtcaagcaattctcatgcatcagcctcccaagtagctaagattacaggcatgtgccaccatgcctagctaagttttgtatttttagtagagatggggtttcactatgttggccagactggtctcaaactcctgacctcgggtgatttgctcacctcccaaagtgttgggattacaggtgcccagcctataagttcctcttataccctttcctactttgtagcatttctcattcgatattgttttgttgtctgtattgccctctagatgctaggcttgaaaacgcacactgtttcttacaggctgcctgttctgtaacaaaacaaaacaaaaaagcagaagtcacttcttactgtttatttctactcatttatttattcatttagtaattactgaatagctgccatatgccaggaattagaaataagccagtgagccaaccaagtaaaccatcttcaagggcatcaactggcatatacaggcacattctattgaatgattgaaagaagattacatatttaggacacttacaacacatggatcatatattttagtggtgacacctttatagaaaaaatattggcttagctggaatacttgtgttcagtggcctttgtggaccattgtcatattttatattaataggatttctgcctcttgcatgacgcttttcgaaggtccattatactgtgtcccccaaagccctggtagtcttataagaggacagagcaaaaatggttctgctgtcatagggctcctctgacaccttttgctggcagcagtcaacctaatgaagtggtatctccattctaggaaggaaactgccttataggtagatgagttggaaggtgagaatgaaggacacctaggtgatatacagacaaggttgtagtaccgctcccacttcactatctaattgagcaagatatatttgtcattccagctttctttttttcttctgctttttttttttttttttttttttttgagacggagtctcactctgtcaccaggctggagtgcagtggcacaatctcggctcactgcaacctctgcctcccgggttcaagccattctcctcctcagcttcctgagtagctgggattacaggtgcacgccaccacacccagctaatttttgtattcttagtagagacggggtttcaccatgttggccagcatggtctcgatctcttggcctcgtgatccacccgccttggcctcccaaagtgctgggattataggcgtgagccactgcgcccagcttttttttattttttaaagacatgaggcctcactttgccacccaggctgaagtgcagtggtacgatcatagctcactgtaacaggtgtggactcaccatgcctcattaatttttttttaagagacagtcttgctatgttgttgctcaggctggtctcaaaaacctagcttcagtgatactcctgcatcagcctcctagtcactcagctttcttgaaatgatgtgggaagctgaggctatcaggttgttgttgatacaggctaaaactagacgatgatctgtagtccttctctaagtagtggcataaacagtataggtagtaaggaacactgacaactcccactgtcttctagattcaggaagaacatcccaatatatgtttcaaaacaaaaactcacagctctcctcaaagaactcatattccattggaatagaaagaaggtctatgtataagcacatagacacagtacatacaaataaaaagtacaaattacttattattacccagaaatacagtttaatctctaattattgaattaattttccatggcttttcctagtagggacagtcttcatggacacatgagtgacatatttcacagttaagaacttgcattttttttttttttgagatggagtctcaagtctgttgccaggctggagtgcagtggcagggtcttggctcactgcaatctctgcctcccaggttcaagcaattctcctgcctcagcctcccaagtagctgggattacaggcacttgccaccatgcccagctaatttttgtattttctgtagagacagggtttcaccatattggccaggatggtctcaatctcttgaccttgtgatctgccagcctcggcctcccaaagtactgggattacagacatgagccaccatgcctggccaaacttacaatttttatattgtcacatgtatgatttattcagctacccttccactaatgtagatgattattagttgtccatttgtacagtttagcgaagagagtcaggtttgagttgcagttctgttcgttaacaaactgcatgaccttagtcaagatatataacgtctttttggtattcacttactcttaatatgggtattatattgtctacctacattataggtcgtgccacaaagcaaatgagataatacatgtaaaatctctttgaaaaccataaagtcctatacgtgtcagttcagaggggattagcatgtggcatactgtttagagagtgactgatattggtgatttctgagcagttggaaaagtgatctattgagtagaggtagagacctctccctacttctagcttataggtagatggtccttgaagattataagtacaacttaagagtcagcatctaaattaaagggctatacctaaaacaaggggctgaactgaataaaatgaagttaacagggaaaaatgtgagatgcagcaaaactgagagaggtgtatgacttgacagcaatgtgggtgaaaagaccaaggctgaatgtaagcagacctcacatggagtatgaagtccagtcttgtatacctcaaattattgtggattgcctactgattgtcctttgtttggggggatttttttttaccaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaaggtaagggggcagttcctggcatccttggtgaaacaatcatggcagccttcacacaatgtaggtagtgtctggggctcagaataagaactccaggacacagtaggagagctgatttatacttggaccatgggcagaaggtcttcacaaacaatgcacaaaatgtaaaatacataggtactagcccaaaggcctgatagctagctaatacctaatacctagcactggcaggagtatatcacactgatggtgaaggtggaagtattccccttcctgtatcctgaccagcagacttggactcccaagagacatagcacacaggggaaatttaaaccaattgcacagtctttatttctgtctttatttcacagagcatctagggtgaatccttaccttccttcctatctaaagaacttgctcgctcttctaaagtttagaatccagtcagctcttcttacctgtcttatgccttctgccaacacttctaatccccaagaaagaatactttttgcacttcttaacccctacctttgtctgcaaccttatgttcatttctttggaagcttgtcatacatctcattaaattttcctgggaatgtaagaaggtcaaggtgaatagtatggagcaaacaatggggacccacacttagagatcattgctacccatctatccatgggttctggcaatacccttatctgaagttacagtgagttgtctgtaacaaagccaggcctctttctttgggcagctgctgcctttggcctgaccttgcttaagtctgcttacctttctttctctggcacagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaaggtaagtcaggacacaggctgtgttgtggtgtcaagaccttgtattccatggcgtaaagtaccccaaaataaagcaaatgcttacataaaataaaggcagtggttgggatgccttggacaagatctgagtgctaaacacttgcttctaatatttatggctatggttaaacttacaattattctgtaaagctgttcagtagctccggattcctagaatcatctttgattacttagatgtttttcttttgtttttttcatggacaagcagcagttgcaggaggaattggctgagcaccaagtacctgtggaaaaactccaaaaagtagctcgtgacataatggaaattgaaggggagccagccccagaccacaggcatgttcaagaaactacaggtataaagcagcaacagtataatagtactcccttaattcctagtatgtacctctattctgcaatatgtcacattgtgttgtgcaaatatctgtggtgccaggctagaggctgagaatataaacatgaatagacatagattgtcatcaaagagcttatcctctaatgaactttattcttgcaccattgaaggaccttcacaatctggcttcagtcccttttccccagacatctatcttctagccacatctacttttctttcccaagtaaaccacttacattgtattacccctgaagtttttcctattgcttagctgataacatttattgaatgcttaccaagcgtggtgaaatcttgcccatgcttcaagatgtagccaagagtatatcatggtgactatagttaataacaatatatcgtatacaggccgggcgtggtggctcacatctgtaatcccagcactttgggaggccgaggcgggcagatcacgaggtcaggagatcgagaccatcctggccaagaagatgaaaccccgtctctactaaaaatacaaaacaaacaaacaaacaaaaaaatagccaggcatggtggcaggcgcctgtaatcccagctactctggaggctgaggcaggagaatggcatcaacctgggaggcggagcttgcagtgagctgagatcgtgccactgcactccagcctgggcgacacagcaagactccgtctcaaaaaaaaaaaaaaaaaaaaaaaaaaatatatatatatatatatatatatatatatatatatatatacacacacacacacacacatatgtatatacacacatatatacacacacacacatatatatcgtatacttgaaaatggctgtgagagtatattttaagtgttttcaccacaaaaaaatgataagtatgtgaggtaatgcatatgttaaatagcttagcttagccatcccactcctcaaaagaaacgaaagataattattcttccttctgggcttctcgaggacagtacttctagtattaatataccacttaagatttgatttttatcattaattgtgatgcatcttcctctgcctatgctctgttttaaagtcttaagttgtagatgtcagataagatacttaagtatctttagtcctcagcatctagtacaatttctggttctttgtatgcagtaaataactaatgcttattgaacttggctctgatactaatgcatttcaaacttattccttctattggtcttaatgtcaattattattacaattactatgttcaatgtaggactgggcatggtggctcatgcctgtaatccaggcactttaggaggctgaagtaggaagattgcttaaggccaggagttcaagaccagcttgggcaacatattaagaccacatccatataataataataataataataatttttattatttattatttaataatattaataataaagtctttaaaagcataatacaaaaattgtctccactctttcttttcatggcctgatttttcagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatggtaagatctgtgtcccaagagctagcatagagggtatgtttgctatgtgccatcattacataatgttgaaaaagtaacaagagggaacctaatatctgtgaatcatctaataagatttagaaatgataactaatctatgtaaagatatttctacccagttgagctggaatgaaagtggagatagcaaagtcatgtggtagaaggggtggagaactaaggtgatgagatgtgtggtattctggaggctcggttgcagtcctccagtcccccttgtgagatagcatatagttattagtttgtggctcagatgtcctggaataagtgaaccaggagctgacagacgtgttcttcatgacagaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggtgaggatatatctgccatgttagcagaataaagggaagagaagggcagggagagaaccagcatttgctgagcgcatactacatcagtcagtatactggaaactacctgcattatctttgggaattattacagtgatcccgtaaactaggtatcatttgtccattttttaagcaacacagtcaatatttatttttcactcttattacatgttcaacccaaatcagcagggccactcagttcatcatagtcactcaagggatgcagattgatggagatttcatcctgatataagctttcatgattactgcctcagtggtaaaagggcatattatatttatttacattttattagtcaaagcactttccacaaaaccacctatacctttcaagagggtgaggaaatgtaatctcaccacttacctagaaggtgcaaagctagaaatatttggtaaaagtattaacagctaccacagatatatatccagaagtaaaactgccaagtcatagtatatgcatatattaatttaattcgactcagtagtggccaatttgagctccagaatggctgtaccagcacacattcccacctgtagtacttcagcattcctgtatctctgcattgctgccttcgctttatccagctttctaactttttccatattaaagtggaatctcattgtttggtttggtttgctctcctttttgctttgaatgatttcaaacttacagaaaagcagaagaaatggtccattacacaccagcatactcttcacctagattcaccagttgctaattgttttccctctcttataaaaatataaaagagagtatcattatgggcttctatatttgttattaccattattctttatgatacttaacgttttcccaaatgtggtcggtgggagcctcttcaagctgtctcctgtggctttttgacatgtcttcctcagcataagagcacttttggaacttaagatatttgtggcacaataatgtatttccttgtcccctatctgaaatcagctatttatccaaggagtcccacttttagtggggaatgatatttagaaaccaaatctggacactagatgagctactggagtgtcactacttttaggttctttttaatagatagtgttaggaaatatatgtgtatgtttcttatatcataaaatcatactgatagtctagtctcaacgcaacaccataggaatcttcctcctttccacatttgtatcttcctttcctgtagggagaaccctagttcccagcaactttaatatatttacttatttgttttattctacaataaatataagatagttttagaattacattagtatttctaccaataacaaacctgctaaataaaattgaagatttctttggatttgtttttgtccttagcctatgacccactatgtactgtgttcaaaaattacctgaattattttttctgtaatttcttatataattagatttgtttctatttgtattcaactttaggactttatttttctacctttgttgattaaacttatttttaaatatgtaaagcattaacataggtcaaaagttaaaactcttcaaaaagttatactcaaggtataggaagtgaataaggatatattctcattgtctttcctgtctcttccatcccattttcacccatccccatagtaacacatttcaggtttatttttttctattcctttttaccaaaatgaacatacacacacattcttattctccattcttccttacaaaaaagaagggtatattacgtaatcctttgcttttttacttaatatgtcttggaaatcacttaatatggattcacagagatctttgttttttaaaccatactttcattgtgtagaagagttacagtttaatcaacaagactctttctttctttctttcttttttttttttttttgagacagagtcttactctgcgctctgttgcccaggctgaagtgcagtggcacgatcttggctcactgtaacctcaacctccacttgggttcaagtgattctcctgcctcagcctcccaagaagctgggattataggtgcctgccacgatgcctgggtagtttttttgtatttttagtagagatggggtttcaccatgttggccaggatctcaaactcctgacctcaagtgatctgcccgcctcggcctcccaaagtgctgggattataggcatgagccaccacacctggccaacaagactcatacgtggtggaaatttgaattgttgtttccgaaattgtgctattactactgaatagctgtgtgtattttttcccataatattggaagtgtatcctcagaataagttcctagagtggagttgttgcattaaagggtaaatacatgtatagttttgttagaaatagccaaattcccctccattgaaatttcaccattttgcattcccagcagcagtgtattagagtacctgtttcccctatagcctcaccaacaaaatttattatcaagcttttaatttttttctggtgtgattggtaaaacatgatatgtgaatgtggttttaatttttatttctcttatgagcgaggttgagtgtatttttacatttaagagtcatttatttgtgaactatctgttcatgtattttgtcattttttggtaaagatttttggttttctctcaatttttaaagttttttttttttagagttcttatatattagagagattaattctttatctgtgatatgttagaaatattgtttcccagattgtgcttttgacttatggtgttttttgccatgtaaacgtggaatttttttttttttttgagacggagtctcgctctgtcgcccaggctggagtgcagtggcgcgatctcggctcactgcaagctctgcctcccgggttcacgccattctcctgcctcagcctcctgagcagctgggactacaggtgcctgccaccgcgcctggctaattttttgtatttttagtagagacggggtttcaccgtgttagccaggatggtctcgatctcctgacctcgtgatccgcccgcctcagcctcccaaagtgctgggattacaggcgtgagccaccgcgcccggccgtaaatgtggaatttttgttctacatagaagattttatgagtattttattaaatatgtatttttagtcatagtttgaaagatttttgtcacacccaggttatgaaaaaatttattcatgctttattctaaaacttgttttaatttttttttacatttgaatcttttaacaatttaagcttattctgaagtatgaatcatgttacctttttctgttatgtctatctagttgttcataatagaagttgagtgccccaatccaaaatctgaaatgctccaaaatctgaaactttttttttctttttgagacggagtcttgctctgtcaccgaggctggagtgcagtggcacgatctcagctcactgcaagctctgccttctgggtccatgccattctctgcctcaacctcccaagtagctgggactacaggcgcccgccaccacgtccagctaatttttttgtatttttagtagagatggggtttcaccatgttagccaggatggtctcgatctgctgacctcgtgatccacctgcctcagcctcccaaaggcctgggattacagacatgagccaccacacccagcccaaaatctgaaactttttgagagctgacatgacactcaagaggtcatgctcaaaggaaagactcattggagcacttcagatttcagagcttcagattagggatgttcaactgctaagtataatgcaaatattccaaaatctggaagagtctggaattcaaaacacttctggtcccaagcataaaggatatccaacctgtatcatttatttgaaaagtccatattttccccagatttaagaaaccatcttcatcatatacacaatttttatatgtctttgagtctatttctggattttcttttttttctttttttttttgagatgggatcttgttctgtcacccaggctggggtgcagtggcatgatcttggctcactgcaacctctgccttccaggttcaagcgattctcctgcctcaggctcccaagtagctgggattacaggggcctgccaccacgcctggctaatttttgtatttttagcagagacggggtttcaccatgttggccaggctggtctcgaactcctgacctcaagtaatccaccgaccttggcctcccaaagtgctgagattacaggcatgagccacctcacctggcctatttctggattttctattctgttttgctggtgtttccattcatgtaccagagcatactattttaattatagaggctttatggtatattttaatgtgtggtagagagctagtcctcctcaatttttttctttcaaagtttttcataggtgtagttgcacatttatttttctatgtgaatttaggaatcaccttcattagttctagagaagttagcatttttatgtgggtcacactaaatgtattcattcacgcaaacacatatacatacataagcaaatacatacgcatgcacttttatggatgtgtttccatctagtcagatctgcttttgtgtttttcaggagtgtttttgatttttttgttcttttttgttttgagatggggtcctgctctgttgcccaggctggagtgcagtggcatgatcatagctcactgcatcctcaaactcctgggctcaagtgattcccaggagtctcagcctccccagcaactgggattacaagcaagagccactgcacccaatttcagaagtgttttaaaatttagattttgtgtttcttgttagttgattactaagattgagccttttgtgttgctatagtaagttgaagttttcattattgatttttgtgtgttaattttatagcctgctaccttgtttaactacttcgttgtttgatttcgttttattgttgattatcttgggttttacaaatatacttttttttttttttttgagacagagacttgctctgttatccaggctggagtgctatggcacaatctcggctcactgcaacctccgcctcctgggttccagcaatttccagctaatttttgtgtttttagtagagacagggtttcaccacattgaccagactggtcttgaactcctgaactcaagtgatcctcctgcctcggcctcccaaagtgctaggattacaggaatgagccaccatgcctggcctttttttttttttttttttttggaggcggagtctcactctgttgcccaggctggagtgcagtggcacaatcttggctcactgcaacctcctcctcgcaaattcaagtgattcttctgccttagcctcccaagcagctgggactacagagtgcgccaccatgcccagctaatttttgtatttttagtagagacggagtttcaccatgttggccagcctgatcatgaactcctgacctcaagtgatgggcctgccttggccttccaaaatgctaggattacagacgtgagccaccgtgcctggccatacaaatatactttcatgtgacctacaaatacagttttatctcttcttttccaattcttactccacagattgttttctcttaattgcattggctgttttttttttaattattaaattaactttttttaaaaaatagagatggagttttgccatgttgcccaggctggtcttgaactcctaggcttaagtgatccacccaccttggccccgaaaagtgctgggattacaggcgtgagccactgggcctggctgatatcttaagtataatgttaaataatagtggagatagtgtgtttacccccattttatagaagagaccatgaagcttagagtagtttagtagcttaagatcacaagttggtaagtggcaaagtgtgattgaatttcaggtgaggtgtatttgactcctgaaactttcattctttacgtcctgtcatggtacctcccaagtctttgaacgtttgtttagaggagacaagactgttttgtaattcctagccactctccagtggattgaagttgtcctacatatttatcagattttttaattgggctttttaatacaaaaaataattagctgggcatggtggcaggagactgtaatcccagctgctcgagatgctgaggcaggagaatcgcttgaacccaggaggcggaagttgcagtgagccaagataccgccattgtactccagcctggatgacaggagtaaaactctgtctcaaaaggaaaaaaaaaaaaaaaaatgtttgtttgttttttttaaacttttcactgagttgcatatttattgttttgatctagcatttgacctggcaagcatacctctttccttattcctttttagagtatatttataaggattagaggatttaatacatttccttgtttgcttgacaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagaggtgagttatcacttgtgttggtcagcattggggaactattttttcttgttatggagtgaaatgatcttttctcttttcttcctttaccagaacagatggcatctaaaattctactactgagttgtaggagggtgaaaagtgcctttttttaggcaaagctacctcatctacttgatgcttagtggtttttcttttctttttttttgagactgagtatcactctgtcacccaggctggagtgcagtggtgccatcttggctcactacaacctccatctcttgggttcaagcaattcttctacctcagcttcctgagtggctgggattacaggcgcccaccaccatgctcagctaatttttgcatttttagtagagacggggtttccctacactggccaggctggtctcgaactcctgacctcaggtgatcgacctgcctccgcctcccaaagtgctgggattacaggcatgagccactgcacccagccacttagtggtttttctaatagtaactaatagaaagtagggatgagttccctctctttgtgatcagaagcctaggccacttggaccaaacagaacaaatttgaggcagcaagtaagattacagaataattttgaaagaagagaaaaattggaagagacttcctagacataattaagggtgatgttggcagtcccctggcttttttttttttttttttttaaagatatggggtcttgctatgttgaccaggctacttgtgaactcctggcctcatcgatcctactgccttggcctcccaaagtgctgggattacaggtgtgaaccactatgcccagaccccctgcttgttttgaccacatttaagttgctattttagaagagtatctggattcttctttcaaggcaaacaagggaatatatgacaaggctggctgattttggtccctgttgaaaagccatgattcctcactggacagcctcacatagatttaagagcatgaacaagacttcttatctaagtttagcgataaatatgatcttgatttagcagataactgccttagtgattagaagaaaagagttgctcaaaccaacattattagcagcaggttatctaatggagaggatggggacaaaggtcaagaaagcttttgtttttcttcccctatgctgagggcctttttactgtatgaggaatcaggatttctggattgacatctgtctgatagatatggccatttccaaaactttccttttgatttagtttattcattggcatcattaatctagaactaatcacctaacttctgtgagcctcagtttcggcaccttccttgctaaagcaatcagcacttgaattggtccttgaaagagtcaaatagctaaaatgtagcagggccggaattgagatccaaagcctgcattctttccattgtatcacagtacctaaatagcagcctccctttagtttttctcactttcactttagcctagagtaagattgaagacctctttccccagaaatgtccaaacaagggcaatatattcctgagtttggtacgcttcaatgttatatgcggttgttcagccaaacctgctatggaaaagattatgagaaagaaaggccatgttaggtaactgatgtctggagtcacagaatgaactactcttagctcaagttgactttataaaacttagtctggcaagtaacaaaactgcttcattgacagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaaggtaggtgaacaaagggactccaagaattgggctaggcactggtttgaatacttgtattaactggtctccagctgtggtggggaaatgtatgagaaatccaagttgtcagtctgcatcagaacagaaattcctacgttttcttcatatgataaccatctacccatacagtccttgagaagcatacactctctttgtatgtttgagaattagacaaatatatttgagcaagtaaccagataatatgatcaggaaattgaggatagaagaactagtactacttcagctagtaaaggaaaagctagaatcagatggttggaaggtaccttcaaggatgggaccaaccttcctcccattccctgcaaaatcccttctgtactgtctttgatccgtaattatccagcctctgcttacacctctaacctatgtcttccttttgttgaaataagccaaatatgcctctgactaactgtcatgcacttatccttattttctcagtaaagcatacttcatcctgagcagatgaaagaaaagcgtttgattgctttcacagagtgagtgccaggagcatttgctgttgggaattccctaggacagagctttcccaacatttttgtttcacagtgcccatggtgttttaagaaatttgtcatggcacctcaaggccaaaaaaaacagaaacaaaaaaaaactcctaatacttctacttgctaagaagttaggtccaaacaacttagtagttgttcatatggtgttcaacagatgtcactgtattttcctcaaaaatgtaaaatattctgtgagtaaagccatagtttggggactgtggctctttggaatcaagagtgattaatggccaggcgcagtggctcaacgcctgtaataccagcactttaggaggccgaggcgggtggatcacaaggtcgggagttcaagatcagcctggccaagatggtgaaaccccatctctacgaaaaatacaaaaattagctggacgtggtggcaggtgcctgtaatcccagctactcaagagggtgaggcagagaattgcttgaacttgggaggtggaggttgcagtgagctgagatggtgccactgcactccagcctgggtgatagagagtgagactctgtctcaaaaaaaaaaaaaaaaaaaaagagtgattaattaaagaactgacaagcagtgaccaagggtcagtttgaaattaggcaatatgagtagagctctgtgcctttctctgcagcttaaagtcaaaagcaaactaagtagattgtcagggatattcagtatggaggagggcaatgaaggctagaatggtgtcctttctctgaaaggagtaaaatcctacaactatggcaggagacatcttggagacttaacgtgatgtggtatttttgtcttagagcaaatgccattgtttcctgacggatttctgtggtagttggatctttgatttcaaacccaatataaagtttccttaataaatgcaaagtatagcctatgattctatgtatttttctgtatctcaatatctagctccttatttatcctctagttaccatttctttttttatctttatatgcatgttgttccctcttgtccatctggcaaactcttatctttctttgctttttttttttttttaagacggagtctcactctgtcacccaggctgggatgccgtggcatgatctcggctcactgcaacctctgcctcccaggttcaagcaactctcccgtctcagcgccctgagtcgctgggattacgggtgcctgccaccacgcccggctaattttttttttgtatttttagtagagacggggtttcaccatgtcggccagtctggtcttgtactcctgacctcaagtgatctgcccgcctcagcctcccaaagtgctgggattacaggtgtgaaccaccatgcccagccattatcttaattcagagctttccttcctctaggcagaattagatagaactcctcttatgctcttggaattcacagactgtccataatactgtaatagcatttatcacattataatgcaattgataatctgagcttctggttttagaaattgtatcataattctattttgtaccccagtgtttggcatggtgccagtcatatagtaaatgttcaatagatatttgataaatgaataaataaatcagaaggatggtctcttaatgcttttcaaaacactagggagtatatacagaacagatgtccctacttatgaggaaaaagccccagatactacatttggccattttcttctttaaacagagtctactagatgactgggcaagtaagggaactctggtggaagaaatcaattgcaaaggtacttctttagaaaatctcatcatggaaatcacagcacctgattcccaaggcaagacaggtgagtacaggctcttcaaaatatagtgaataaaaattgctctttgcttttggcctttggagatgcctccttatataattaaagtgaaaatcaaggttggatatgaaaacaaagggcatgcccaaagcagtcttcccctgcaacctgacctgtcaccccttttgctatataacattgctccattttgcaaaattccttcccatgatggaaaaagtaaatgaactagttgtcccacttagaactatcaaatgaacactgaataattaaaatgagattttcatcttgagaatttcccttttttgaatgtgtaaatgggatgggtaagcatcatctttaaacttgggcactggccagccacgaagtcagaagatcaaaaccagcctggccaacatggtgaaaccccatctctactaaaaatacaaaaattaggccaggtgcggcagctcacacctgtaatcccagcactttgggaggccaaggcaggcggatcacgaagtcaggagattgagaccatcctggctaacacggtgaaaccccatctctactaaaaatacaaaaaattagccaggcatggtggcgggtgcctgtagtcccagctactcaggaggctgaggcaggagaatggtgcggagcttgcagtgagccgagatcacgccactgcactccaacttgggcaacagacagagcgagactctgtctcaaaaaaaaaaaaaaatacaaacattagccgggcatggtggcacgcacctatagtcccagctactcgggagtctgaaacaggagaatagcttgaacctggtaggtggaggtttcattgagccacgacagtgcatgcactccagcctgggcaacagacagagtgagactccatctcaggaaaaaaaaaaaaaaaaaaaaaaaaaaaagttgggaaagcctgggtaggtatgattgtgatatccaggaagaagcaaggtatttagaagtcagtgttgggccaggcatggtggctcatgcctgtaatctcagcactttgggaggcctaggtgggctgatcacttgaggtcgggagttcaagaccagcctggccaaaatggtgaaaccttgtctctactaaaaatataaaaattagccaggcctggtggcttgtgcctgtaatcccagctatttgggagtctgaggcaagagaatggcttgaacccgggaggcagaggttgcagtgagccaagatcgtgccactgtattccagcctgggcgacggacggagaccccatctcaaaaaaaaaaaaaaatcagtacttcaaagggggtacaaagattgtgcccagatgtgtatataatctttcactgcaaattaagtctttgaagcaaaatctaatatgaaggccaggcacagtggctcacgcctgtaatcccagcactttgggaggccaaaggaggtggaacacttgaggccaggagttcaagaccagcctggccaacatggtgaaaccccatctctactaaaaatacaaaaattagccaggcatggtggcttgcgcctgtaatcctagctactcaggaggctgatgtgggagaactgcttgaacccgggaggcagaggttgcagtgagccaagattgcgccactgcactccagcctgtgcgacagggcgagactctgtctaaaaaaaaataaataaataaacaaaatctcatgtgagttcccagtcacttgctcgttgttaattgagatcacataagttttattactagtctgtgatagtgcactcctatagtcacttaacgagtaaaggaaaaatttatttgctttctgaaaatgtgtacttttctatagtattctaaagttaaaagatattttggaactatccacaagtgacatttcagggaattggtgatatatcaacctctacgttcagtgacttattcgtgtgactaaatcagagtcagcaaactttttctataaagggccagatagtaactattttaggtttgcagggtatatggtctctgtcacagtcatatacctctgccattgtaacaaaaacagccaaagacaatacattaatagaaatgagtggttgtgactgtattccagtaaaactttgttgaaacaaagggccagatttgactgatgagctgtagtttactgactcctagactagatcatttttttaaaaaaaaaccagaaatctcatatagaacagaaatctcatatagaaccctactacgtaaaacaaaacattttgttggctgccgggcgcagtggctcacgcctgtaatcccagcactttgggaggccgagacgggtggatcatgaggtcaggtgatcgagaccatcctggctaacacagtgaaacctcgtctctactaaaaatacaaaaagttagccaggtgtggtggcgggtgcctgtagtcccagctactcgggaggctgaggcaggagaatggcatgaacccgggaggcagagcttgcagtgagctgagatcgcaccactgcactccagcctgggtgacagagcgagactccatctcaaaaataaataaataaataaataataaaaattaaaagaaaccattttgttggtgtaagtttcccttatatgttattttatagcatttatctgttatgaaatccatcagtaagaatattgagactaacttaacgaatataaaaatttgaaaaggaagattattggatgacagcttcaccatctaatttctttctttctttttttttttcctgagacggagtctcgctctgttgcccaggctggagtgcagtggcacgatctcggctcactgcaagctccatctcccaggttcatgccattctcctgcctcagcctcccaagtagctgggactacaggcacctgccaccacgcctggctaattttttgtatttttagtagagacagggtttcactgtgttagccaggatggtctcaatctcctgaccttgtgatccacctgccttggcctcccaaagtgctgggattacaggtgtgagccaccaggcccagcctatctaatttatttctaaattttgtttggtttcattgtatccagaaaatatggttcacacagattaagtaactgcaaatgatgacaaatgtttttgaaagttgacttcacaatgtcagaacaggctttgattgaattgagctagaaacttgaaagtgatgtaataagaaattattgtttcaaagttaaatcactaagaatatttaatgagggcttttacacatagaaaacacttaagactgacattgaggacaaaaactgtccaactgacttgaagtgttaagaattctattattacacaattctgccacaatgagaactgtgtagatgtacagagagcaagtcgtgttatatttttggtcgtgttatttaatgtattacacatgtgctatagatgtttttctttgtatagtatacatgagtggacatggacaggtttgaatatcataaattgctggtaaagagctaccacctttccaatcagggacactcaaaaataacttaaaatagatgcttagatgtgtcaggagctgctttactttccccagaaaagcagcataattggttttatctggtgggttaaggtgtagaattcagcataattgaacatgcatgttttattatcatttctaagtacttagaaatttatgtgaatattacatttaaaccaaacattaaacacaatccctaaagcacgtttttagggtgttttgaaaatcagtttgaaaattactatcttgagtgctctcaaagttctcctccaactctgaaaaaccatgtatatttcagttccttacatttatctagctccgtttcataaagtactttgatatacattcgctcatgatctcttcccagttaccccatgagagttaacaggataggttgtattatctttaaatcctgcagaataaactgtgtttgtagattaaggctcacatactgagttagtgacaaccttggttagtaccgtcttctcccacctactagtccagtttctttttttgcatcaccacactgcaatggaatgttatttttctattttgtattttttaatcgaaaatataataacattaacatttaaaagttttataatcaccaccctaattcagctaatttttttccttccttttagagacagggtctcgctctgtcacccaggctggagtacggtagtgtgatcatggctctctgtagctttgacctcctaggcccacgcaatcagcccacctcaagctcctgagtagctaggaccacaaatgtgcactgtcatgcctgactaattttttttttttttaatatttttttgtagagacagggtctcgtgttgcctaggctggtcttaaacttccaccctcccaaagtgctgggattacaggcgtgagccattacacctggcccacaactattttgtttttgttgttgttttgagatggagtcttgctctgtcgcccagactggagtgcggtggcaccatcttggctcactgcaacctctgcctcccgggttcaatcgattctcctgcctcagcctccccagtagctgagactacaggcgtccgctgccacacccagctaattttttgcattttaatagagatggggtttcaccgtattgcccaggctggtctcgaacctcctgagctcaggcaatccacccacctcagcctcccaaagtgctaggattacaggtgtgagccaccgcgcccggccaactattttgtaatataaccttgcacatgactttttgtacagtgaagtcagtgcatatgagagttttctgtccttttaaagtatcattatgaatatttttcagatttctgtataatatttatcattacctcacctgatttttacctatcttgggaaacttctgaaatataaggaatcagtttggggagaatgtatgtgaaattatggtgattagaaacagaaccaaaggcccaaagcacaatttataagaatgttgatgagccagatttattggcacttaggatttctgttttttcttggggaaaggtgagcaagaagaggttatgaaagaaaaggcaaataatcttcctttaaaaacaatataagaagggctcattttaatgtctttattagaagaaggctgctttttaggccaggcacggtgactcatgcctataatcccagcactttgggaggccgaggcaggcagatcacctgaggtcgggagtttgagaccagcctgaccaacatagtgaaaccccgtctctactaaaaatacaaaaattagccgggcctggtggcaggcgcctgtaatcccagctgtttgagaggctgagatgggagaattgcttgaacctgggaagtggaagttgcagtgagccgagatcatgccaccgcacttcagtctgggcaacagagtgagactctgtctcaaaaaagaaaaaaaaaaaggctgctttttctgtccttaatggtattttcatttttattatattgaaagatattgatataaaaggtgaaactttctggctttattataaaagcttattccaaaatatggcaagtaccattctagactgaataattttaccagtacttgcttcacaaaattagggcggcatccagagaattcaagttggagatttaataaaaagggaatacgaatttcctctagaagggattaagaatcattcctgctaagaaccttgagtgacgttttgttgcctggcagctaaaataatttgtctctttccatgagtatgttgtcttgtgctgtgttaacttcctgatacctaagcttaaagtgagggccaaaggacaaattcagtgcctatatgtattcctaacacgttggtcttgccctgtttgtctccctgtccttctgctcaggttccatactgccctctgtaggaagctctgtaggcagtgtaaacggataccacacctgcaaaggtgagaatgccatttcaacagtgcttctttgttggatgtgttaggacagtgtctatgtttgcatctgtgtatgttgcaatatgtggtggaagaactgctgccagaatgggtgtgaggataaaaatctggggagaagcaactgtggtttgctggctatagaccataaacaggttggcagcccctgaagctaaaggtattgtagaaatacaatagattggatcactagataaggcaaatagggaaggaactcaaagaaaatatatgttaatctttgaattataaagaagttatactagagataatctagtctagctctcagcctcccagctaggtgacttctctgtagtttggagaagaaggaatggaagaatgctccaagtcccttaatcccaatagtaaactaaggttaatttcttactttgctcccttcacttttgttgttcccatgtttagcattttaaggtatacatctgagtatataatgccaaaaccagaaagcagattaatgagaatgcttttgttttgtgtatataaatgggaacttttgtatgatttagcaggaagataatctctaattcactagaaggagtaagagagatgcaagtaatttaggagtgaggagtcaaggagcatactcgaagagctgtctccaatctgatttctgtttctatgatactagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggtactgtgtttacattagttgcctcccaacaccaagaggaagagacagctgtaccagtgttcctgcccaagcccaggtatctgagagagagacatgggcaacaatctaggctgtgatgggcagtatgtttgacattctaaatgattaatatgccttaactctcctagagaattttcttatgaaattagaaattgttataagttagattcagaaacaaaaccaggtatgtttgcagaaaaagaatagccctccccagaatcgttagctcattgagaatgggatctcattttctatatgatgctgtaagcaagacaaaccattcttatcaaagtatctttccaattcttagagggatctaaataacagtgattacagttcattcttaagattgacatgtgagactaggaaaaatgtcagaagatataagaccacagaaaatcctgtaggcaagtttcaccaaaacttttaatattcccattgagcgtagcatctcatctccttcaagatatgttatcatcatatcttggtatttttagtttattttgattaataattccttcttattgagttctactgatgtattatacataaaagaaactcagatcctgccatttagattttcattttaaaataaaaattgaagtagaagggttaagtatcttaacaccactaaacaagtcattgataggatcctagtagagtctataataactgcccagttttccaatcatttctaccacacacacaactttgtttcctgtccagaatctcatggcatgcatggcattctttctcctaggccttcctggctgagttggaacagaattctccaaaaattcaaaaagtaaaggaagccctggctggattactggtgacatatcccaactcacaggaagcagaaaattggaagaaaattcaggaagaactcagtaagttttcacaagagtgttacaaatttgctaagttacttgtcttcaaagcaagtagagaatttcagcacatcctataaaacaggaattatttttagttaatttttataaataagcaattaggatccagatagggccagagcatgagcctgaattgggaagaaaattagaaattccactcaaaaagtcagaagtttggctttcttgggcaagtcaaactggtaatctactgtgatcaagaaccaaagagaggccaggaacagtgcctcacacctgtaatctcagcactttgggaatctgagacaggaggattgcttgaagctaggggttcaaaccagtctgggcaacatagcaagatcctgtctctacaaaaagcaaggaaaaacaaattagccaggtgtggtggcatgagcctggagtcctagctactggggaggctgaggcgagacgattgcttgagcccaggagttcaaggctgcagtgagctatgattgtgccactgaactccaacctgggcaacagagagggaccttgtctccaaaaaaaacgtaacaaaagaactaaagagagtattaatgataaaaatgaaagatggaaataataaaaatattcaataaagagattagataaattgtgtactcataatattgaactgtaaacaatgtagatgaattttttttaatttaattaaattttttttttgagatggagtttgctcttgttgtccaggctagagtgcaatggcatgatctcggctcaccgcaacctccgcctcccaggttcaagcgattctcctgcctcagcctcccgagtagctggcattgcaggcatgcgccaccatgcccggctaattttgtatttttagtagagagggggtttctccatgttggtcaggctggtctcgaactcccgacctcaagtgatccacccacctcggcctcccaaagtgctgggattacaggtgtgagccaccatgcctggccttttttttttttttttttttttggggggggggacagggtcttgctctgtcacccaggctggagtacagtggcacaatatagctcactacagcctcgacttccctggctcaagcaatcttcctgcttcagcctcctgagtaggtgggaccacaagcatgtgctaccacaactagccaatttttaaatttttttggtaaagatagggtcttgctttgttgtccaagctggccttgaactcttgggctcaagtgattttcccacttgaggagttcaagaacagcctgggcaacatagggagatcccgtctctacaaaaaataaaaaattaactgggcatggtggcacacgcctatagtcccagctacttgggacgctgaggtgggaggatcacttgggcccaggaggttgagacttcagtgagccatgatcgtgccactgctctatcctgggtgatagagtgagacactgtctcaaataagtaaataaataaataacgcttctggggtcatttcctgcagtatattaggaacataacttaggtaccaggccagttgttgataatgtaaaggaatacattccctcatttcctctctacagattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccaggtgagcaatatagcaacaaagaaattggaatcacatgaaactgggtttgaatgtttctcccagtaagtagatttcatgtgatcctggacaagtcatttaatctctcagagtctcagtttaaatgaggtatttataaggtgttaatcatggtgcctgtaaaatagtaaacagtcaaaaactctattattattattaatagagacagtaagatgagtagatatgagaatggggagtttttctgactaaattgtggaattacattttacttttggctgggcgtggtggctcacacctgtaatcccagcactttgggaggtcgaggtgggcgggtcacaaggtcaggagatcaagaccatcctggctaacacaatgaaaccctgtctctactaaaaatacaaaaaattagccaggcgtggtggcatgtgcctgaaatcccagctacttgggaggctgaggcaggagaatcatttgaacccaggaggctgaggttgcagtgtcctgtccggacagtagagcgtgactccgtctcaaaaaaaaaaaaaatttttttttacttgtaatcccctgtgatagtgatccacattacttaatatcttatatctgccggctttacataggattttctgtgatcaaacctcaaaaaaattgatttaagtgcctaacatcatagaaatttaggttggtcaggccgggtgcagtggctcacacctataatcctagcactttgggaggctaaggtgggtggatcacctgaggtcaggagttcaagaccagcctggccaacatggtgaaaccttgcctctactaaaaatacaacaattagccgggcgtggtggcaggtgcctgtagtcccagctactcgggaggctgaggcaggagaattgcttgaacccacgggatgaaggttgccatgagccaagatggtgccactgcactccagcctgggcaacagagcaaaaactgcttcaaaaaagaaagaaatttaggttggtcaaaattatgtcattcccaatgaaatcctgcctggaggcttttacttcttttacattctcccgcagcctggtccatgtcttctcaacttaccaggttccttaaattaagacctaagagtactttttgaaggaactgcttcttttagttcctgcatccaggtaattattgagtcctatttagtctacttaacaaatatttttctaatccgggattttcaaactttttggcttcaagaaccccttttattctctgaaaaattactgaggatccccaagagcttgtgtttatctattaacatttattgtattaaaatactgaggaattttaaaagtatatatttaaatttttaaaatagcaatgataaaaccatcacattaacgtaagtaacatatttttaatgaaaaaatagcattttccgaaacataaaagtttgataataagagtggcattggccgggcacggtggctcatgcctgtaatcccagcactttgggaggccaaggcaggcagatcacgaggtcaggagatcgagaccatcctggcttgcacagtgaaaccctgtttctactaaaaatacaaaaaattagccgggtgtggtggcgggtgcctgtagtcccagctgctcgggaggctgaggcaggagaatggcatgaactcgggaggcgaagctgacagtgagccgagatcgcaccactgcactccagcctgggcaacagagcgagaatccgtctcaaaaaaaaaaaagtggcattgttttatgtctttgcaaatcttaatttctggcttaataggctattctgcttctgcatatctgttacaatatcgaatgccatgtagcttctgggaaacatcattgaacatttgtgacagcgcagaaattttaaaaggcaaataacatcttagtattattatgaaaatggttttgatctctgtatgtctgctaatcctagaccctcccctgaagtgcctttcaccagccttaatctctgctctgcttggagaactgctcgttctttattgtcacatctagggagcctttcctaatttctgtcttctgccatttgtcatccccagcggaattagccaccctattccatgctttcacagttctgtgttgcgtgttcacatcagagtttaatcatttttacttttgttacattttattatagttcattgtttacacatttgtcatttcgtgaggctatgtcttatttatttttgtgcagtgtaaatactgagtactttctataaattatctcatttaatccttataacagccaaagtaagtactttactgtcctcattttacagatgaggaagctggggtttgagaacttatgaaatcttgcctaaggtcatacagctagtaggtgacagaaccaggatttgaacacaggcagtctgactccacatcctgtaatcttaacttttttgatgaaagcagcaagggatatgaaaagaaaaaaaagccatagtcattgccttaaagaagctctttgtctaattatgctatattataaaatacagattgtatatgctcttcgaattctaagaaagaaactaagaaaaacagacactgagagttgacatggcaagcccagctagtaatacagctggctctgggatccagtgttctgaactcccaattcagaggcttgggtattgcatggcaaagcagatgaatgccaactttaatttctcagccgtgtctggccttagtaactgacattgaaacagaatgggacaaataaggaaaagaaataaaataggaacaatcagtgatcctttcaaagtaagtttttattaagcaattgttaagtgatactgcctcagcctaatagcctggtcctttagttttctggcttatagttttaaagtagttggcactatttggcacaatccaacatcagtttttgttttgacactgctttttcttttttggagacaaggtctcactctgttgcccaggctggagtgcagtggtgctgcctcagctcactgcaacctcggcctcctgggttcaagcaattctcgtgcctcagcctcccgagtagctgggactacaggtgttcaccagcacgccccactaatttttgtatttttagtagagacggggtttcgccacgttggccaggctagtcttgaactcctgacctcaagtgatcctcccacctcggcctcccaaagtgctgcgattacaggcatgagccactgtgcctggcctgacactgcttttagatagatctgtttttttcctgtctaaacatcttggtgtcatttctatttcagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcaggtaagttggggtgaagaacatacttctgccattattagaggcaagcagaaagaaggaatgggttaggagtagtcccaagattctaggattcccttacgtaatttgtagactcagaatggtgttaaaccaattccttctcctagttgcagtgagaactgttgtagttgttacacagtgaacacttaaaaatgtgaaggtttacatagcatagtcctaaagataaaagctctaataaaatttcagtcagcaagtagagattcatccccatagatgtactgataaatggagttccacatatactctcattgatacccactttttttttttttttaatattatgcataccacacacacacggtctcgctctgtcacccaggctggagtacagtagtgcgatcatggctcactgcaccctcaatctcctgggctcaagtgaacctcccacctcagcctcccaagtagctgggactatagacacacgccaccatgcccagctgatttttttttcttttttttttttgagacagagtctcactctgttgccccagctggagtgcagtggcacgatcttggatcactgcaacctccgcctcctcggttcaagcaatcctcctgcctcagcctcccaagtagctgggactacaagcacgtgccaccatgcctggctaatttttgtatttttaatagagacggtgtttcaccatgttggccaggctggtctcgaactcttgacctcgtgatctgcccgccttggcctcccaaagtgctgggattacaggcgtgagccaccgcacccagtgattatttttatttttagtagagacgaggtcttgctttgttgcccaagctagtcttgaactcctgggctcaactgatcctcccacctcagcctccccaagtgctgggattacaggcatgagccactgcacccggctgcttctggacttcttatgataacttggtagaagaaaaattgtgccattaatttattatttatttttctggaactgtttatgactttcacgtttaccagctagaagtcaaagtttacttctgttacttagatcaccttacaaggttgatacgaggattaaataagatagtgtacatgaaggagcctaattatatgcctctttttggtaggccctcaagtaacattagttcccttcccccaagattagaccgtatactctcagcaaacattttaaatgccagggttcaggctttattgatttcaattttattttctcatttcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaagtaagtctgaaccttgtttttctttttcttttacatgtatttatttgcttgtaacttggaaaccagtcaagtatacattttaacttctgtccctagttttattattgtcacttccatcaccatgaaagcacactgtctgaagactaaatagtctctcggacttctgagcaaactggtttgagcatttttctttttctttttcttcttcttcttcttttttttttttttttttttttttgagacagggtctctctctctcacccaggctggagtgcagtggtgcgatctcggctcactgcagactcgacctcataggctcaagcgatcctcccacttcagtctcccaaggagctgggaccacaggcgccaccatacccggctaattttttgtattttttgtagagacgaggtttcaccatgtctcccaggctggtctcaaactcctgagctcaggcaatccgcccacctcagcctaccaaagtgttgggattacaggcatgagccatcacgcccagccagagcatttttctattgtagtttatttcagtctttataaccaattaaggatatagaaagaaatgtccaagtcttatctcttactctaagaatttccttttaggatttcttgagatttcagattaccagattttgtaatagcagtgaatgtatcttcaggtctctggtttttgtgtgtttttttttttttttttttttttttggagacagagtcttgctctgtagcccaggttggagtgcagtggggcgatctaggctcactgaaacctccacctccggggtccaagtgatcctcctgcctcagcctcccaagtagctggggttacagtcgctcaccaccacgcctggttaatttttatatttttagtagagatggggtttcaccatattggccaggctggtctcgatctcctgacctcaagtgatccacccgccctagcctcccaaagtgctgggattacaggcattagtcaccgcactcagccccctgtttttcaaattgaggtatgaaaagccgtaagttaaacatagtctcatcttcctaaagggtttattttacatagattttaggggaggatattgatgtatatttgatatattatggaataaaacataaaattatcattaattgttaagataaaacatgacacttcaaataaatctcccatttatatagtaagcagcttaataatacatcccagactcctcaagagtacaagttctttgcctataggaaagaagtttgagaagtactgccttaattgcaaaaatactttaattctttgcctgagccaaaatctccattcctgagattgtgtgagtataaattaaagtaacaggagatgattacatgacccaaaagtgtggatttactgggttaggagcacatctgttggatcttggttctcactatattaacctgttgcccctagagttttccttgtggtaaatacgtaaaagtctctcactctgccactgtacatggaatagatttggaaaggatactttcagcactttgtttccatcactagagttaattattcctgcttacacagttaacactcctgccattaaagtaaaattgtgatctcagagaccctgcttgccagcgttatttatcttaaaaacatggatgcagaggtaatgttgacaccagctcagagccacgtagtcctagagacgtcacagttttgtagacaggatccaagtgcaaaaatgtggctgtttcagaagggcccctctaggagcttgggagaaattcagcactaaagtgggacattggctgaaggccttcttaccatgtttggagatagtacaattttgagcaagaggagtcatcgtatttgggtttcttgaggcacccagataaggaaagggtaggtagagaaaacgtaaacccgtgaagcagtgcattcctcttagaaacttcctttctagtggtagtgtggccttccctgtttcagcttgcacatttttctttcctcttttgttataagtgtctcaaaagcagagactttcttctacaggtatgcttcagttatccaatttacttgcatccaggctatttagaattaaccatctaaccaactcaatgaaatttttagaaaactgaaacttatccctttaggctccaaaatagttttgttttatcagccgggtgcggtggctcacgcctgtaatcccagcactttgggaggccgaggcgggtggatcacgaggtcaggagatcgagaccatcctggctaacacggtgaaaccctgtctctactaaaaaaaaatacaaaaaattagctgggtatggtggcaggcgcctgtagtcccagctactcgggaggctgagacaggagaatggcatgaacccaggaggtggagcttgcagtgagccaagatggcgccactgcactccagcctgggtgacagagtgagactccttctcaaaaaaaaaaaaacacacaaaatagtttcatctaaccaggttctggtttatataggaattattttaaactcaatttgcctaattttctaaatatgtattatgcataagttttttttaatgagtgcaggttaacattatttaaatggttgtactgtctatactatggtgatattctcaaggatgtgagacacatttggagctgctttgtattaagtattcccaaattactgtgcactttgatttctatattgaagttattgtttagggcctctatagtattatactggttggattggctgtgcatgtgtgtgtggagaggaggaggtaattttgggatttctgcccaccaccatgatattggttattatttcctactgctatcacttttcactgctgtcatttggtctgtgtagtctattcctcccttctaatcttcactgagctagaaaatgagataaacaggcctgttaaaattgcattagatatgagctaaaatgtacaaaagagtccacatgcaggcataaatagtgtttggatttgaggacaagtcatcttttccttttcatttaatccttggtttctagagacattctgacttttgatgttgctggaagatttcaaaaaattactgggcattactttatcttatttctatcctagtatgttgcctaatagtgctcagagttcaatagcacttagttgcttgtcatagccaaattcgtttcactgatttctaaaaataagccttccacctcagatactctggatgtgaaggctgggactggacactgatcggctgggctcttgcagagtgtgttcatcaacagtggactggtgttgacaaggcaagcctggaagaagagtgggagaagggagaagggtggtggagtgtcctgtgtgtagtccattgtcaagtcagtaggtagttaccataaaatgatcagtatccaccctcaagttggggatgcaaatcaaaagccctgttccacctgtccaccttgtagggaagtcaaaagctttggaaagagtttttgccttctcccagcaaaaatctttggtcaggaggggaggagcatattcttggctgaactcatgctgagctcatcggaagtgaaaacaatgagaggagaaaaattctgtgtgtcagttccatagtccccaggaggccgcataaagggaaggtctttttggacccattctgaggactgagtcattttcatgatttgagtgtggagttcctgggttaatgtattatagtccagccatagattaatctttccttactccagcagcagaccagatttataaagtatgactctgttttcagattcaaattatttttaataaggtaaaaacaaagatgaagataaatatttttaaaaacagcattagctgtaagttttcagctctttttttaatggaatcatacttttagcacagaatctgcacaagagaagaggatatgaatctgggagacggaaactctgctttaacccagctaactccatgggagctagaatagacagatgagttaggcctgtgaagaaccccccagtcttacttgggactgtacagtcttgctgatagatccatggatctgcagtctgtggggaaaattatttcttccttaaatgaatgtggaatactaaaatacattattcctaggaaaggctttccctcagttgcttctgaatgattagtaggtcctcactggcagaccagattctatcacatgggagtggaagagagttcctttccactcaaaccaggcagagatctcaggcttcctgagttaggatctttaccaggttcagctctctgttggaagtagaaaggaagaagccattctagaaatcactaatgagaggattgagcttgttttcagaaagctggaaagaaaagactttggcaaatctcttcaggaaattccgttttcctgaacaagggagtctggttattgaggaaaaggaattgtatgtgtctaacaggaggctaacaagaaaggaaggacgtttttatcactgaaacttgagccaaagaattcccctagagtgaccttcctgggaagggtaaaaaaaaaaaaaaaatatatatatatatatatatatatatatgttaagtctctgatgataacaagagattttcctcattttgaaattccctacgtaggttttacttgaactgagatcattctgaatcttaaaccaacccctcctttgccccctgctccccgcaagaaccatgtgacttctcactcagaaagtatttgatggtttgggcatcatactggtgagcattatcaagaaacctggatgcaccttcattcacttgtttttcatatgtatttatattgttgtgtatttgggtcatgcttcagacttggcattctacctctcagtgataaaatgaacaatggggccaggcacagtggctcacacctataatcatagcattctgggaggctgatgtgggcagatcacttgagcccaggagttcgagaccagcctgggcaacaaaatgaggcggcccttctataaaaaataaataaattagctaggcatgacggcacatgctgtggtcccagcttacacaggaggctgacgcaggaggatcacttgatcctaggacgttgacgctgcagtgagctgcgtccatgccaccgcagtccagcgtgtaacagagtgagaccctgtctcaaaaaaaaaagaaagaaagacagagagagagggagggagggagagagagagagagagagaaagaaagagagaaagaaaagaaaggaaggaaggaaagaaaagaaagaaagagaaagaaagaacgaacgaacgaacaatgggaaaaattgactgacagacctctttagggtctgcgagtttctcatagtggttcacttcacccagtggtgcatataaagcacccaaaccagttggtcttttcctttcttgtctttgaggctgggctgctgggttctaataggtgcagcatcaggcttccttaggattattttcattcctaattcaggttgagcagagcccaggatcagggtctcagtatacttgaagtttctaccgggggacctaggtatcctactatgaaaacagaataagaaagtcttgtaaacgccttcatttgattgattgattgattgattgattgattgattgatttattgccacatagaaagcaagcttaggcatcttcatgtgcacatgagaaaagccctggaagaggctgggggcggtggctcacgcctgtaatcccagtactttggaaggctgaggtgggtggatcacctgaggtcaggagttcgagacgagcctggccaagatggtgaaaccctgtatctactaaaaatacaaaaattagctgggcatggtggcacatgcctgtagtctcagctgtttggggaggctgaggcaggagaatggcttggacctgggaggcagaagttgcagtgagccgagatcgcaccactgcactccagcctgggtgtcagaaagagactccgtctccaaaaaaagaaaaagaaaagccctggaagacagggcccagcatggagttgaaagactgccagtttactccttcctttcaaatgattacaaggacagtatcagctcatgtacgtttttggcagttagtacacctgcctgagagtgagtcactggaggatagagcaaatgaggttagcgttatctacctgcccttggagagacaggaaatcacacttggtatgacctgtctgtcacctggaggtttaggtttccccagctttaccaagatgagtgggtatcctctatccctgccaacccccaccttgtgctgacccttccttggcctgtcttggttttttcctttcttccttaaacaaagctactccaaataggaactagggtccaaggaaataaagacagtatcctaaaatggatttctcaatttcggcactattgacattttttgggggtgggtggggaggaaaggggcagccactcacgccaccacctctgcctgccactatcaacattttggactggataattctttgttgtgagaagctgtcctgtgcattgtaggctgtttagcagcatttctgacctagtaacttcccagttgtacaactaaaaatgtctccctggaaggcagaattaccctctgttgagaactatagccctggaagaaattgccacctatacatgggaaacttagaattcaggtggaataggttactagttaaatatttatgtaacaagcagccttctgataatctgattatgactgtgtgtagtggcaacaaccacttctaagtcagctttcctttaagccaggctctggattctttatttttgctggccttaatctgtgtctggcttaacacctcctggtcactttccctggctggaatttacgtacagttgtcagttgttgatgcaggtgtttggttgatgatgcattgccaaagagaagaggaacttcctttgtggacatacttcagggagcttccttgttctgtgcctttaaggggagactacagtctctcagttgttctccacagccaaccaagagtttggctgctgatatttataacccttatgtgaccacccccacctccccaccccacaaagaattccaatgctctgtaataatcctctccacccccaccatagcaactggatgtggagaaggtgaaggagcctttaaggcctttaagtttgcttcatgttgaaccttttccagctcccttttaaaatattgccagttgtattttaaatatcagtgtcacaagcaaaatcccaggcttgcagccactgcatcatcttaaaggagcctcatgccccagtgaaggtagtaaaattgaatggaaggtagtaaaatcatcaagaaaggattgatagattttacaaaaatctgtctggaaatttgatagcaaggtgagattttaaagcaacaaacaggctaggcgcagtggctcatgcctgtaatcccagcattttgggaggctgaggcaggtggatcacgctgtcaggagatcgagaccattctggccaacatggtgaaaccccatcttagccgggcatggtggcatgcgcctgtagtcccagctacacaggaggctgaggcaggagaatcgcttgaacccaggaggtggaggttgcagtgagccgacatcgcgccactgcactccaacctgggtgacagagcgagactccatctcaaaaaaaaaaaaaaaagcaacaaacaaatatatctgtaaccaaagaaaaggactgagcagttggatttgagtttactaaaattcttcacatacagtatcagtatgtagcattcacaactaagatttatcatttgtataagaaggaagaaatatatttccagaaaaactagaatgtatcctgtgcagaacttgtatgtattgatcgtttagtagttgattagtaaacatggttaagataagcacagacttgcagaaaaggactgatcctcactgtgcctagaaatgaatggtaaatggtctcagccttaggctggttctggagcttcagaaaaatatcctgggcactttcaagctcgctaataagctatgagcttctaggaagtacgatgagtttctttgaagggccgtttattgttagagttgctggtttactaggaataaaatgacttccacagggagttgtgtcaggtcactgcaccaaaccatcactgtaaagggctgtctcctgctgaatggattcttcacaagtctcagctgtcccagttggaaaaacccagctatgggtagaatgtgcaccctccctactttgccaccactaagtgcttttcaactacgagtctctcttattgactatagaaggttaatggaatacacttactctctaggacgtcataaactatttttctaccaccagtcatgtcatttgaaatatggatctttgctacacatggtgatggttcatggatggaggttaaaaggaagtgattccatattccttttaacccatccttactgggcagttgctctgtgctagtccttgtggtgggtactggagtctcagatagtctctagttaacagtgtacagatgtgccttgacttacagtgaaattatgtctggaaaaacccatcataactcgaaactattgtaagtcagaaatgcatttaatgtacctactgacagccgggtatggtggctcatgcctgtcatctcagcactttgggaggccgaggtgggtggatcacctgaggtcagaagttcaagaccagcctggtcaacatggtgaaacccggtctctactaaatatacaaaaattagccgggcgtggtggcgagcgcctgtaatcccagctactcaggaggctgaggcaggagaattgcttgaacccgggaggcagaggttgcagtgagctgagatcatgccattgcgctccagcctgggcaacgagcgaaacttcgttccaaaaaaaaaaaaaagtagctactgaccatcatagctcagcttagcctaccttaaacatactcagacacttacattagcctacagttaggcaaaatcatctatcagaaagcctattttataataaagtgctgactcgctcatgtaatttattgaatattgtactgaaatagagaaactgaatgattgggtacttgaagtatggtttctactgaatgcatatcactttcaccatcataaagttgaaaaatcttcagttgaaccattgttaagtcagagaccatctatagtaagggaaacagatacagagaattacagtggtactgatgtagtggtaaatgcagtaagaaagatctgagtctaaatgatctctgaaaaaaactctaaatcagacatttaaaatcctattttgcagataagaaaacttaagacttgaagaggttaaaataacttgttcgagccacatagcaagtaaatattagagttgggattgggaaggtctgtttggcaccaaagtttatgctacaccagtggttgtcaaccaagcatagctttgcagagactcccactccccgccactcctttttttttttttttttttaaacagtttcactcccatcacccaggctagagtgcagtggcacaatcatggctcactgcagcctcgacctcccagtctcaagtgatcctcctgcctcagccccacaagtagctggaattacaggtgcatgctgccattcctggctaatttttgtattttttgtagagatagagtttcaccatgttgccaaggccggccttgaactcctgagctcaaatgatctgcctacctcagcctctcagagtgctggtattacaggaatgagccacagtgcctggcccagagacattttttattgttatgactggaaaagctgctactggcatctagtaagtgctgcgaaacaacctacaatacacaggatgacggccccttacaatgaaagaattattcagcttacttctagaaagctagggaatttgatttttgccatcttcagatcccatgacaagtaagagttaactgattaaatagttccactcgctgggggtgcttctgtggttttcctctccttttaagaaaattagttaagaaatagtgttgcttccgggagtgacttacacagatagagtcaggatcttggggaactaatctgagtcagcgactgaagaattttctctatgcctgaccagtccccaccccacactgccacaaggctcctgctgtggaaatcaatcagctgtgtatctcaggctgcttcctgtagggtgtgttatggaatggcatcagcccttgcaccagctgggagtactgatctcagtgtgattttatcagactatgtttcttttgagccttactgtttggaacaaaggaccctctgttaagaatgcagagagctggtgtgattggatagctagcatatacatacatggttcctatgggaaaaaaacagacataaattatgctatagccctctaaaattttcatctccaaaatgatttcctgaccttctgtctgtattcacagttctttctgtaagtgcttatccttcccccaaagcaattcgaaggccatctgatctgataaatggttgtatccttcagaactagcctatttctgtgtctccagtcttggatgtatttgatccccactatctttccagtgttatttcctatatagaccatacactacatccagttaccccagacactccttatacattttaggtatttgatttctgaagtcatagctcaagtccacttctttataaagctttttttttttttttttttttgagatggattctggctctgtcacccaggctggagtgcagtggtgcgatctcggctcactgcaatttctgactcccaggttcaagcgattctcttgcctcagcctcccaagtatctgggattacaggcacgcaccatcttgcctggctaatttttttgtatttttagtagagacagggtttcgccacgttggccaggctggtctcgaactcctgacctcaggtgatccacccacctcggcctcccaaagtgctgggattataggcgtgagccaccatgcccggccttataaaggcttttgatctccccagctcactactcctgatctcttaatcatttacaatgtataactcacttggcttttatcacataccacctaattttgacattttctgattatatccatttgtcctatcccctcagttaattcacttttgtgtcccttaatgtagttagcatattggtatatacacagttggagatgagacaatatttgactgactggatgaacattctttatttctcataagccatgtgagctctaggattcaaaatgctatctactctgcaagacttgaggtatatatccttgtgtgtcctgaagaaattctaatcttagcctgatttcctcagttctccatctttcttctgggcttccttccttctctgctagttagtatatgttaagggaacacaatcttttttcagtataagagggcaaaactaagaaagaaatgtgctacttcttatgcacagagtcattgctacttactcaattagttgacagtttggtgtagtgaaaaaaactgaatacaagttctagtcagaagtatccaggtttgaatcctggctctatcatttactagctgagtgaccttcagggaaattacttaacctctctgaatcttacttactttaactgtaaaatacaaatattggtaaatcatacctttaggatttttatgaaaattaaatgaagtgatatatctaaaagtattaggcttatatttggtgctcagctcactagatgataatatgcttttttttaaaaagaagcttatctagacatataaattagaatattgtgaaatctttttttttttcattttttgtttgtttgtttgtttgtttttgagacagggtctcactttgtcaatcaagcctgaagtgcagtggcatgatcatggctcactgcagcctcaacctcctaggctcaagcgatcctcctgcctcagcccctacaagtagctgggattacaggcatgcaccaccacacccagctaatttttgtatcttttgtagagatggggttttaccacgttgcccaggctagtcttgaactcctgagctcaagtgatccgcccacctcagcctcccaaaatgctggggttataaacatgagccattgtatcaagcctgtgaaatctttttaataagaacagttacccctctttgtgcctagggatcatcattctccagaagacttgatctaaggcccagcaccagattattttcttcttgaaaattggaaaaatggaaattatgaggataaagtaaaattagtttgataacaatgaaacaagtggatggatagagagccttcctgagcagtttttgtgggaacaatagggcttatttctagccctagagtgggaataataggcaagtttaggtcatgattcaacacagcttaaaatatattttatgtacacatacatatacatacatatttatttattcattaattcatttatgcatttctatcagaatcctacaaccagcaggtttttctgagaccattttggccttggcttgtatgctctacaaattcatattattttcaaatcattaaccagaattaaccagaagacattaccagctcagtgacttccccagccactcagttgcccattagatcagctctaatgatctcagggattttggcctaattagcttttatcatagaccatgttatcttcctctgttaccgtacaatggcaactactaagtcagcatctttaggaaagacatctcttaatattaatcaatctttaattaaaacattgagggctgagccaaaaaatatcggcagagtttcagaagcaagcagcttaaaatacagatataattcatctgtctgccaatctcataccagattgagatgttttacagaaagtctttaattctttacagtttcagcaaatatgtgtttttaatgtttttaacatttggtcatgtgtatatatgagtcaaggaaagaagataattcaaagaaattatatgtgccttagattttctccatcttgaattaattgtatttatcaagtgaaccatttaatatctctgtcatcttgcaattcattcccaaaggataagctctggttttggtctaattctttaaattcatacctaagctgtttgtttctttgtcatcaatgataagaattttccttagtaacgaaatgaaagagatggtttttagaaatctcttctctctgtattatttattctgccttcttttctaatattgaggagcaggggctggacgcagtggctcacgcccgtaatcccagcactttgggaggccaaggcaggcagatcacttgaggtcaggagttcaaaactagcctggccaacatggtaaaaccccgtctctactaaaaatacaaaaattagccaggcttggtggtgggtgcctataattccagctacataggaggctgaggcaggagaatcgcttgaacctgggaggtagaggttgcagtgagccaagatcgcaccattgcactccacctgggtgacagagtgagactgtgtctcaaaaaagagggggtgattcaacccagagacctctttcatggaaataaccaagcaattttgtgatgatcatgccactctggaactggaaagactactctcagttagtcccagggggaggcccacatcatcactttctcagggaaacctaccctgagcttccaggccaggttgaggcccatgacccatgttctcatagcacggtgtgctttccttagtgcctgggatagtttagagcacatagtagataccaataaatatttggtgaatggatgaaaagaagagaatcaacgatataaccttgtgaaattagttgcctcaagaggagaggaagaggaatccaaggagacaaagaaggactggctagaaagatagcaccagggtaccacagtgtcatggaagtcaaaagaacacagtctcaagaagaagggaggatccatacttatttctcaccactgcttatccttaaccccctctaatctgatccaacacccatcactgtgctgaaactgctctcttagatattcattggcttcctagttgccaagtctagtggccttgtctgcctcactattcccctctttcattgtacagcatttaatatcagatcttctttcttgaaagttaatttactttctggacattgtgctcttccgttctcttctctggctgctcttctgctttcctttttggtttgtcttcctatctcctaaatatgtggttccttaaactctgtcatctgtctcttctcttctctctgcactcaacctctgagatggcagctcctcactgttctatggggaaaggcttccaaatctatctttctctctcttttgttttttttgtttggtttggttttttttttgtttggttgttttgttttgttttgttttgttttgttttgttttgagatggagtctcgctctgtctcccaggctggagtgcagtgggtgcgatcttggctcactgcagtctccacctcccaagttcaagtggttctcctgcctcagcctcccaagtagctgggactacaggtgcatgccaccacacatggctaatttttgtatttttagtagagacggggtttcgccatgttggccaggctggtctcaaactcctgacctcaggtgatctgcctgtctcggcctcccaaagtgctgggattacaggtgtgagccaccacgcctggcccaaatctatatctctatcccagcattgaatcttttgtgtgaggggcccttctagacaccttcacatgggtcgttttttagtatttcacatacagaatgctctaagataaatgaattcaaatattttattctttcctgctgttgttttataataagtactactatgcccctagtaacctaagagtaacactatatggcattatctttgtttttttccctctaacctctaccttctctctggtcagttgtgaagcccaaatattcttcctctgcaattactttcacagccctcttcctcatttttactaggtgtattattctgaacaagtatgcttgccaccctaagtttcatttataaagatttagattttttaaatgagataataataagtgacagttgagtgagcatcccgtcccaaagtcctcatttaaaaatttttgggcgggggggccgggcttcgtggctcatgcctgtaatcctggcactttgggaggccgaggcgggcagatcacctgaggtcaggagttcgaaaccagcctggccaacatggcgaaaccccatctctactaaaaatagaaaaattagccaggtgtggtggtgtgtgcctgtaatctcagctacttgggaagctgaggcaggagaatcgcttgaacttgagaggcagaggttgcaatgagcgagatcgtgccactgcattccagcctggcaacagagtgagactctgcctcaaaaaaataaataaataagtaagtaaataaataaataaataaataaataaataaataaaatgaaatagaataaaacggtttttttttgctgggcatggtggctcatgctgtaagcccagttgggaggcttaggcaggtgcatcacttaagctcagacaacatggtaaaaccccatctctactaaaaatacaaaaattagctgggcatggtggtgcacacctgtcatcccagctacttgggaggctgaggcaggagaatcacttaaacctgggaggtggaggttgcagtgaaccgagatcgtgtcactgcaccccagcctgggtgacaatgtgagaccctgtctggaaaaaaaaaaaaattaacaacaacaacaaaaaaatttggagacaggatctcactctgtcgccaggctagagtgcaatgacacaattacagctcattgtaaccttgaactcctgggctgaacgattttctcagctcaacctcccaagtagctaggactacagatgcacatgcctggccaattttttaactttttgtagagacgagtgtcttgcaatgttgcttcggctagtcttgaactcctggcctcaagggatacccctgcctcagcttctcaaagtattggaattacaggtgtgagccattgagcccagccagaatttgcttctttagagtcctgccttcagctctctacttagaaatatttgtctttgccatctctgtatatctgaaatcctaatgagtaaatgtgattccctccataaagccttctctgatacctcctgccttccttcttcccacccttctgtcaggtcttttctaacttgcaaagccccatgattttgtcatcaccatggttttggtgaccattagtctaaaaagagggattaatacactgtcttttggaaagtctacaggcaggaaagggcttacaggggtcatgagagttcctgcagagtgtgtggaaagttttctcatgggttcacgagtacatgagagctcaaatagcatcaaaatccttagtatcccacttaaagcaaacttcgtgtcatgctatgttgctttatgagccactccgtagccatgtttataataataaaagtaccaaaggatggcagtgactgatgcccaacaggtacagactaatactgtggagtttctacttgctactaaataatgcttgtaaaatctaaagatcctaagatgaaaggcattgtgtagatttaaaatgagcaagatccaaccagtcctctgtatcctcttctactcagaattagtcttccaagagagagcacccatcaaggtgggtgataaggcatcatagaatctagggaagtgtgaatctggggtctccagattgtcccagagggctggcattttaggtctggagcagacaagggcaggatgccaggtccaaaacttggaaagggagctatgttagggtgtgaggagactccacccggctgtctttcattaggaagactgcaggaaggagctggaagggccaggatttttctttcttctaagttcactgaaggaaaatctaacaccaaattctgtacttgggaatttcaaaatgagtagagaattctttgaactctgtaatcaattaaccggaaactcatttgaaatttggcttcagtgcatatgtttgtggttacaggggtgggggaaatatctgaagagggtctctggagctccctgtatttctcttttaaaaagtttatacacagcatgtgaaatgaacagatgcttttttttttttgtagctatcagggcaacaagaggtggaaagctgtatcaggtatttatttcagtccctgagatggctattggcagagtttcacatacctaaactaaggagaaactcatgaacagataaaaattaagacatggaggagaacttgtgcttcctctcttgatttatttctaaacacatactgatgattttttaaaaagagcaaagcactcagaaagtattctttggctttgggttctggggtttttttggaggtgcggtgggaggattagattactatatgtaatttctctttaggttgtatttaaatttgttttcctaacaccctaattagagagagtgtgactgcagataataagtaattcgaatctgaatttcatagtcgtaggaatgctccatttatttatttatatggatcactgatgagagtagtaagaatattggtagatagacatgggagggaattatttaagaaaagtctggattggttgatacctgacttggtgaggaaacagtaaaggaatttctgttcatgaagtttgtgattccacatcaagataattctttatggctgggaacagtagctacgcctgtaatcccagcactttgggaggctgaggtgagtggatcacctgaggtcaggtcaccagcctggccaacaaggggtgaaacccatctctactaaaaatacaaaaaattaactgggtgcggtggcgcatgcctgtaatcccagctattggggaggctgaggcaggagaatcgcttgaacccaggaggcaaagattgcagtgagccaagattgcgccactgcactccagtctaggcgacagagtgagacagagtctcactcaaaaaaaaaaaaaaaaaaaacattctttataatagaataaccacccatgtttcatccagagccagaattcctcagattcttccaaccagaggggccctggcatgctaaacagtctgttatgatatctgaacacttaagtgaatgtatttggccagggatatttgctagtaaaattgatctttccttccctgagtttttccagttgtgctgaataattaaaggaaaattaaaacctggattccctaaactgttaagtatcagatctgtaagctgtcagtccttaggattacagtgtatcagagttagaaaggactttaaaattcatctgaacaaactgcagaagatttgtaaatctgttttcccaaatctctgccaagtgattgcttgaatttctgctcaaacacctccagggtcaggaaagtcaccagtttaggggacactctattctttgaatagctgtgagaagctctttgttggttttaaatctcacatcttagtgtgccagcttaaggagatacccagaacaagtttccttcctcccacgtctcagcccttcagatacttcatgctaattacatctcctagaactttctctaggtcagacattattgggtcttgcactgtttgttcttcataggacagggtttctagtgtcttggcagtatacgaccaagaggacacaggattctggggcagtgcctttaaaagttttagaactaaaaaatattaaaactagaaagggtgtcaagacacaacctagtcggcctccccacccctttcagtttacagatgggcagagtcttttggatttgagtgggtagaattgatcagcagccgttgttgaagtgagaaatgaagtgtaaagcattttaccagagaaaggtcttttagttgcctaattccgattacaggcttcagcgcacttctcatttttgccaaggaccagtctgattccctaagtaagcctaaggctcagctcaaggtttcagtgccagatcttcatacaccaggtgttggtttcacttactgtttgtgtaaaggatagaaataacttttccataagttttgcggtatatattgaccacatggtccgacagagattccgaattttaatagatgtttttttccttcataaaatcagagaatggccatcacaaatagaacagagtattggacccgttcagagatgcagctgcctctggtggacagtttcctgggttgccctttgtactttctttgtttaacagtcaccaggtgaccaagtggcttttctaaaagccaaaggccgtggacgacgggattgtgagcgacttttctctagtgttttctatttgagatttgaaatacccatgcttttcatctggtccaaggaggctcaggtttccttggctgtgcgcaactataaaggacccaggtgtttggtcgtagggctcagctgttggcatccccacctcccccaacaccccattttcttccgtcattgataccactcaggtctgtgagcagagaaatcctggtgggagaattgaccaggacttgatatacttgagaagggggagagggaaggtagaatgtgcctagagttatccaataactttggtctctgagcgtgaccgaattcctttgggacaccgggaaagtgccgggtttaaggctggagtgttcttcggtccggcaaggggcgcgctaaaggtgacactggaaggagcagggacagcctttggcggcagagatggagccgagagcgatgcaggcggcctaccccagccggcgcgacctgccggcacacgggaactcgagtggccgtcgccagagccggctagctgggggagcgcgggcgccctttctggattcgttcgcctttgggctgggctcggagccgggccggttggagcgagacaggggcgggaggggccgggccagcgggaggagggcggggctttcctttgtcaggggatttgcgccgcgcagcccagactcgcgcgggttccgttcctctccttgcgccctctccgggggcggggcgttcccctctggccccggggcgcggtgggcgtgggctgcgggagccgaacggctggcgtcccgggtctctcgctccgaatcccgcagaagcccctccttcggcgcctcagcctccaatcctctccaccgctccctccactctcggagtcgctcctctccccggccccgcccccgccgggccccgcccccgccctcgtcctccttcctgtgctctccgcgtcgcgcgctccctggcttccagggggctgcccgggcggggcggcgcagcgcggcggcgcggggaagggggaggagagccgcccgccagccgagcacttccagcgagctagcgagctagcgggtcgcgctgcgcgggggaggaggactcgccccccgcccgaccctagcggagccttttgttcccagccagaagtttgcatgccgggaccgtgacagctgcgggcggggaggacggcggggccgcggggccagcggcgtggtggagaatagaggcggctgcttgtcatgcagcccacggcgtggcggctgcgggccggggactggcggcggcgggcgaggcggcgcccacagcactcgggactcagctgccggagggacaaactaacttcctgagcgcgggacctgaggctggcgcggccgggagccacctgcagcctgcggtgaggcgaccctggccctcggggcgcgcggcatggcgcggggaagcgggccgtgctgagcgagcccctccgacagacccgcggccgctgctgctgcccgcccgcccgcctgcctttccgaaggcctggcgcggggctccgctcgccttgttttgcagctacagcgcagggttggcctgggagccacaacaatgccatgatgttttggagacaggaagccccaagctggccccgaatgaaggacttcctgtgtttaaagttgcaggaatatccgccgaccagcccagttcaaatgcaaacaccccagctagggaggacgaatggctaattcagaccagctggactctccagggctggaactgaggataaaatgaaaggaattcttaggagcttgggccatacttgaagactagagaggctgtgccattgttattaaaggatacaatcggcataaatttgctgctcccaactctgcttcggtgagaagtgagtggaactagatatcgaaaaagactcgtcaatatcagatgatttttgttgactgtatttgaaagagcagtgctcttaaaaaaaattaaaccataagccatacaaggaattattttaaattatatcgtctgtcaaccatgaggctgctagcctgtgaggaaaaagctgtttgtcttagagcttctcccagaatggtttcaaaacggaacttccaggcctttctggagggcagatgcaattggtggtttggggtatgaacagctaaaaggatttataacttatgtagaatgcatttggggggaacctgtgaaaaatacttttgaaagattgatggttcatcttgattgaaaaaggatgggtaagccactcagcagaccagactgtttaaggcggaaccccagctgcctggggaaaggagaggaggaggatggctacatagaggactgctatgttccacaacggtctatatatgatacgatgaggataaatgagcaaattgaccaggggtcaaagcttaaccagacttcaaaaagcaccatggaaaagatggaaggaagtactatatccagcaatggtacattaggagcagcatctaatgtttttgaatctagagcaccagaaggtaagaagctggatgagaggataatatttgatgcactaaagctaagcagtgatgtgcagaagtcagcacctgtgccacccagaaggcggccaaatgcagaacgcaaagacaatgttaacaggagatcgtggaagtccttcatgccacccaacttcccagaatttgcagagaggatagaagcttctctcagtgaggtttcagaagctggtgcttcaaatccttccttgcaagagaagaaggagtccagttctgcattaacagaaagttctggtcatttggaccacagggaacctcagtcagagtcagtaactctggaacatgtgtccaaatccataggtattccagaggtgcaagattttaaaaacttaagtggagactgccaggactttagatttcagcagcacagtgcaaaccctcctcatgaattccagcctgtagaatcagaagctgtagcaacaagtggtaacacagatgtaatgcaggaatccagattctcaagtgcaacctggccgagggccacaaaaagtttagctaagggaggcttcagtgagaagcagcacccccttggggacacagcctgcactgtggaaatgccacctctctccccttgcctgagtgaagagctgttagatccagaattgcatgttctcataacccccagcctgagagagaaaacagagtctgagctaaagtttgaggaggatgagcgatggattatgatggaggctgagggagagtgggaggaagagaaactgtcagacagggaaaagacttttctgatggcagatgagaagaacagcctggcagatatttttgaagaaagagaacaagcaaacacagcagtggtggaggatggatccgattgcttagctgctgtcttgaggacttttggccacctatctcttggtcagatttgttgccctgatgacccacagccagccaaggaccagttggctactgttcccaaggatatacccctggattgcgattgtgttcttacaggtgaggatattctcggtgaggtggcaaacagaactgctcaggggttagagggacttgtttcagattcagcatgtactgtgggtactattgatgcagaacagctctctgacacagactcagtgcagatgtttcttgaacttgaaaaggagtgtttatgtgaagaaggagtaactcctctagttgagctacagaatcaaatctcttctgaagggctggctgcatcccaggatgcagaaaatttactcgtaattagtcatttttcaggggctgccttagaaaaggaacagcatttaggccttttacatgtaagggcaaaagattatgatactagattggattgtggatattttaataccctggattcttctcaggtgcctaatgctgtggaacttattgcccacgttgatatcatgagagacacttccactgttagcaaggaggaatgtgaaaaagtgccttttagccccaggactgcagaatttaagtccagacagccagctgatctggattcactggaaaagctggacccaggaggactgctgaactctgatcacagggtttctcatgaagaaaaattatcaggcttcattgcttctgagctggccaaagacaatggcagtttgtcccagggagactgcagtcaaactgaggggaatggtgaggagtgcattgagagggtcaccttcagttttgcttttaatcatgaactaacagatgttacctcaggacctgaagtagaggtgttatatgaatcaaatttactaacagatgaaattcatttggaaagtgggaatgtaactgttaatcaagaaaataacagtctgacatcaatgggaaatgtggtcacttgtgaattgtctgtggagaaagtttgtgatgaggatggtgaggcaaaagagctggattatcaagccacacttttggaggatcaagctccagcacatttccacagaaacttcccagagcaggtcttccaggatctccagaggaagtccccagagtcagagattctgagtctgcacctgctggttgaagaactgagacttaatccagatggagtggaaactgtgaatgatacaaagcctgagctgaatgtggcatcatcagagggaggggagatggaaaggagagattcagattcattcctaaatatttttccagagaaacaagttaccaaggctggtaatactgaaccagttttagaggaatggatacccgtcctccagagaccttcccggactgctgcagtacccactgtcaaagatgccctagatgctgcactgcccagcccagaggagggtacctcaattgctgcagtgcctgccccagagggaactgctgtagttgctgctttagtgccctttccacatgaggacatcctagttgcttcaatagtctccttagaggaggaggatgtcacagctgctgcagtatcagccccagagagggctactgtcccagctgttacagtatctgtccctgaagggactgctgcagttgctgcagtgtcctccccagaggagactgctccagctgttgcagcagccatcacacaggagggtatgtcagctgtcgcagggttctccccagagtgggctgctttagctattacagtacccatcacagaggaggatggtacaccagaagggcctgtcaccccagctaccacagtgcatgctccagaggagcctgatactgcagctgtcagagtgtccaccccagaggagcccgcctccccagctgctgcagtgcccaccccagaggagcccacctccccagctgctgcagtgcccaccccagaggagcccacctccccagctgctgcagtgccccccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccgcctccccagctgctgcagtgcccaccccagaggagcccgcctccccagctgctgcagtgcccaccccagaggagcctgccttcccagctcctgcagtgcccaccccagaggaatccgcctccgcagctgttgcagtgcccacccccgaggaatctgcctccccagctgctgcagtgcccaccccagcagaatctgcctcctttgcagctgtggtggccaccctggaggaacccacttccccggcagcttcagtgcccacccctgcagctatggtggccaccctagaggaattcacttccccggcagcttcagtgcccacctctgaggagcctgcctccctagcagctgcagtgtccaacccagaggagcccacctccccagcagcagcagtgcccaccctagaggaacccacctcctcagcagctgcagtgctcaccccagaggaactcagttccccagcagcttcagtgcccacccccgaggagcctgcctccccagcagctgcagtgtccaacctagaggagcccgcctccccagcagcagcagtgcccaccccagaggtggctgccatccctgctgcttcagtgcccaccccagaggtgcctgccatcccagctgctgcagtgcctcctatggaggaagtttcccccattggtgtgcccttcctgggagtttctgcccacactgactcagtgcctatttcagaagaaggaacacctgttctagaggaggcttcctccactggaatgtggatcaaggaggaccttgattccctagtatttggcataaaagaggtgaccagcacagtgctacatgggaaagtgcctctggctgcaaccgctggattaaattcagatgaggtaattgtccattttgattctgggaagggtctaaagagtaaagtgagatttgcagggctgacctggtggtgatgagaaatggcacagatagttcttttgttctttttgggtctcccgggcttatagtttgtagtctttctgttcagtttttggggaaaatatactttaattttgtctggtgaaagactttataatttcatgcttcgttttttattcagataagccaatcccacggaaaacagggatataaacagttgttgatttacatttttaaaaagattattagcaggaaagggtcattctgtttttgaattatacagtgagcatgttcttgcctaaaccaagagacagtttattcattggtggtgtcaacatttaggtagaggccagagtgtgagctttggaatgagacctggggtgcttcctaaccactctgggaaaattagttagctattcttgagtttcctgtttcttcatttgttaaggcataactctgtgaggataaaatgagatacatttaaggtaccaagcgtataagattaccaatcactggccatatcctccccattcttttcaaataggtatgttggttggttgaaagaatttaccaaagtagattggagagaagcaataaagctaaatgattaagaacttttaaatgcaaatatgtgtttctgaaaaccagagctaggcataatgtttatgaaaaatagagatattttagtcatctttgtcaaactgcctttgtgtccttaagcaagtcattttcctttccaggacctcatttcttcattataaaacaagaaaattgggctaaatgtcctcttgggtctctcttggctctaagattctttttattttttttttttagatggagtctggctctgtcagtcaggctggagtgctagagtgcagtggtgcgatctcagctcactgcaagctccacctcccgggttcacgccattctcctgcctcagcctcccgagtagctgggactacaggcgcccgccactacgcccggcaattttttgtatatatatatatataattttttttttttttttttagtagagacgggtttcactgtgttagccaggatggtctcaatctcctgacctcatgatctgcccgcctcggcctcccagagtgctgggattacaggcgtgagccaccgcgcccagccggctctaagattcttaatgttagagaaccgaatgtgttaggaaacagttggaaacgatgttccacatccttgagcactcctagtccaaggaatttgagatcagcagctttccacagttaattacccaggtttgatttggtcagtggtaaagagtgcaggagttagaggtttaatctgaacacaagagatgactgagtgagaagattgttttgattttactgcgcccctaggactcaaaatagtgccttcttcatagcaggcatttgctgttgactgactgactgaatgcatgaatatcaatttcctagactatggatggatgctacaagaaagatgggttttctcattcacctcactgcagagcctttcagggcagccttaagtcagctagagcaccagctaaacatgcaggtcctgacaacaaaatcattttgattgcatgccataaactctttgattaagaggattgattaagataatctggccttgctgagtggtggtggttttaccttgagctttaccagttattttgtcaggtagcattccattaaattaggatgcatcatctttgagactgatggatttttgattcatttttccgagttttattgaatttggaatgacaccgagatcccaatagcctgtacaaagtgaagacagtaggtcaacaacagagccattcttgataatacagaatatttcacaccaggcacagtggctcacacctctaatcccaacatttgggaagccaagggaagaggattgcttgaggccaggagttcgagaacagcctaggcaacatagtaagaccccatctctgagaaaataaaaagaaaaaaaaaaaaacagaatatctccagtataaagcttatatagcagtaatcatgaaatataaggattaaatttatagtgaggcaatcaaatctgcataaaggggaaaaagtcatagaaatcctgtatcagtctctggaatccttgtttcctcatctgcaaaatgagtagatggctacataatctctaactatccttccagctacaggaggtaatccttttatgaaatattgcctgatgtaaatgacaggagaaggaaatggtagcccagctgcaaagttgtccatctttgaagtgtggttactttgtggaatatctggaagtgagcaaatgcctatatctgtgtacaggaaaggatagatctgagcctcagccaggactgttaaccagcaagaatgtagagaggccattttgaaaatattgaaacaaaacaaatcattatagagttaacatgagtatacaggtttgctaaattggtgaaatattattttaaaaggtttttccaagatgagaggttaattttttatttcttccattcccttaggattccaagaggcaactgaacctgccatttttatatataaatacttagaactcaacaagtgatttagcatgaactgaggtcctctatgtctgtatgtatatgtgcaagtgcagacatggatacatggttaaaatagatataaactttgtaattgcaataacaacagagtttggtagaactaaaatgccaaaaactcgtttgctttttctgtaatgggatctgaggcctactgagaccaatctctggttatgtaaattccctgcttatttatagacctcttcagtcttaatcccagccactggttcaaaggaagaaaaaaaccttttgtataaaataagggttctataagattacaatttgccaagggagtctttttaagcaaaaattggagagcaccacaattccagttcagtgtttgaacgctctgctgatcggcagaatcttcattggttttttgcattccctaacaccgtttgtgtacaaggattcattcattcatggaacaaaaaaaagtttttgtttttttttttagacagagtctcactctgttgcccaggctggagtacagtggcacaatcttggctcactgcagcctctacctcccgggttcaagcaattctcctgccccagcctccgaagtagttgggattacaggaatgtgccaccacacccagttaattttttttttttttttttttttttttttttttttttggatttttagtagagacagggtttcactgtgttggccaggctggtctcgaactcctgacctcaggtgatccgcctgcctcggcgtcccaaagtgctgggattacaggcatgagccaccacacccggcctgagtaaatattatgagtacctactctgtgccaggtactaggctcctgcagtaaatagaattgacatggtccttggccttgtggaacttatactgagtggaggaggcagatattaagaaaaccacacataaataaatataaaataaatacatagttagaaattttggcaaattctttgaataaaatgatgtcaatggatttgaagacaatagggtggattgaagatatattttggaggtaaaatcaacaagatctgattgtggcttctgtgttggggctgagggagttatcaagggtgacttttaggttctggtttgtacagtggagtggatagtataaattattgatttaaggaagaggtaagggaaagtgggagacactgtttcatttttgaactgttaggcttgggatgcctgtggttcatttttttgcatggagatattaaaaaagcagttggatacgtagctttgaaactcagagagacaaattgagagtcataagcatttattgtggttagtatttaaacccacagaaattgatggaattgcctaggaagaatatagaaagagaagagagtccaggactgacgtcgttctctcactcccacccccaaagatcatttagagatctagaagaggagaaagaaaacaaaggacaacagaaaagaatcagtcaggataaaactggaaaaatgcaataacaaggctggatgccgtggctcatgcctgtaatcctagcactttggaaggctcaggcaggcagatcacttgaggtcaggagttcaagaccagcctggccaacatggtgaaaccctgtctctaccaaaaaatacaaaattagctgggtgtggtggcgcatgcctgtagtccccgttacttgagagactgaggtgagagaatcacttgaacctgggaggcagaggttgcagtgagctgagattatgtcactgcactccagcctgggcaacagtgtgagaccctgtctcaaaaaaaaaaaaatgcagtaacaaagataaaagtgttttaaggagttctttgggaaattttctattttgtgtcctagttgcatcttacaaccttgcaacaatttttactagtgtacttctttggaaaatgtctgccagtactgcttagttaataacatgacacagtcctatttcactaacagtgtgtgaaatactaaggagtaggaattttagtgtatctaaaagcactggttttgcaaaacagctttatttgggagttgacagaaggaagcaggtgttttcaaatgtacgttctttaacgttctgttcacttttattcaaaatagataatatttagaggtgctttcatatatgttttaacttatgagaaatgatacaaatacccattgtccctgtcaatccatagagtgaaggtgagaaatgaaggaatagctaatgcttctataggaaatgtttgtaaacaaagtaaatccaaaagtttaaagttgcagtagctcttattatagattgaacatccaaaatgcaaaatgctcccaagtctgaaactttctgaatgctggcatgatgctcaaaagaaatgctcattggagcatttcagatttcagattttcagatttgggatgctcaaccggtaagtatttaatgtagatattccaaaattttaataaatctgaaatcagaaacacttctgttcccaagcattttggataagggatattcagcttgtatatgaaagagattattgaactatttaaatataattttacttttctttctttctttttttgagatggagtttctctcttgttgcccaggctggagtgcagtggcatgatctcggctcactgaaacctccacctcccgggttcaagcaattcttgtgcctcagcctcccaagtagctgggactacaggcgtgcgccaccatgcctggctagtgtgtgtgtgtgtgtgtgtgtgtgtgtgtgtgtgtgtgtgtgtatttttagtagagacgaggtttcgcctgttgcccaggctggtctcaaactcctgagctctggcaatctgtctgccttggcctcccaaagtgccaggattacaggcatgagccacttgcctagcctattttacttttctgtgtcatttaaagtgctgtccagtaggacttgctgccaagatggatttgttctctatcaatagtccagtagagtaaccactggccatatgtggctttgactatgtgaaacgtggctagtgggtctgaggaactggattttaaatttaatttaaatgtcaatagctatatgtagctgctggctgtcatgttggaaagcacagaaagaatttaaatgtcagttgtagagtgagataggatttggttattgagtaaaagagggccctgtaatgtggacttgacatcttccctccataccttggctttctgccttctttgccttttcattccttcaccttcaccaccaccattttattgtaccaaaagcagctttaaacttgggatgtttttcctgcctctatctgatttttcttcagcagaaacatctttaatgctacaaaatggaattatagcagttgttttttctgggaaccatgttgttggagaaatagtcattttaactgaactgctttgtaatgttgcctaagaaaatatggtataatcaaattatagtaaaaaaatgaagtgcactcataattacttttataaccttcctttttcagtgttccctggggctttccctccctggtaatcttagccagccatagaccattctttctagaatcagtttcctaatcctagtgtggtctgtagtctcatattgaccaaaattggtcttactcaaacttatcattttcttttatatttatttttgtcctcttccattttctgtcatcctctggccttaattgactcacctggctcatggaagaaaaaggaagggaaataaatccaggctagtgaaatatagctggttctatccctctgataactgagagaaacccaatttttttttttttttttttgagatggagtcttgctctgttgcccaggctggagtgcagtggctcagtctcggctcactgcaagctctacctcccgggttcactccattctcctgcctcagcctcccgagtagctgggactacaggtgcccgccaccatgcccgtctaattttttgtatttttagtagagacagggtttcaccatgttagtcaggatggtctcaatctcctgacctcatgatttgcccgcctcggcctcccaaagtgctgggattacaggcgtgagccactgtgcccggccacttcatactcttaatgtggcagaagtaccattctcttctgacccttttttccttttagacatgtctaaatcgtaatggagcttaactgtagtagagcaaaatatacacgttgcttgttacacctattcacattgttttaaaattctgttgcaccatggtaaacgtggataatacagtatcatttttgagcagttttttaaatgtaaatctgtatcttactcagagtgtgtgtctgaagttattaaggacatttcccaacgttactggcccatttccctttgtaatcagaggaattctgtttcaagattattgttgtgtgtgatctgtggctcttgatcagaatgaagttaaatggccacaggaggattaagctatgaggttggcatttttcacactgttaatatgttttgactaattgagttattagtcttagtcagagaagagcatttcttattagtggtcagttaaggctattccccaagggatattccatcttaaatactagtcatttggtattattctattcttctcttttaggattcatatacattgcgcttacttgtacagcatttcgaggttgatgcttttctattctccatggctttttgcattaaaaattaagcaacaggccgggcgcggtggctcacgcctgtaatcccagcgctttgggaggccgaggagggcggatcacgaggtcaggagatcgagaccatcctggctaacacggtgaaaccctgtctccactaaaaatgcaaaaaaattagctgggcatggtggcgggcgtctgtagtcccagctgctcagaagactgaggcaggagaatggcatgaacccgagaggcggagcttgcagtgagccgagatcacgccactgcactccagcctgggcgacagagcgagactctgtctccaaaaaaaacaaaaaaaaattaagcaacagattttaaaaaaaagaacaaaggaaagagtcattgggttaaagacctaagtagtgtcataactctctgtaattacatgtccataggagaatgtattgaaatacaaaaccacatgttttcttgatgcttcacgtgcaaatgcttgttctttctttttattcctggtcgtctttcattaagtcataaatgccccaagaataaccagtctctgcgtggtatagagagtctaatagcctttgtattaaatcttctttggcttgtaattatctagatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtgagtgacaatggggtagcaagtgtactggaaacggaaggcatagaaaagagacatctgaatctaaggtttcccgaaacctgaatggaaataaaaatttagcagttgcaatctataattactaaaagaggtcagtagtaatttgaaaactactttctccgttctcataatgaacctacatgttcatgatacaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaaggtaagtgagaatgttgggacagtgaactgtaacagccgtagggagtagtagacaacacatttgcttatagtttaagaagcagttcaggagttttagtagaatcctaaactactttgtgtcgtcctgaaaagaaaggtggaaattgattttcattatcttacttaaatctggtttactgtggcatatattagactgaataattttacctgttcatgtatcctatttcagtgttcatctacaattttgtgttaagaggtttttggtgttttcagggtcagcaatattctaaatagtgttgtatatcatgtacaaagttttatctatattttttgttggtttaatttctattttagtgcagttttttctttttaaaaaaaatttatcccaaaggaaattttatttttttctcagctttattggtatatagttgacaaataaaaattgtatatgtttggctgggtgtggtggttcacgcctgtaatcccagcactttgggaggccgaggcaggcggatcacaaggtcaggagatcgagaccatcctggctaacacggtgaaaccccatctctactaaaaatacaaaaaattagccgggcatggtggtgggcgcctgtagtcccagctactcgggaggctgaggcagaagaatggtgtgaacctgggaggcggagcttgcagtgagccgagatcgagccagtgcactccagcctgggagacagagcgagactctgtctcaaaaaaaaaaaaaaaaaatgtttataatatacaatgtgatggtttgatatacatatacgttgtgaaatgtttaccgtagtcaagataattaacatattcatcacttcaaatgttaaccattttttacggcacttttctcttggttcaaaggaagttccctgttagtcacataatgacagtcactgctccatttaaaaatttaagtgtgtgaaaagtatacgagtggtgagaactgtgctatatctcctgtttttgccccaaggatgaaaaaaacttcttttactcaatgaagcttaggatttggcgggttggtttcttttgttttttttctttcttcctagttcagatttcaaaatgatcctgtgttacagcttttcattctctttataatagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggtaagatcaaaggaattttgaggagtgggtcagaggtttgttttgttcttcttcgacttattatcactataagttcttggatgattcatatagatttttggaaggtgtttaatggcttttatttgaaatgggataagattttagagatgatcctcataatcagaatcacactcaggaaatggtctccagcatcttcataaatttccgagagctggaaaactcattgctctgtgtggttgttctgctgtagtataatcatagttccaaatgacagacacagactcctacagtccagccgagttattttctgagtttttcaaacagatttccccctcttatatttataaataatgcttttgatacttggaattgaaatgtgtcatatttcttttctattagcttatagtaatattagatttttttgcctttaggagctagtctgtggttctgttaaatatctgggaattcaagagatgcatgaacttacctcaataaatggtcaaaaagacaggcaacaaatcctccttcaaggaaatattccctttctcttttcatagctataagttatcctgtgacttgagcttaataagtcacatagatgtctttacttttatacagtcctcagttttaaaattaaataccagctaatgagaaatcaataagagagctgatcatttgttattgtatcctttacatttcctaggtagcctatggcagtcttcaaataattccctcttcagtctttttatgtccacctgcccatgacttggcttattccttacctgagttgcaaagtatggcttgcctatgttagtggaagaaacaaaatggaaagaatttaacttacttgtatttccagatttgtactgcttattttcttttctctctgtccatttccagtaatggtaccattagctttccagtttcctaggcttaaaacctcgactccatttttacttttctttttttaatttctcctttgtgcccacatcgatcagcatgctaaattctgtctattttactttacagtgtctttcctgtccatctgtttctctaattcccactctcccctcagttcatgacttacgagctctcactaggtgtatagagatagcttcttcactaatcactctaccactaaccctggggccttccccttcccatcccccagctgcagatgaacctttctgaaataagcctttaatcatatcttttcaagctcagagatatttaattgactccctgttagaataaaacctttagattatgaggctgacacactgcctgccgtgctaagaaggtgcttaaaataaaatataaactctttaacacaccattcaaagccctctatttgaccctaacctacctttcttagcttctactattcttctcactccttaatattatagctgaagtaaactatattctgttctttaatatcttctgacaatgtcctaaccctgtgtcttattttatgggttataatacatctttcatgaaatgcttttgtccagctctctctcttctataaaacttacctttattcctcaatcatggaataatttttcctgcctcttcactgccataactctttatctgtaccttgtattatgatcattattttatgtacttaccttcctggtccataaactccttaaagtcatggtttgtttatctaatgcatatttttatgactctttccttctactttacttgtttccatcctcctagcctaatatagtttctgggccaatattttaaatagaaacaaataacaagagtagatatttgatgcttctaaattatttttagctcttctccctaaaaatacctttaatcttattacaataaattcttcaaattttcagattccaaaatcaaatgagtaagaaagacataaaaattagaggcaatttttaaaaaatgaaattcaaatttaataataatttttaatattgtatgttttagttgcattacttgaagatatattttgaaggctggcataaacaaactaggaaagaaagttttagacttagattgccacttaaaaaatatgtttttctttatattcaaacataattgaatttccagtaatcaaaatgccaactttttttatttaaaccacttcttattaaaataactttgtcagggcataactagcataggacctggcgtaaattaggtcttcagtaaaggtttgctgaacttaagtgcatcatatactcccaggcctcttcaaatgccatatcttagtctgtttttagtaattcaaagacaacattatgacctttcattattaatctgcatgctaatacagttctgtggttgttttcttgtctgttccttgtcaggctatctccaatatccagacttcctcctcactttgtaatttgctgcttttattttatagagtaaaacaaaccacaggtactttggaaagtacatctcttagcacttctctggtctcagtgacagtcatgtatcccaggaaaagccaagcttagttatggatcttatattaaataagagttaagattccaagtgagctataaagtctgtagttttttttgtttggtttttttttggggggggtgctttttgtgttggcaaattcagccagcgtgaggttttttgtttgtttcttttttgtttttttgccttaaatctggattcaaagttatgttctggggcttgaaattaccagaagcctgactggattttggggagttggggagggagttctagttcataggcaatatacagtctttactcttcagatatcttcactcataaatgaaggtagtagtgacagagagaatgaaaacagacaactttttgcctcctttaaaccttattttggtcagatgttcaggtgatatatatactacattctgttttgatttgtgttaaataaggagaacattagaagatttgattctactgttgctactcaccaggtgattggacaaatctttctttaagccttctgactgaactttctcttttataatagggggataattattcttttataatgggggataattattctgtccaccttacaaggttatgacagaatgagaataaggttaatggtgtgaaatcctttaaaacatcgaaatgctacataacgtgtgttctgtttactattggtatttaaactatacctggaaaagactattcttttactgagtatagtactattaccagttttaatgtgacttttcttcctgagcagcttgttctatatatttgtgtaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggtagggagtggttacagtaaatgaaaatagaaaactggaattagaaatcctagaaatgagtaaactgcctgcagcattctagaggatgtgtgttttgtgggtttaacttaaaatatggtcagattattaattggaaaagtcacattcttgaaatacaaatagaaattgactgataggctaccaccggaataaacagcttttgttcccaatttttatattatttttgcctttcagtcggtgagttttttaattgtttaatttgttgtatcatttgttattcatcattttgtgtttacttttcatttattttgtttctgttattcattttttccatctggatttccaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggtattcatgtttccatttttattggttatgttattctgttattttgttattttgattcatgtttctcttcatttatttttttttcttcattacaaacacttcaactttattttatacacaagtgcatagttagtggacttgatgctgactgctaatctgtttttggatgagtccatggaaatacttatatttaacaagttaaatcagtaattctagaagatggtacagggtatatagtcaggggccatctgaactccaactcatgatttacattattaggtgatgggtcactaagattctatttgagcagttttatgaaagataatgtgctttaacaaaaccagatctatctgtgtagtgcccaggatttgatcatacagttaaaaaacttttaggatatttctggatttgttcaaattccggggattctgtgtcatcttaatagaagagtttgcctttttcatttcatttttatgaaatctgtttgggagagtaaaaataggtaatttttctaatagtctgattcttttgcttcgtcaactttaaatatgaagagagtttttaaccaggattctgatttaagtcagtctgttcttactgaatttcttctcttgaactttctgtttattccttattttggacacagtagacaattttgctcaatttcacttctgcctttcttgggttcaggtttggtaccaataattggtaaagctgatgtaattctaagtttttctcatccagcgcataggaaagcttgcctataggtatctgatttaattattttgaatagtcaatgggctaaccaaggagaagatgaggggatcaaatatctgatgtttaaattaaactagtattcatctctttactttaaatttgatctcttaaaggtctcgcattttgtttcatttgtagtgccacagtttcaggattaatggtattctttcctttcaggctttaaatgaagaaattgttaatagaaagaagaatgtagatcaagctattaaaaatggtcaggctcttctaaaacaaaccacaggtactttgaaaagtgtgtctcttagcacccctatggtctcaaagacaattatgtacccaaggaaaggagttccctgccttagcctcttctttatgtatatatgagaagcttagtattcactgattgtattccctactgtgctccagaaggttgtttcctgctaaatcttttgaaaactaagttatctcacatctggttatagatgatgatttctcctctccttcagtatcttgaatgccaacatgcactgaaaggtgctggaaacatctagaaacacttgacgctgaactcagattttaataattcagaagtggcttcttttatccagtggaaagtttattttatttcccatttgcccttagtatgggataggtgaaatcattaccacagagagagagagagcgtctatgaaattaaagctctgatttgaagaaaggggatcagagactcctcattcctaggtctcttaaatatgagtaattgtgtgctatcttccataggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggtgagctgttactttaccataaaaagaaaaaaaggcttcctctttgtcagaatccttaagttttatcaacctttaccttaaatataaactaaaaatatgtgccccctttcttgtttactcatggacagtaagatttgacataaagacatatacgttacacatatgttatgaagaagaaagaagttgaatcaagtttactttgtaacattttaacctctattatttattctctaaagagtgcttcatggttttatttgatttctctgcaggatctagtatagttctagatgcatagaaatattgtataggtacttgttaggttaaatactgagcctttggttaaagcattatttatcatttctgttgaagtaaggagatgaaagaagtattagttgttttacccagagacaatgtggctcaaaaagtcttacaggcagttctaagcaagcaacaatgaagtctaaagtcaggcttcagaatgattgaaaaatctgagatgagaaaaaaataactgaaggaaggaggtcagagtcctgctgggatgtgtggtagagatagcaatttccacccagcacagttgctgatgtgctttatttagcaaggtatggcctgaaaactcttttccctccttaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacaggtaatgcttataatacctctgcattaatattttagacagtattgatgtgtgagatacagtactatgacccacataaatacagactcagaaataagaatgggctcaagctaaatctggtggaataaatatgtttcattgatgggaaatgattgggtagaagtttgtgaggatggatccagaatttgaccaaaatacttgacccctttgagtagagaagtacttggagaagagtctacatgaggccttttcttagctaatgccctgctaagaaggctgatggtgatgggagtagataatatctagattcaaaaggtccaaatgcaccacaatcttagtttgacataattaactctcttagcattagatggaagagggggaaggaattactatcaaatatgcaaaccaaaatagcagagctatctaaaatagaaccttctcagtaaacacaggtgtcatatttcccttgatcttttttccttcctactttctggaaaaaaatcatttgttcttttgtgtagctggatacacacctcttaatgtgccgtagtacaaaaaataagttaatataactccttaggatcatagtgatgaacatatgctttttgaatcacacagaaatttgctctgagtccaggtatatccccagtgtgtctttagagttatcccttatcttggccagatatttcaatatgaaatgtattgtgcttgggagaagcgtatttttaaatgtaagtgtatattggccaagttgaagaggaagagataaaagactggagaggtcaggcataggagactgggctcacacctgtagtcccagcactttgggaggctaaggcaggagaatcccttgaggccaagagttcaagaccagcctgggcaacataacaagacacatctctacagaaatatttaaaaattagccgatcatggtggcaattgcctgtgtagtcctagctattagagaggctgaggtgaaaggatcactcgcgcctaggagttagagcctgcagtgagctatgattgtgctactgcactccagcctgggcaacagaatcagaccctgtctctgagggggcagggaaggatggaggattggggagccctcatgaaactaacagtcacgtagaacatgttcttggttttcgttattacataaccatttaaaaatgtgttgttcttttggggtcttatgctgcttcagctaagcgggcacttccgagttaacttgactcatccgtctactgccatattaggtttatatttaaacatctgactaaacctactactgttccatgtctgggtaggaaagagcaatggcaggaagagtgtagtctcataaaaacactgattagaggcatctttcttttgaaggggattgatatctgttatttctagctgtagaaactgagttctgtaacttactttaaagaaattgaaatgtggtcagttttaacttgtttgcatcttgatttgtgattttatgaaattcttcccagttttgactctactttgtgagatataaactgtattactgaaaatccaggccttgctttgttgaataaattgcagttatgtggagacttggctgtatataatttgtttatttttctttaatacgtctattagtatgagcaagctgccgatgcagaactagcttgggttgctgaaacaaaacggaaactgatggctctgggtccaattcgcctggaacaggaccagaccacagctcagcttcaggtacagaaggtacgtgcccactctttcctgagctaatagaatcatcagtaacttagagtgactaggagagtttctgactatcccatgtcaagtggaataatttagtggcatgatggtaaatagaaattaattttctatgtatttggttgagatgaggaagaatttttttttttgctttgtgagaaaggaaaaataggcccattaatccataattagcaatttccttgatagaaatttttgtaagctactaaaaagataagctagagaagatgttggataggcaaagtgtcaaactgtataagaacaatttttgatgtggctttttcatagattttgtcttaacctttagtaataacaggaaaagggtctttttacttcttaactacagtttacttttcaaaggctttctccattgacattattcgacacaaagattcaatggatgaactcttcagtcaccgtagtgaaatctttggcacatgtggggaggagcaaaaaactgtattacaggtgaattacatttatttatttgccatattgttcctgtttttatcatggtgaattagaagcacaattgtgaaatgatggtttaaggctttttccctcctggacttttcttatgattgttattaaagtccagcttgatgttctggggaattcagaatcttaaccctgtgtccacaaatgtttaaaacagccatcctatataatgtgaaatatattgcaaatccatcttctttataacaggggaattgctacttatcctcactccacagggagcaagctttgagttacttttcaaggtatttatggtagatttttttcagaaccatatgcagatattaattccttcattatagccttctaaaaggtcgtacctagttttaaaaggattggtcaagatggtttgtagacaagttttttcatttcgttttgttttgtttcataaaggatatgtttaagcacagtttcctcagaaatattcataaactgactgagctactcatcctaaacatttgaagcataaatggcaggtttctggagacttttttttaatcagaagaaaaatgacaggcaaaacttgataggcaaagattccatcgtagccccttagatgttcagttttaaactgatccattataatggtatattggccaggcacggtggctcacgcctgtaatcccagcacattgggaggccaaggtgggcagattacctgaggtcaggagttcgagaccagcctggccaacatggagaaaccctgtctctactaaaaatacaaaaattagctggatgtggcagtgggaacctgtaatcccagctacttgggaagctgaggcaggagaatcccttgaacccaggaggcggaggttacagtgagctgagatcgcgccagtgcactccagcctaggtgacagagtgagactctgtctcaaaaacatatataataataataatgctatatctaaggttgtgtatcattactgaaaggttaattttgctgtgtttttcttatactattttactgctttttaaacttttatcttttaaaaattatagaaataaaatatatgtatgataggaaaattagaaaatttcagataagtatgaagaagaaaataaaaatcacttgtaatctttactgatattttaaaataatttagttatgtattcttttagactttttaatgtatatatacctactttttttcttaagagtttataatagtaatacttatcctttttttttttttttttgctcacataggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgagggtaaggagcatgccaagtttcattttattgttctaaaatggtctctataatttatttaaaaacaacatttgttagtgtctataggtgcaagttctgtgttacgaagttaattcttaatcagttagaattcctttcataatacataatctgaattatttccttggttgtttaatatcaattgattaaacactaagattatagagatgtcgagaaccttagaatgacagaactaaagaaagaactcactaaaaatcaatggaatttaaaatatttccggggataatagggtgttgttacactcaaggtatggttggacagtactttctacttagttaggcaccaactggagtgaaagccatgaggtaatgtcaaaaaacatttgctctgtatagttaatgacacttcaaaatgtttatttctggtttatggcttgtgcttattgctattcttataagtggaagtgtataaactggacgtagtcagcagtaaagtcaaggagtggttggattgccaaaaatgttgctattcatagcttatccagcttggtatctcagtctggggaggtagacaattattaaaccatgtagagtaaaatagagtacatagaagtacttatgattacagaagagtgtggagtagacttgtatgacacagctggtaggggaagagaagagaggatgtttccaggaaggctgctagggtgatgagacatcagaactgactttcaaaaattaaattgggtaatgtcagaacctaagacttaggtgtttttctgttcccacacaaatggtgagatgctgggccttgctggtttttaacaattttgtttgttcctcttaaagttgatattagctctgatcaaagtatctaaatacataaactggtataaaagtactcattatggtttaattctttttttacctagcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacaggtatgtgtgtgtctgacactcataaccttgaattgtctactgttctaaacaagaggtctctgtatcaggtatgtctctgtgctcaggaatgtccagagcagcatgttaatacgtgatcggtagatagaacagaaagcttagcctatcttcatttttattccaaggaacattggcatactgacattctaaggagagtgaaatgagtcttggctggtatatattgtctgttgatggtttctctgaaaactttatgttgtgatgatcctttagcagatgattttggataaatttaccttgcagattcaaaagcagtgactgcctcaaaaaagtacttattgaacctgttacttttttgctttagagcaacagcacattagttttcttaagcaaccagctaactcatagtttaagatgcttgagtaaggagtagtaagagccaaagagaagcataaaccagcagagggatttaaagcatgtaactacatactttcaactaatatattactcttagtggtactgttgtcatgtctgggtattttattcctatgtttagtcaatattcttggttaatatttgtacttactcaagtttctccccccaccttccgtcccatctctcactcacattgtggaatgtgttactttgtgttgttgctgcctgctcctgtcttccccacatcgtcacatttcattgttgtgttgaccgcgcccaccattacagattacagaggtaaggtacccatccccattgggactagggtgttcttataatgctgaaaattgaggtcattacctgtaagggaatttcccttaactttagtggaataaatttaattagtgcagtttattatgccagtttcatttggggtggaacctagaagtgagagagtgatgggaagtgatgttgttaaggaatcccaccatgttttttctataggacacttgaaattgataagcctttctttaactaaaaccagagttggtttgagatagatttttcttaggaggcatgcttatctgttttgctcttttctctcctctctgcatcaaattttaatgagaacttttcagttgtagtcatgttattcaaagtaacagaaaagtgggaaggtaataattcttcaagaataaggttagatttggtcttccttaattacctttcattattccaacgttttttctctcttattgttccataaggtgggtcgttaaactgcatgccatgttacttttaaactacaagtcgtgtagcatattaagtttcccatccatttacacagctggtggagggcatctaacttgttggtctagtctgttgcatgcaactgtcatctcagatgttgacatactgactctcagcagtttcatagtcttgtcccttttttgttacattagttggaataggagaaatattgtggcagcactaaagatttgaattggtttctagtatattcatatatttagattcttaaaataaatattggctttttttttttttaatgggccagctctgtatatgcccaaaacagttttgttgttgtttttttctttttcttttttttttcttttagacaaagtcttactctgtcgcccaggctggagtgcagtggtgctatctcagctcactgcaacctctgcctctcgggttcaagtgattgtcatgcctcagcctccctagtagctgggactacgggcgtgcgccaccacacccggctaattttttgtatttttagtagggacggcgtttcaccatgttggccaggctggtcttgaactcctgacctcaggtgatccacacacctcagcctcccaaagtgctgggattacaggtgtgagccaccacccctggcccaaaacagtttcttaaccaaactcaacacttaatagccattgggctaaactgagcacaggttatcctaaacagtagtaggataatatcttgtccttattccctaacacttctccaagaagagtgatgaggtatgctgtgatggtaatgttccaacatttgtttagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaaggtgcttgatgattgtcattatttttaaaaatcaacagaataaattctaggctgtggttatcttcagcatcccaccagatttatttatttctttgaatgtaaaggcagtccccagtaatgagtattccagaaagtcactggaaaatcatttggaattcagaacacatttcgccattgaaacaaggttacaattggtagttagattcccaggccaggaaacaaaagctcctttaacccctaacgtgagtaaactacagtatcaatagtgggtagaacatagctaccttttgtaacactttccatgggaaacatacaagtttaacacagaacactggaaacaagagttctcatcttagcccttttgtaagttaggggttttgtatcttagcactacctttatagtagatgatagctcatttctggattacttctgtgatccctgtatgtgggataccaatgtaagaggaaaacgctagtatataaataataggccggagccacccgcagtggctcatgcctataatcccagcactttgggaggctgaggtgggcagatcacttgaggccaggagttcgagaccagcctggccaacatagtgaaattttgtaaaaatacaagaattagctgggtgtggtggcatgcgcctgtaatcccagcaactcaggaggctgaggcaggagaatcgcttgaacctgggaggcagaggttgcagtgagccaagatcacaccactgcactccagcctgggtgacagagtgaaattccctctctctaaaaaaagaaataaataataggccgggtgtggtggctcatgctgataatccaagcactttgggaggccgaggcgggtggatcacctgaggtcaggagttcgagaccagcctggccaacatggtgaaaccccgactctaccaaaaatacaaaaattagccaggcatggtggcacatgcctgttatcctagctacttgggaggctgaggcaggagaatctctggaacctgggaggcagaggttgcagtgagccaagattgcgccactgcactccagcctgggcaacaggagcaagactctgtctccaaaaaaaaaaaaaagaaaaagaaataatagtaaaactaaaatagaaaattatcctttagttataaatgcttagcatttttttaaaaaatagtttcattgaaaaggtcagagttacatggaatttctgaatagaccaatttcaggctcttcagaaagtcctattcatatctctttttttaacctcctcagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgaggtaagaaggaaacaaaaccctttttcttaggtgtctgtcctctagaaaaagcactttatcaaatcaaagtgaggtatgttaactgcttagccaggctgagtaccttaaaggtttttgtttttgtttttgttttttgctcttgtccccaaggctggagtgcaatggcatgatcttgactcactgcaacctccgccttccaggttcaagtggttctcctgcctcagcctcttgaatagctgggattacaggcatgtgccaccatgcctggctaatttttgtatttttagtagagacagggtttccccatgttgaccagagtggttctgaactcctgacctcaggtgatccacccaccttggcctcccaaagtgctgggattacaggcgtgagccaccactccaggcctaaagtttctttttaagtgagacattctccaattgaaaaaaacctgctcattatattacatttcttaaatgtagaaaaatagatggtagaaaataaaaatcaattttggactcattatctagagataacagttgttacattgacatacttttttctagtttttggtgctatttttcttttcttttcttttcttttcttttcttttcttttttttttttttttttggagacagggtctcactgggtcacccaggctggattgcagtggcatgatcttggttcactgcagcatccacctcccgggctcaagcaatccagccacctcagcttccctagtagctgggtcatatgccaccatgcctggctaatttttttatgttttatagagatggggtttcaccatgttgcccaggcttgtccagaactcctgggctcaagcaatcctccagcctcggcctcccaaagtcctgggattacaggcgtgagacactgcacctggcccaggagtctcttttttaccaacaacatttcttacctcatattgtccatttagcataagccaagcctatcttgatattatttctctaatttcttacttttatttcagctattttttcatagagaaattctttccctccccaccttgggtcaataccaatacatgagccaatttttaggatctggcacagagtttttttcaagatcatagaccccagcacttctgttatactctattgtcagcacttaaatttgtgacttgtactgtgttattttacccttgatatgtttctctgtaatagacttctagctgttgattataatttctttggaggcaggaaggggtgaacctttggtaaattattgaacctcaccataccttttctatagtattttatatatacatatacctatatgtaatatatattttgtatatatgaaaaataaccatgtagagtctgaagctttagtgtccagataagtgaaactgacagttatgttgagcatctgctattgatggggtataaatcacatttgcaaagtttggtaagttctgttctgttttctattttggcttatattctattcgtttacatgtagactattaaggaagagacagatggtctgcatgaagagctggagtttattcggatccttggagcagatttgatttttgcctgtggagaaactgagaagcctgaagtgaggaagagcattgatgaggtgtggagaaatggatgaggcactcagttagaacattagtgggcccagactgaagagtggtattgattgaagaatctgattgaatgtttttcccctagatgaataatgcttgggagaacttaaacaaaacatggaaagagaggctagaaaaacttgaggatgctatgcaagctgctgtgcagtatcaggacactcttcaggtgagaggccaggaggtgaccaccaaggaaatacaggttctgttttttgccatttttgtcatttttggaattaagcacaaaagtggatcaccttcacaggactgcagacctaagatagtggtgtttccacaaatttagccaaagttccccacttgtagtgaaaaaagtagcgacatctgtctgaattcttactcttcctgccatgtttatcattgcctgctcatcatagattcattcagctacgttgtgaagctggccttactgtgaaagtcattgcttgccagaggttccaaacccaggttatcttcaagcacagtttggcacagttgcttcagaacatcatgagcttgctagctgggattgaaaaatcttcacttttattcaaatttagtatttccaaattgtagtttattttgaacattatcttgataatgttggctccattattaaatcaccatattattaatataaagatcattattctttatctgtgccccttacctgaaatcacaaacagcacaaggtgctttgattgatttatgtcttcttatgttagcagagataatgctaattctctcccaaattcttctggttgtttttgactgtttacttgtcttttgttctaggctatgtttgactggctagataacactgtgattaaactctgcaccatgccccctgttggcactgacctcaatactgttaaagatcagttaaatgaaatgaaggtttgtatctgggtatggcttttgaagaagaattgttttattatagtttttaaaggcttgatttgatgttaacattgagtgtgtctttgacaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacaggtaaggcaggtggtagatgacatcagtgaactactctccgctcttttctaatttcgtattgaatattccctttctgtcttttcctgagtagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtaagtattttcattttttcatctctaaccctattgatttgagaccagatgctgccaccagcagcctttgaatgttgtgtatatcttaagagaaccaagttagatgatatccatagagataaattatgttgttcaacatgttttaggtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggtacatgtgacatccaagtaaggtaggaagagctatacagataacagaaagcctatctaagtcagagagaagagatcaatttgaaaagcaaagaatcccttatgtcttgaggggaaggttaatactgtgctgtaacttatctagaaagagcagcttttgattgggtagttcttttctgaattcatttctagctcagtctctttattcacattcaaagttagcagatcttcactataacagattccctttttttcttggatcaagtcaggtctcttcctattcaacagtaccttaatcaatagtcaattcatctgatcgtatcaggcatttataatatgttatagtgaggtctgaaggattctgctagattctagcaataatattggccccatgctaatctagcaacagaacagctttgccagagagcagccgaaaattccttcctcaagataaactcctcatatcatttggaaagttgacttttaaagctgagaaatgactactgacatggttgatatatctttttctcaaaaggcccagggcttccacagtgaaattgaagatttcctcttggaacttactagaatggagagccagctttctgcatctaagcccacaggaggacttcctgaaactgctagggaacagcttgatacacatatggtaatagcaattttttgaaattgagcataagcatcccatattcactagctcctttccaagttcacagtcataattaatatgtatctggaaatctacaaagtagtgcatttttatcaaacatatagtataacctttggggattgctgcctgttacaggcttctaataccttacagtaggcagcagtagtgacagggaaggtcagctggaaattttgagttaatcagctttactggcacacatatattgacttgaagatgacagcatcaagaagacaaatatacaacacagatgtgctttcacttaagaaggaaactacttaaggggggtttagggaaatcaaatagttacccgacagtatttcaagaatgcatgctagaacaaaaagcaacataatttctaggcaaatttttcatgaaaaggggaaatagattattggagtcttttgagggatctctaatccttaaaaaatgtttttcttggccgagcgcagtggctcacgcctgtaatcccagcactttgggaggccgaggtgggtggatcatgaggtcaggagatcaagaccatcctggctaacatggtgaaacctcgtctctactaaaaatacaaaaaattagccgggcgtggtggcgggcgcctgtagtcccagctactcaggaggctgaggcaggagaatggtgtgaacccgggaggcggagcttgcagtaagccgagatcactgccactgcactccagcctgggtgacagagtgagactccatctcaaaaaaaaaaaagtttttcttctatgggtgataaaattattttaatattttaatttgccacttgttatttagtaaaatatgttaatacttacattttaatacaaatgaattctaagtaatcagtatttagttattacaattaattttattattaagtatggtgggtttcattcccttatggctcagcacttgaactgaatccaaaagaatggcttgtaatcaagatgagcccttcctggactttcccagactctgctacagaatctatatgtaggtgtcttccagagaattcgtagaattgatatctttcctgccttttcttgtaggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaaggtacagtgtatgatccccatgtttgagtaatttgctgagtgattgcatgtataataattgccatcttatttatatgaagattttttgaagaccagggtattgtaacagaagttgcagaactgattccatctgtgttgagttgcattgatggtataagtttctgttgttatttgcttttataattattcattccttacctgttaagacattactgccattatcgcttcgtgatgggctttatgtcctatattaatcaccaatttgtgttctacttaaaaacaaggttttgctggagttggtatcttggggttgagagattggggacagggcatatagggactgacgaataattctccacaaggaatttggttcctaacgtaaatgtagtgtgcaaggaaatttactagaaatcaggagagaagtaaattatatgacctcttcccactcatcctcaaaaatcaaattctcttctctacaaaataatgaaagatgactagggatcaaggtgtttgcccaaaaagattattttttatgagtacagagtttcactgtattttttgctgctcagatcaagtatgaaatatatacatacacaaacctgttgaccacattcactcaatgaatagttattgagcaagtgtgtgccaagtcctgtgcctgatttatggtggaaacactaaagacgaccctatctttgggaaattaatgaacagaagggcataaaacacatgaacatcttgagagaagcattaatttcctaaaaaccttctagcatgggattgggtaatttgattatattaagaatggctaaaggacctaagtgtatgctaattcttggacagagtcagacctggtggctcacgcctgtaattccagcacttgggaggctgatgcaggaggattgcttaacaccaggagtttgagaccagcctgggcaatatagcaagaccccatctctacaaaaatacctaaaaattagccaggtgtagtggcacacgcctgtagtcctagctacttgggaggctgaagtaggaggctcacttgagcctggagggttgaggctgcagtgagcagtgatggtgcccctgcattctagcctgggtgacatcaataacctatctccaaaaaaaagagaaaacaatccttggacaggctgtcatccatagatcctgcagaaggcaaagctaagattaaataaactgagacagattccagctcataaccaagaaattttcagagagttttcttaatagttgagcaaaataccttaagacatagttgcccattatcagaaatggtcaggcaaaagctgagtgtcaaggatagtttattattttgcagaaacattaccttcaggatcagtaaaatcatttattaaatgtgtgtggtgctgtagtaagaaaatataaagaatatgtagatataaagaatataaagatataaattagatataaaagtatatcttttatatctataaagtagatataaaaaatatataaagaatatgtggatagaatgatgtggaaagaattcctatcatctaggaacttgtaatatattaatttctaaacatttctatatatatttgaagtggatttcatttttccacctgatttgtttagattgggtttgtacatttttataacatttattgtaatttttttttttttggtggggggtggttacaaaaataacctgaaagcgcaaagaggaaaatagaaattacaacccagtcaggtagaattaacaacagttaacgtttttggtgtacatcttggagttttttctgtgaatattttggaaatactcatttttgtcagcctgtcatttttactttgcctgcctagtaggggggccagaggcagaagtcattaccaaaaggttagtgtaggtctctgaggatggagcttatgaactctgtgggattgaagcgtacttgtgaggagtagccttttccctgaatgagctcttgttgttgccattcttaggtaaatgaaagtgtctgaaaatctacatctagtgttgtcagatttttgcctagaatgtcttggcttctttcgttacctcttcttcttatagcataagcataatttttagactcatattttcatatgccatattttctgaaaacatgtatttaaacaaagagtactacattgaacatcatcttcatagtaaattgcttttcatttagctgtttttataccacaaaaagtacattaaaggaaactgaaacattacccaaagcaggttgtagatcctgcagctgtcaccactaaagggtctgttcacttacagttattgaatagtcttattcccgttcaaggaagtggagagtagcagagaaaggaacttagctgcttattgtgctctatttccttttccatgtacacagttcttgcccatttgtttcagacactaacattaaaatgtccccttctttacaaataaagcatgtttggacgttgattaaatgaggcttcctttttagaggtcatttcatttgttgtacaattcatgcctttgtcgctgagcctataattcctgaaattggcgctttttctttctgtgtgtgtgtgttttacttgaaattcagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtaagtatgatattatgatgctgcattctttttgaaagcactaattgaaagaaatgcccctttatcttatcttaagctaaaaaagagcactattgttccctcaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaagtaagttggggaagaaagatactaattcactgaagagtcttgggctgcatgtattgagtctctgggatgattctcaaacgtgctgtatagtgtgtatattcattcctgttaacttatttcttatgtaattttagttccatgaagcttggaaaaaactgattgactggctagaagatgcagagagtcacctggactcagaactagagatatccaatgacccagacaaaattaaacttcagctttctaagcataaggtaaagcagttaattgctcttaggtcccaagccatagtattcgctaaagcttgtatcttgccaaaaataaaaatcagagctagtaaaaagaaaaccaattggttaatgtttaaaagtcaaaatgatgaagccagggttccattttatatctagatggtctaatcatgatatttgctcatttaaataacagtttaaggaaagtagttatgggagtaactagttaaaactgtaggctttcacaaattgtcaggcacttctatatatggtataaacaaaaaattataaatttcttaaggataagctatggttaattttagttcaaaaaaagtggtgatattcatactttatttggtttctagcctgaaaactcaaattcttttgttccaaatcaagatgtcgtctgacttttaacacttttttcttttctttctggaaacataggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggtgagcatgaatgtccccttcaggggtctaaccgggatcccaaaagcaagaggttcttaccagattctataaaatggtgataaagctaatgcatcagtaagaggttttgtaccatcttaacaccaccagttagttcaaagactgttataatttaaataaaatgtgtaaaaattctcattttaaacttgaaccttattgtattagagagaggcctataaaatcaaaccaacaataatagatcagtaactcaaaagtatttgtaaatcatcaatttgtaataccaacaactgtcttattgactgctcttggacactccaaagcctctacatgcattacctcatttaaccataatgatacctgacctttgctgggcaattactactgaatatgtaccaaacagtagctgataatcatttaatcctcataaccactgaggtgggtaccatttttattccattgtacagatgagaaaatgaccataaagaggttcttaactcccctaaggtcactcagctaccctgttggcagagctgaggtttaaaccatggcagtttggttctaaaagttgtacttttatctatttgtacccactatgccatgctaaatattacaatattgctaccctatttgtacttttttttgtttgtttgtttgagacagagtctcactctgtcacccaggctggagtgcagtggcgcgatctcggctcactgcaagctccgcctcccaggttcacgccattctcctgcctcagcctcccgagtagctgggactacaggcacccgccaccacgcctggctagttttttgtatttttagtagagaagggatttcactgtgttagccaggatggtctcaattttctgacctcgtgatccacccgcctcagcctcccaaagtgctgggattacaggcgtgagccaccgcgcctggcatttttttttttttttgtcatgttgagacagggtctagctctctggcccaggctggagtgcagaacttactgcagcctccaactcctgggctcaagggatcctcccacctcagcctcttgagtagctcagactataggcatgtgccaccatacctggttaatgttttttgtttttgtttttgagatggaatctccctctgtcatccaggctggagtgcagtggcactgtctcgggtcactgcaacctccatctccccggttcaagcaattcttcttcctcagcctcccaagtagctgggactacaggtgcacaccaccatgcccagctaattttttttaatatttttattagagacggggtttcaccatattggccaggctggtctggaactcctgacctcatgatccacctgcctcggcgtcccaaagtgctgggattacaggtgtcagccaccacgcccagccattgttttttatttgagtagagacaaggtcttgctattgtccaggctgttctgtaactcctgacctcaagtgatcctcccaccttggcctcccagagtgctgggattgcaagtgtgagccaacacacttggcctgtactccaattttttttttttatgaggtgactgaggttcaaggagatgaagaaacagcctagggtcacacaactgatacagagctaggagttgaactgattccagatcactaccaaaactatcatcttttacttagagtggtatatgaggtgattaacacagaccttgggttgttagggtgtgcctgtgtgtcactgggctataagatgcctaaagggtatctctacctgtcccctgtgctacccttaatccattctagagggtggtttgatttaaaatgtctcaccatctctcagtcactttttactctatttctttttttttttttttttttgagatggaatctcgctctgtctcccaggctggagtgcagtggtgcaatctcggctcactgcaagctctgcctcccgggttcgcgccattctcctgcctcagcttcccgagtagctggaactacaggcacccaccaccatgcccggctaattttttgtatttttagtagagacagggtttcaccgtgttagccaggatggtctcgatctcctgacctcgtgatctgcccacctcggcctcccaaagtgctgggattacaggtgtgagccaccgcgcccggcctttactgtatttctaactgttctaacatagaagtcactctctatatagggttcaagcaatattccctttcagcgaggcagaattgtgggccatttgtaaaaggaatccctaaaaatggtagcgtttgtgtgcatttctcaggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggtaggggtgaggtctgggctacattggagtgcagtgggtcttctgtatatgactgcctagggtcttctacatatgactgcctctgcccttctttctaggggagaaagagagcctgacagttgctttgtgtgtttaaacaaactgttgctgagattctgcattagtcacaacgaatttaccaaaattggtttgattcagatttggcaatgtgtaaacttcacttcaaggttgcgcctcttcctgtttgtttctctcagttgagtcacaaaatggatctaaattccaacggaaacccataagatagccatttccactgactcctaaaatggaaatgagtgattttttttttaaaccacttctgaacctaacaatcctaacaccaggcacgccaatatttaacataatctctatctgtcatgttgaattatgtaatatcctcctgtttcagcacaagcatttaactttaccttgaaattacaacagattcttattatgtgcacagcagatgtttttatttcccataattctggaaacgttagtataatggttaccattttacagatgaagaaactgggccttaagcaacttttcaaaattatgtatctcctaaatgcctgagctagcatttacagccacattttctggttgtttttttctttcttttttctttttttccccttgagattgggtctcgccatgttgcccagactggtcttgaactcctgggctcaagcagtcctctcatctcggcttcccaaaatgctgggattacaggcatgagccactgcgcccggcctggttgttttttcttatgcattgctctgcctccctctatgcataaaagacacatgattagaacctaccaagaaaattattatttcccagtggtttcttggactcaaaacattccttgaacaaacaaattctcctattttcttttctaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagtaagggatatttgctgtcccaacccaagggatagatctgagtgggtttatttggtttttcttttactagaatctgttccagtcagtcttgaaataagtataacagagttgaaaattgatattctgaatgttctataaaattttaatattcattttgagaaataatgaattcagttgattttcaaagatctacaaatgaaagataacctttgtggagttttgatgaggccatgaaatgtctgaatgaacactggaccctttccctagcatgtcccagtatctaggtccttggctgcagagagaggttgaatcttttgtgcttggttatttcaggcggaagtgtttcgagacacagtccacatgctgttggagtggctttctgaagcagagcaaacgcttcgctttcggggagcacttcctgatgacacagaggccctgcagtctctcattgacacccataaggtaatccagccttggggtttggtgacctcatgctacctaccaccttgagggctgcctaccactaaatgaaagcaactttttcttggaaatatcagagctcacatgaaaaggaacaaaaccagagtggccctagctcattggtttagcaggaatgaaagggaagcgactgatgggttttttgacaccttaaacagtaacattcattcttataaaagtaatatatgttggttgtaacaagttttttaaacatggtattaagaaaaatgttgactatttcatcttctttactcctcacctgcatacgcctttgtttgccttatgttaccagctttaggccctgatctgatcccccagcaccacttactaagctgtagagtatggtgcagtgtctggggtctcagtctgtcctaatgaggtgggaaatgtttccctttttaaatttttatgttatccactcagagattttaatcatggatttgttattatattctgttatgggtattttttaaaatcatggtttttacaactataattatatttttccaatacaaatatgtttaccaacatgaaatgaaataggatataaatgagagtaaatgaaaaatgggactaaaaaagagagaaactaactcgaatgggaaaaggggggcatacctctgtgtgtcctattctttgttgtcatctccaccagagaaagtcattcttgtgtaaacccctcaccttcccacatcttttagaatgaaaatgccataaataactatacaggcttttagaggtctgcgttaacacatggaggaaaaagaaaacattgaaatttatcccccctcagtgtaaactaacagtgctgctaatgtagactttttacgtttttgttttcaaatcttttttgtttaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtgagtccctggttcagaggaggactgcacacgcccagtaaactatcactatagtatagtatagtatttttcccccaggtaaggaatctttcactcactgtgaataactcagcaaaaattaagttaacattttagtaaagactgttttcttggtaatgtgtggcaacctggaggagtagtgttggcatagtgctatgttaatgtgacttccagtggacatgttgtgtagtgtctgctccttcctgggaaatcctgtgttaacaggatgtacagctgacccttgaacaatgtgtatttcaactgcacaggtccacttatatgcggttattgttcagtaaatacagtcagccctccatgttggtggggtccacattcacagccaaacatggatagaaaatacagtattcacgggaagcgaagcccatgtgtgcagagggcagacttttgcaggttgcacaaaaccaattataggccttgagtatgcatggattttagtatccacaggtggtactgggaccagtcccccatggataccaaggaacaactatactagattttctttcaggagggctgatattttattccagctcttatcccagttgtcactggggtaatagtgaagcctcttgactgtttgggtggtctctcctctaaaaagtcattgtgttggccgggagcagtggatcacgcctataatcctagaactttgggaggcttgaggcggtcagattacctgactcaggagttcaagacaagcctgggcaacatggtgaaacccatctctactaaaatacaaaaaattagctgggtatggtggcacaagtctgtaatcccagttacttgggaggctgaggcaggagagtcacttgaacccgggaggcagaggttgcagtgagccaagattgtgccactacactccagtgtgggtgacagagcgagagtctgtctccaaaaaaataaaataaaaagccattatgaaaatcagatgaaaaagggctttggaaacaaagggggtatgcttgactgaaagaggccatggtttccttctttttccacaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcaggtatcttaacctcactgtgtgatcactggtgttttccgtgttgggcatggagaccatctctgttgccctgtgtatatgtttttaaatggctgcttaacacattaccacagacttagcactgtaaaacaacacatacttacttacctcatagtttctgtgcttcatatacctgggcatgagttgactaagtcctcttcctggagtctccccaggcagaaatcaaggtgtcagccagtactgcagtctcatctggagttcagggtcctcttttaggctcactcaggatgttggcagaatccagatcctggtggatgtaagactgaggtctctactttcttgctggctctcagctaggagttgctcttgccttctagaggccccctcaggtcttagccacacagccagccggagaaactgtccaaagtgctctatggagtcttgaaatgtaatgaagaatgaaatgtaattaagggagtgaatattccatcatttgcccacactcaagggagggggattacatagagtgtgcatacaggagtgggaatcctgggggcctttttagaagtctgcctgccacagcctgtttttattgaccatcatttgagccagggtcccactggtccccattatacctggttcagaaagctctctcgcatgaacccagtggtcagtgaaggtgcacattagactaaactgaatggaggaaagctcaggtgggccatcttcataatatatccttaagaggcaaatactatttttaaccataatcatttatactgaattcaagcgtgaatgttgattagttatactgtagactatatggtctttttagtttatataaacaattaccccagcaagtgagaactcactatacagatagtccctgacttacagtctctcaactttatcatggttcaaaggttatacatattcagtagaaactatacaattagaggccaggcgtggtggctcacccctgtaatcccagcactttgggaggccaaggggggcagatcacttgaggtgaagagtttgagaccagcctagccaacatggtgaaaccctatctctactaaaaatataaaaattagtcgggtgtggttgtggttgcctgtaatcccagctactcaggcggctgaggcaagagaatcacttgaaccagggaggcagaggttgcagtgagctgtgatcgcaccattgcactccagcctgggcgacagagcaagactccatttcaaaaaaaaagcactttgagtgcccatccaaccattctttcactttgattacatgagatagtcaacactttattataaaataggctttgagttagatgattttgcctaactgtaggctaacgtgttttgagcatgtttaaggtaggccaggctaagctacgatgttccatagtttaggtgtgttatattttcagcttaacgatgggtttgccaggatgtaacttcatcgtaagtcgaggagcacctgtccttcctgtgggatgtacctcctctctgagagattatcttcttcctattcagttcttctcctttctgttttcctctctctcctctatgtcttcagtctctccctgtttattcttttctctaaagcttccagacatgtccttccaacccagagttcccctcctttttcagctacgcttcttgttccctgtctcatctccttttttcccatcactccccaagtccctgtggtctggctgacactgttctggtcacattctactggctaaatccaacagagttttttcagtctttattttgtttgacatgtaacctagctggctcttcatcccttcccaaaacttcccttttgacttctgtgtcctttaatctttgtgttttcctctgatctctctgaccgttcctttttagcctttttagctggttcctcttccctgcctattcatcagtgttgttccctgacgtctcattcttgatgctctcctcactctgctaagatttatctggtctaacagctttagctattacctataaagcttctgcatctttttcatcttcagcactatcatctcctaaagtccagacatacagtaaactagaagcagttctaaaatttccactttatctttgcccccttgcctgacgtcatttgtccattccagatctgccccccctttcctcattcagaggcctgtgatgtctggagttcctccttttcctcacatctagccactcaccagggcttgtcagtcccactttcaaaatacctcttggttccatctttcctgccctggctctggccctcaccatgttttgcctcagttgctgcaatggtttcttaacctgtcttctcactgctagccactccccatcccacacttacccccacccccacatcactccatgttttacactgaagccagagtgatagctgtaaagcatgggtctgatcatgtctcttacctggatcgaaatccttcagctgccccctgttgctctcagaataaatggccaacccttagcctgacacagaagcctttcgtgatctgtctcctgcctgcctctccaaccctgcctcttgccattcctctgattgcatcctctgcccagccagtgagtggaggggtcctggtcacagcactgtcaggcatccctgtctctgtttgggttgcaccctcttccaggactgccttcccaccatttgttgactgtttcttcattgctcagtgtgtcagtccgtttgcattgctataaaggaattcctgagactgggtaatttataaagaaaataggtttattttggcttacggttctgcaggctgtacgggaagcatggtgccaatatctgcttctggtgagggcttcaggaagcttagaatcatggtggaaggcaaaggggagccagcgtgttacatggcaagagagggagagagagaaagaggaggagatagcaggctccttttaaacagccagttctcatgtgaactaacagcaagaactcactcattaccatggggagggcaccaaggccattcatgaggaatttgcccccataactcaatcacatcccgttagaccccacctccagcattggaaatcacatttcaacatgagatttggaggggacaaatatccaaactacatccctcagtaactcaactcaggcaccagcctccacacagcctttcctgccaccacaggccgtaaagtacccatcctagctcttcctttgcccccataagagtaaaaatacaatatttaactctttttcctattttttgtgtttaacagacatttatggaggagatgactcgcaaacagcctgacgtggaccgggtcaccaagacatacaaaaggaaaaacatagagcctactcacgcgcctttcatagagaaatcccgcagcggaggcagtatgtttccagccccctgtgttaggatgcttcattcctgctaattgaggatgagcactttccaaatgcctatcaaaaaaaattatattccattttcaaaaaccgtgttggttttgaaccaaaatctctcatttttgaaactcacttttcttacattgacagacagtagctgtactccatattctttggtatgattggtatgaaattacgaggtggttaagcttattttttaacagtggcctttccattgttttggttatcagccctagctgtttacatttggcttgtactaatttaatcaacacaacagcttctacagaatatgttgcttttttagttgagttaacgtgtcatcagctcactaaggtaggacagaattgcttggagatatgtaggcagcaggtaagtatgtgctgggaggatcagtacttttggaattagtacacctccgtatctaaatattgccaagtcccgtatttcttttctcagttattgactggatattattataaagatcttctaggtttatacatacagctatttctctttgtatactaaccagctgttctaatcttgtgattatttttccttttagggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggaggtaatgccctgctgagtggccttccctgaaacaaagtgcttttttcaatcaaaacacagcccttctgaggctctcttaatgtgaaccttgtgtcttaatttactttttcacaatagaaacagacctataccaagccagtactcattctttgaggcccctgaatgagaaaagacacatgtgtaagaaaaccgtttgtgacagagtaggctaaagcttctaggtgtggaaagcaagaaaacagccagtccataatgagggccaggacctgatctgcctcagcatcttgctgtggttgggaatcaggaacagaactttggaaatttatctccagatatgtagcatagcacaaaaatgacccttgttgagcctttcatgtaaaaacagatgctacagaattatgaaataggagtaatttttaatgattttgttattagtcttcacttgatcatgagaagcaactctattttgaagtgtcattacccagtataaaaaatatagtactatgcttcctagtttctaaaacaagcctctaatatcttttgtatttttttatttgtgcatatcaaagcagctatgcctggaagtgagtgttctgtgttttgtttattttttccttaggtcagttgacttttaagcttattgggttcttggtgcttttttcccccattccttctaactttggagtttgaaagaccaaggggaaactgctgcactctttaagtcattttgagtgtatatcattaacgtagacttaagtagctgaaaattgtcttgcccactgcataggcctgctgttttccatcaaggccaaatatttaacatggaggtcagatgggcaatttgctctctggtgccattccaaagaaacatgcttggatacaacattgggttcccaatgcttccatccagaactcagattttctcattgaaatctcagaagatagtggtaaacacgagcctcctgatatgagccctatgtgtgattataatgcctttcaaaacaacataatcgaggagtgctaaggacctcccttctgggttagaatccatttccttgcatctaagagagtgatcctttgaaaagcccaaagggaaagcaaggctggcttcacccattctcattctgtgtgctccatattttccatggtgattcagttattgtttctcttgctattccattataccatagctcgtgtaaatagtcatggctttaagtgaaagagccagattgtgccttcacaaaagaagcaaacacatagatttcattgttgatggcccctggaagcatggctttactgaatgtctgaaagtttgggtatgctctgggcagcttttgagggcccaaaaaataaatcttattgacacttctgatttctgtgtagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccagtgagtctagtcatcattccaaacatgggtcacacctggattccttgcactttgtagaagctgtgatattctagctaaacagtctttctgaagctggccaggagcttggctcacacctgtaattccagcactttgggaggcaggtggcaaaggcatggtggcacacttgcagtcctagctacttgggaggctgaggtgaatcacctgagcctggggaggtcaaggcctgcagtaagctgtaatcgtgccagtgaactctagcctgggcaacagagtgagactctgtctcaaaaaaaaaaaaaaaaaagacagtggttaaccagaggttttcagctgggaaacaatatgatttggtctgtgttttagtaaatcactgtgactactataaatagtcacacttccctttgtatagcaatttgtttagaatctaagacaataatctaaacataggaaaacttcatgctattccaaactgtcactattctgaaataatctaaatatccaataattgtggagtggatgagtatattcttgagttgagtggtaggactgtgggtggttgtaatattatgtttatgccttttggtatatttgaaatggggaatattaccttttttcgttgcatttggggtaggggagtctataagtggatatgtattatttttcaggaaaaatcaagacataaatttttttgctcttaagaagtatttctggccaggcgtggtggctcgcgcctgtaatcccagcactttgggaggccaagatgggtggatcacttgaggccaggagttcaagaccagcctggccaacatggcaaaacctcgtctctactaaaaatacaaaaaaaattagccgggcctggtgacaggcgcttgtattcccagctactctggaagctgaggcaggagaatcacttgaaccagggagacggaagttgcagtgagccgagattgcaccactgcactccagcctgggcgacagagcaagaccttgtctcaaaaaaaaaaaaaaaaaaaaaaaaaaatctataaccgccaaccgaacaagtacccctcttaatgtttcaaaatatgattccttttctccagagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggtaagggaaataattatattttgagtacacttctggctgtaggtttgtaatatcctgaatttggttgggttcagtgatcatattagcctttgacttgtctgttgggagataattatttggagttctattttgagatctctttttggatagcatttcaaagagtcccagaggatctctgacatctgagctctagctcaggctagatggattactcaagtgagtcatgtctgtgtggtgctctgaagtttacagagaacctttgcagggcagcatactcatcctggttcactcgtcctgtgtttgggatggactcatctcactcttgagcatgctgcctggaatctagggaaatggtctaccagtgtagcatttaagggttgaaatggactgggcatggtggcttacatctgtagctctagcactttgggaggccaacacgggaggatcactggagcccaggagttcgagaccagcctgggcaacatagtatgattctgtctgtcccccccgccaaaaaaaaaaaaaaaattagccaggtgtggtggcaagtgcttgtagccccagctactcaggagactgaggtggaaggatcacttgagcatgggagatcaaaggtgtggtaagctgtgatcatgccactacactccagcctgggcaacagagcaagacttgtcttaaaaaataaaaacaaatgtttaaaaggggagtaaaatgtaatgtttaaaatggtgtatacccatcatgctttctgccttgttaagaactaccacattgaaactgccaaatttattagtgccatctagaaaccctaacatctgttgataacagatcttggtaagggagaggtgctgggacaggtcttaggagtggccctggaacacaccaggactgacttccagggaatcttgggctcctagggtgaaatttaaagcagttcataatttgctttattaataatttgattttgatgcaagcatattagcacttttctctgaaggagttttgaagcaggaataaagaatgtgttgtatagtcacttgggaattttctttcatgccttttctcagtgtctcaattagttcacttagtaagaagaacatatactaatttggaacagacaataaatgtatatgtcaaaagcctgaaatgcctaaaaagtaaataatgagctgtgcgtggtggctcacgcctgtaatcccagcactttgggaggctgaggcaggcggatcacctgaggtcgggagttcaaggccagcctgaccaacatgaagaaaccccatctctactaaaaaaatacaaaaaattagctgggcctggtggtgcgtgcctataatcccagccacttggggggctgaggtaggagaattgtttgaaccaggaggcggaggttgtggtggagccgagatcgcaccattgccctccagcctgggcaacaagagcgaaactccatctcaaaaaaaaaaaaaaatgtaaataatgaatagcctccctgttaatgtataaaaatctttgtttctctgaataggaagttttgctctaccctttacactttcctttttgttcacacccaataggttacaagacaagtggctcagtgcaaatgtgcaaaaaggtttcaggtggagcagatcggagagaataaataccgggtaaggaagagaaaaagcagtcctttgttgtggtggtttctcatatgtggctgatcccaccttttcctcctgatgcttagaggcccagagcccatcggacttgagatgtggtcactctctgacctcatctctatagatgccaagtgtcaggtaccctgttacatctgaaaactagtcccatatctacctagatagtagtagtttgtatttaagttttaagataggagatatttcagagctgtcacttcacatctgacaaagttcctagggggatgaaggtacctttggaaacaattatatctattgactgaccacttgcccacaaagagatggtcattgtgagcctgagtggctcccaggctagagaggcctggggaaactgtgttgaagccccaacagacactgtgcctgctctgagctgggctacaaatggggcccaggagcactgaggagacatcaggctcagtggtcttccctggaaagccatgctaggtgtggccataactgacagtgaactatacttgtgttttagcttcttttgggaccagggtcagggacatagaaggatctgaaacaggtctcctaaaatatatcaacagctcgtcaagattctctaaagtcctaagaaaaatctatgattggcaaagaggatttagattgcactaagaaacacaggaaggtccatgtttcattagtatatccaaaatgtcctcaaagtacaccaaatctaccccatgctgcagtctcctgaggagtgctgggtgaatctgctttgaatataacctagggcatttagttaataaagctccatataatcttatgcctgcttgttggattttgttttcttgttttttgtttttaattatctatgagagaaatgaattaacaagaacaacatagcatggagagttagttcatagtttataaaaccacatccctggccgggcgtggtggctcacacctgtaattccagaattttggaaggtagagaggcgagcgagcggatcacttgaggtcaggaattcgagaccaacctggccaacatggtgaaacaccctctctactaataacacaaaaattagctgggcttggtagcgcatgcctgtaatcccaactactagggaggctgaggcaggagaattgcttgaacgccggggtcggaggttgcagtgagccatgatcgcgccactgcactccagcctgggcaacagagcgagactctcaaaaaaaaaaaaaaaaattaaaaccacatccctgtggcaggagcttggtaagaatatgttcagtgtgtgtcactttgccagaaaaatgtaatgatatgattttcattctttagtgttaatttgacaaaatgttctctttttttttcccctcctttcctccatcctttactctttactgtctatagttcttcctcggcaatcaggtacagtgtgccttgcaatgttctccttctcaatggatatggtctgtgtagctaatgctgcctgttcttcgctatggggagaggatgtaatctgaagcatgcctgggtcgcacctggttgtcttaccaagtggagaaactgttgatggggccagcattgcaaagctatcttagcagcaaaagaatataagtataattttttataaaggagatgaaatggaggaaagtgaagctatggtatcagtccattacacttctaagaagagcctggttttgtacttctgtgttagaagtcagattaccaaatagcacagttcttatttatattagaatcttttgacagttaataaattttgtaatgtatggtaagtcaattcctgaagaacttcagtactatttaaatatctttttaatatttgtagttacttatattgtatgttataattacaaggtatctgagaagtgtagtgtggagatcgtaattggccgtggcctgaagtatgctgattatggccagccagccaagatttaatgggaccaaattagacttgcaaaaaagattggatgctttgactccacttggtaactctaacctttcagatctttttgagtgctgtggggtcctgtgtcctccaatgtggaaggaagttgcatgagtaaaatctgtctctctgatatgaaattataaacactagttgttgatttcaggccctcaaacatcccaggccttgcaagtcactatagaaatgttctaggcaagtgggaagaacaggggataagagaaaaaaactaaagatgagaacaaactggctttaaaaaaacatcattgcttgagagtgtccaatatgcctatttgctaatgactgtgtgtgaatgctagggtgcctttgaagagtcctgacaccctcttctactgctccattgatcaggagagggtcagatgacttctaatgttgagaacggaattatgaagttcattttatacacaggcaactgaggcctcaaagatcacatgcctactctcacacagctagtgtcagccactgcaagaacccaagtctctgtaagaggttttccttttaaaaggtggaaacaacagttactgacccttaggactcttatttgttctttgcctcactgacaaccttgtcctaccaggtgtgcacaggtctccatttttagagctgccataatccctcctaccacttgtgactctggcctcaacttccccagctacactggctgctggcttggtcaaacctcctttcccccatagcttagcagaaacaagttagaatctttcaaagagagctttagtgtgaaattaaggttgggggggacatgaaatatatggagtgataaattatagtacacagtattccaagaataaagtactcttgtggttccttcctgattcaccctggggtacacacaggtgcatactccctgcctctcacccatccagagaaaaccctttgcagtgactcaggtccaagagcactgctcttgggtggaatcctccatatctctcagaacctcccacagggcttctcattttcacttgtggggcccagcttctgagagggggctctcacagagcctggggggcagcttccttcccaggacaggacgtgtattctctttcaagtctgggttcagtgctgctgctaccacacagtgcttttgctgcagtcactttgtataaacatgtttaaattgtatcagatgaaaggtgtgggacttcttttattttcaaagtaaagggctgggagggaggatacagtatttttcaattgccttgcctgtgcaaatactgcatttgagtcagagcagctaaggaatatggagaattaccacaagtatattaattttgagggaggatggctatatgacctcagatatcctttcttgcattttcaatttttctgccttgttttaaagttacagttgtcctttataactttgaaaatcctggccgggcgtggtggcttatgcctgtaatcccagcactttgggaggccgagacgggcagatcacgaggtcaggagatcgagactaacctggctaacacggtgaaacaccgtctctactaaaaatacaaaaaattagccggcctggtggcgggcgcctgtagtcccagctactcggaaggctgaggcaggagaatggcatgaacccaggaggcggagcttgcaatgagccaagatcgcgccactgcactccagcctaggcgacagaacgagactccatctcaaaaaaaagaaaaagaaaaagaaaatcctaccaactccatacccgaggaacccttgaattgaatgattttaggaattccatttctcctaccagatgtttgtttgttttggaaactctgcatacttctcttttgttgctccttacttcattttggaaagagggtaatttatgccatgagaaactccagatgtttagagctgggaagtaggaatgtttgggcaagaaaaaagggaaaacataaataatcagaaatatgcttgttttagcatctaaaatgattattggatactgttcataatcatcatgggagctacaatttttaattgcttcaactcaattttagtataaatatgacctaatcatttgttcagctgaagaaacttttctgctggtgacactgcaattagcaaatacttcgggttaattcctgaaaacctgatgcagaaaatcagattttcttctaagcttgtaatgatgctttgcaaaggtttccttaaggcttgaaatagtattcactattttccatttagctttaaagcatactgtattcagaagttgatatccacaatctttcttttaggaaaacaaattagcatgccaagaatatgaatttttaattgagcagaatctcttttaaaaaaataaagtgacctaacactttgtctgttttcctacctctccttttggtgcagaggcagtggtgtgaccattaaaagtgatttttatcccaatagaaagtatattggcccggcgcagtgtctcatgcctgtattcccagccctttgggaggccaagactggcggatcacgaggtcaggagttcaagacagcctggcaaacatgttgaaaccccgtctctactaacaatacaaaaattagctgggcgtgatggcacacgcctaataaacccagctactcgggaggctgaggcaggagaattgcttgaacctgggaggcagaggttacagtaagctgagatcacactgttgtactccagcctgggcaacaagagtgaaactctgtctcacaaagaaaaaagtatatcaagacaccagtctttagcttgatatttctgcttttctatttttaaaatccttttgtgaaatatataaaaatgcaaaattgtgagagttaacaattcttctgtagctatcaaattgtcattcctgtctgaatacagtctgctttgggagaaaaacatagatctgctttaagacatatatattaattaagtttcctttgattctacagtttggggattctcagcagttgcggctggtccgtattctgcgcagcaccgtgatggttcgcgttggtggaggatggatggccttggatgaatttttagtgaaaaatgatccctgccgaggtaaggaaccattctaagcatgaattacgtgttaggtatgcccccagcagtgatcttttatgcttacaggaagcattgatggtggggtctgtctgttttttattttgttaagctgcccaggtgtcatcccactagcacagattagaactcaggggtgccagcataggccagggagaaaaagctgaagaggttgatgctatttggggaggtaggtctagaggaatgcagtaatgagaattaagagtgtattggtgttactcgaatgtttgtttggggtattaaattaacactatcctagaaaggagcccagtgaagccctttaggttccctcttagtgcctcagatccctttgcctgtaattcctgtggctgatactcagggagagtgttaggcccttctcatacagggaagaactggtgagccccctggaccaggaggaaggataaagacacctacatgtgagcccattcacttctaagacaggtggccacctaagcaagaccatggggtgtctttctgctaaatgtgaaaaggctggcccaccagcccagaagcataaggagactgtcaatttaatatgagcatgagtggtggcatctgcagctagggggtgtgtggggactgcaacagggaagagatgaccggttccaattgctaaatcctcttcagctatgtccttgcctttttcctgttagcagagctgcatgtgggtgcacaggaggctcccccactgtctgccaatttgtctttcttgactagtttctgcgtttcctgccctgtctgtttctttctgtttacgtattttttattctagttcaccatcctgggagtaaaataaagcgctctgattccagctcttcgatttccagtcagtctcccataggttggcttttaagctttgtccctcttcctcacaccctagcccattgagaatggctttgcttcttaaactgtaacatctcttggttctgtgtatctgctgcattcatgaatgcttgaaatggccaaaccatagcttttctaactactcaagttgatggtgcataaaatactgttgagacagtgtccatggaatttgttttgagtttctatttaacaaatacttatatagttttatgtgccacacactattacaagtactttacaagtaacacatttatgcctcatatgaagtgtagatgctcttatctctgttttacagaataggaaattgaggcatagaaaacgtaaataatttgcccaaagacaaacaactagtaaatggcagagatgagattcaaattcagggcaatctgggtctggagtatgtgcccctagtcagcatgttatatctttcagaggctgacacacctttgtgtatgtttattattggatcacctgcataattattaaggtttatttataaacctagcagaaatgtttgctgtacagtacataacttctttggaaatgatttatagtcatattctgaagcatttagtgaggacagagctaaagatagcagttttcacatgaattcagatatgcccctaagtagttcctcttattttaactcattctgtgtttactacagtaaaccagagtaaaaattcagcagtaataattttcattagaggttccttttttaaaaaaattggggccaggtacagtggaatcccagtacattgggagcccaaggcaggaggattgttgaagctcagaagttcaagaccatctttagcaacatagtgaaaccccatctccacaaaaaaaaatttaaaaattagctaagcatggtggtacacacctgtgtagtcctaactactctggaggctgaggtgggagtattgcttgagcccaggagttcaaagctacagtgagccatgatcatgccactgcactccagcctgggcaacaaggcaagactcttgtctacaaaaaagtaattttgaaaacacttaaaaacttgaaagtatttagttttagaatttaaaagctgtcttttattgctttaatgagaaacaatatatgccattttaactttaactcagtaaaacaactttattcctttccaaatctatgaataaggtcctatttttcctgtcatgtatgatcagactaaataaaagagatattgcatgtggcattttggaatccttgattgcctgtttatttgctgcctgctctatttatgataacatcatgctgctggccaaggagaacactgcttgctttgtccttatcttagtatctaaaatttggaaccccaaggaaattggggagggccatctagaagctattttctatgaaagctagtaaccttttttagcatcccttggaacaagcaaggtaagactttcctgtgtctctccaggagtgctctcctggaactcagtaatcatctcaatccattgactgtggagagaactctccagaagttttaaatttcgtaactctgtcagtgatgggcaggatgagctatttttaatcaaataaaaaatggtgctaggcgatgaacacctaaggactaggatggattataataagttagaagggtatgaaggatgagaagagaacaaagttacttgaaactatattggaagttctataaggattaatgtggcttctggaaacagtgcttatggtaggttttgtactcatttatgttgcatatttccttgggtctctggaatgtagagaatgctatactgaggacagtacaagatgtgtgacaaggttcttaacaccagtgtgcactatcatttcttacctccttttacacagctattttaaaaggtagaagatatctcaaactgcatgtagcttttagtcatgtgtaaaaaaatgaaaatattttactagctagatttgccagtctcctggtactgccaaaatcagatatttcagtttctgaatgtatccgtggcacaggaaatcatgatgttttggatagagagaaaaaaagtgctcctgcctaaataatgggtatacttgtacctaaggtactgtgtatgtttttgatcattagacatattagctcccccagataagtgaacatctaggaaatttcatttatgaagatttaaaagacacattttgaaatagaactcattttttttttcagattgttatacagataaaatttaccatcctaaccatttttaagtacaggactaagtatatttgtgtcatactaccgtcaccaccgtccatccacagaactctcttcatcttgtaaaactgaaactctatacccattaaacaatagcttagaactgaattttaacatgcccgcatcagccagtttcaggtggccagcataactcccttagcaaagacagcctctttggtggtcaatgaactgaacttgaggtggctgccgtcatgtctggttctgtaggttcaatggtagatcttttctccagtgaaaagaatggtgagggggaaaatcctatcacagtagtcaaccaagtactaggaatcttctcttttttttaactttaggactataatacccaattttgggaaatatttgaatcaatgtaaatattaagagtacctttactactaaattcaagtgctagtacataaattttgcttaatcagaatttggtgtttccttctagttcgagaaaaatgtttactttttacttgtgggattgctccagaaatcaattttcacagcttccaactgtttattgtttgttgtcgcctcctcccatcccagccttttctattatcaaagtaaaagtattaattgcccccttaacaccttttttaattcttaaaattggccgctttaagtttatttctgaagaaagagctttcatttcttccaagtgatatgtatataaaatgttccttaccaagaatcgtttcattgccttgcatcttcaaatattttcttttaaaatgcaaatatccatgggagttgtagcatattaagctaatattagctaggcatggcttgggataaattaattattcattggtctcttgaccgagatgagagcaccagaaatgtgggaattttactattgtgagcttaagagcataaggaccaagaagatggaaattacagagagaggaaggaaaataaaagggagaagacaagcctctaaagccccaattaaagtaagccattatttttcacttgagtttagaccttcttaatgaggcctcatggaagcgtgcaggagctagctaaccactgtttacagtctcagattgccttaatgcctatgttgcgtgtctttggcatggctgtagtaacctggaaggatgacgttagagaattgttcacacgtctttgcatctctggccagtgaaatactatcccaagaggtgaccattggctggagatttccttatgaaaacagagactgtctcattatgtttatttgtttcgttatgacgtgtaagcgtaccctgagaaaattatgaactgtattttcccagcatcctgcatgcacccagctaggaaagcaagtgagacaccctttgggccctcagcagtcatttaatgaggcgttacaatgtacctacctcatggtggcctctggggctaacagggtcatgatataggagatcagcataggatcctgtgatagaattaaacaggtcctcagatcacaaaatgcaaaggttgctgttaacatgggataatcttccttcttgtagtatctttcttatggaaagctattctatctgctcttttaaattgctttaatattctatatatagtaggtgttggcagtcacaaatttaactttgtggtttcagtcatgaaaattcatggatttgcatttgtttctgctgtgcaagagagccggtcacacagcgagagagtgagccccactggccactgactcctcactttaacacagcttggtgcttctgttcttcatccccgtgaaataatgagcacttctcaatggaagcacttagtgagttcatgaaggttgcgagatccattccttgaaactgttgagagacttgttttcagaggctatttcagagaaacagaggctactctgtttcacacatacttactgaaaccctaaatgcaagcctcgcactgggatccaaaggtaaattaagatgatggtccctgcctgcagaagctctcagcctagtgcagggaacaaacatgtgaatacatgcccttctatttggtaaaatgaatggttgagagagcaagaggggaagagatgactctgcccatgaagatggagaaggtatcaggaaaaggacataattgggctgggcatagtggctcacgtgtacaatcccaacactttgggaggcctagtagggaagatcacttcaggccaagaatttaagaccagcctgggcaacatagcaagaccccatctctgttttaaaataaaatacaggccgggtgcagcagctcatgcctgtaatcccagcactttgggaggccgaggcgggcagatcatgaggtcaggagttcaagaccagccgggccaatatggtgaaacgctgtttctactgaaaatataaaaaaattagccgggcatggtggcatgaccctgttgtcccagctactcgagaggctgaggcaggagaatcgcttgaacccaggaggcagaggttgcagtgagccgagactatgccactgcactccgtcctaggcaatagagggagactctgtcgcaaaaaataataataaataaatatatggccaggcacagtggctcacacctgtaatcctagcactctgggaggctgagccgggcggatcacccgaggtcaggagttcaagaccagcctggcccacatggtgaaaccctgtctctactaaaaatacaaaaattaacggcctggtggtgtacacatgtaaccccagctactcgagagactgaggcagcagaatcacttgaaccggggaagcggaggttgtggtgagctgagattgtgccactgcactccagcctgggcaacagaacaagactccatctcaaaaaataactaaataaaaataaatgtttgtgtgtgtgtataagtgtatgtgtgtatatactgcgctccagcctcagcgacagagtgagactgtatctcaagaaaaaaggttttgaaaaaggaaaaggaggtgttgcttcagccacatcttaaaggaggtaacacttgaccagaaggaaaagggatctggatgttcttggtacagaaaccacaagttcatatgaacagaagtgtcaacagctgaaaaagtaaggggacaagtagtcccatgggactgcagccaaatgtacaaggttagcgaccagataagactctggacgggtcagcaggaggggccaggtgatggatgccagaccactgggtcctgggtacttaccacattgtgcttcctagtccccaagatgtggtcctcaaaaaaacgaaaagtcacggtcaaatgaatttgggagatgccaagttaaagctctcccaagcagggaaatatagaggaccaaaccccttttgtaggaaaaccctagaaaacctcacttggggaattctgctataagcagtgaaacaccatggaaggattctgagctgttgacaacagattttcatttagaaattcattctgcaaaatacaaaaattagccaggcaaggtggtacatgcctgtagtcccagctacttgggaggctgaagtcaggggatcacttgagcctgggaggtcaaggctacagtgagccatgtttgtgtcactgcactccagcctgggtgacaaagtgagaccctgtctcaaaaaaaaaaaaaaaaatgcattctgcagaatgagaaaatgagtgagggctgggtgggtggtgagatgagaaacaaggagaccagtaggaaggctgctacagttacccagtggggaggaggtgctccatgaaacacctgagtacaagggggcatgcacaggctcagggattcaagaggcatttgaaggtagaatcaatagactgaactgcccttgggagggagagacctacgttggtgccagggttttggttcctgactctggtcatgcctaatcagttgctggatataacttctggcatccagcaggaaggcctgccctactaatatatttggagttgggtgtgactataatggtagcactgaagcctcagtggatgagctcatcaccaggtcaagtctaaggggagaacaggactgtggacagacccagcagacatccatgttttagaagtgggcagggaggagtggtcagcaagggagcaggcgtccttgaagccaggggaggacagggtttcaaaaacaagagagcagtgtgtagtaaccctccacatgcaagttacaacagcagagagatgtttttacctaacaaattgtcagacttttttcctgtatgtactcatgctcatagcacaataattggccagaatgaagtaaatttaatatactcatattattttggagagtgtatgctagtaaaacattttggaatcagctggcatctatcaaccttgacacatggttgacattcatcagttgatgtttttaccttaggtatgcatcctttctccccagaaaatctacatgtagatatttatcctaggctgggcgcggtggctcatgcctgtaatcccagcactttgggaggccgaggcgggcagatcacgaggtcaggagatggagaccatcctggctaacatggtgaaaccccatctctactaaaaatacgaaaaattagccaagcgtggtggccacgcgcctgcagtcccagctacccaggaggctgaggcagaagaatcacttgaacccaggaggcggaggttacagtgagccaagattgggccactgcactccagcctgggcaacagaacaagactctgtctcaaaaaaaaaaaagaaagaaagaaatttatcctaaggaaatatcgtggatacatgcaaaatgttttacaaattgtcacagcattggctacaatgtttaaaatatttaaacaaaaatgcaatattggactggttaaataaattcacatccatatgatgaaataatacttagcagctagttaaaattttgcatgagacatgtagggcatggagtaaagtttctgatttttttaatatatacaagctgggcatggtggatcacgcctgtaatcctagcactttgggaggctgaggcgggtggatcacctggggtcaggtcagtgtttttgaaacactgtcctccccggcttcaaggacgcctgctcccttgctgaccacttctccctgcccacttctaaaacatggatgtctgctgggcctgtccacagtcccgttctccctcttagatatatatacacacacatatatacacttagtgtatatatatatatatatatatatatatatatatatatatatatatacacacacacacatatatacacttagtgtatatatatatatatatacacacacacacacacacagatgtgcaaaggagtaagacacaccattataatagtgatgtcccttgggttgtgagattaagcgacttttgttgttgttttggtttttgagacagcgtcttaatttctcacccaggttagagtgcagtggtgtgatgacagctcactgcagccttgacttcccaggctcaagcaatcctcccacctcagcctccagagtagctggatctgcaggcacatgccaccatgcctagctaattttttaattttttgcagagatggagtttcatcatgttgtccaggctggtctccaacctgggctcgagcagtctgccctcctcagcctcccaaagtgctgggattacaggcatgagacaccacacccagccattaagcaattttcattgccctcctgagatagaggttgtcagtgacctttgccagagcaatttccatgagtggtggggatggaagcgtgagtggtctgaggggaggagtggagacagcgaatgtaggtggtgatggagagagctaggctgggaatgtcttgggggtcgggggacaaagaggacaactcaagtggaagacgtgggttctaggtccacctctactgccactttgcttgacctcagcctctgtgagtacttaagtgtctctgtaacatagggatgctaattacagtcagctgcattattgcacattctgtgaactgtgcagtgcatagggaacatatcaccattatggcattagagaatgcccttcctaaaacatttaaaatgtcacttccttcaactgcaatgcaatttcaaagttttcctcttatatcttttttttttttttcctggcagagtttgctcagaagtgaatttttttttttttttttttttgagatggggtctcactctgtcacccaggctggagtgcagtggcacgatctcggctcactgcagcctccgcctcctgggttcaagtgattctcctgcctcagcctcctgagtagctgggactacaggcatgcaccaacatgcccagctaaattttttatttttagtagagacggggttttgccatgttggccaagctggtcttgaactcctggcctcaggtgatctacctgccttggcctcccaaagtgctgggattacagacatgagccacttcgcccggccaagggtcatgtattgttgaggcttgaggaggaaggaaacactggatcatggaaggaaacagcttagcatttcagggaccattaagtcatagatcatccagacaacagggctcttagagatcggttgacctgatcgcctctggtgagcctgaggaaactgaggccagagcaggaaaaaaatcacagttggcagcagagcttggactataactcagaggttttggtatccaagtgagtgcttttaacctgatactttgatatgttctgtcaacatataatatattgagaagaatttggatttgatttaggaatttggaaccatgctgcttggacacttatgcaacctgatttaaaacactgattctaccaaaattcctcaaattccttaagggacatatggggtagcacagatgagaaggtggacaaaatttcctgccaccttctagatttatggtttctgaccagttaaacatctgttatagaaaagaatgacaaatattttgttcataatgattcccttttctccagcagtcccatttgtttagctgtgtctagtacttcataaagagtgcacagtttagggtggatgaggaggtagagggtttctgcaggattacatcttacagtgagaaataatctaagaacatattccagagggattatgtcttttaaattagtagcatctttcgcatttaacatttttgttggctgtgcgtgagatcttcctatggaatccacattttaagttctgggtgtgcagccccagaaagccataagacagcgctaactggcttcccgtgccgactccacgttctttgcatcttgatgttcctcctacttgcagttactcctttggccttttattgctttcagtttttcacttaacagtttctcactagcaagttttgtgcatggtcttgatctctttctctctccccaccgacatgtttacttcttaatgattctctcctgatctttttactgtcctgagttcctggactcctttctttaggattgttactgactgaattcaaatagaagagtctagacaatatcgatttcagtaatgtttttctctactctttcattaccacatatcctgcaaaaattaagcaaaaagtacacatgtactaagagagagaaaagaggggttttgatttaacttcagaggtttacgaactgttgcatctgctttacctcaagcagtcagtgtgcttaccccagggacagtggcaaagcaagacgctagcagcagagtgggctggtcctttatacacagagacttgcttattatacagttaacatatctgctatgggtaggaaccttgacaaggctgatgtgtcatgaatttatctctatttttgaagaacccacagatggtactaaacccatataacttatataactgttatcatggggtcaagccgctgtataaccgtcaaaaatatattttttagaagaactgacattgtgtgtgtgtttatttcctttttagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggtatgtactgatctccattatgcccttcttccccaatcccaccctcacagatgttcattgttcacggtagcctctgaaagactccagtgaggagaagaaataaaaatgaaaacatgttttctattttagaaataaaacgtgaaaacacacagatcaagactgccctgttcctagcagtacacagatatatggcctttaagatgactccaaaggacatttattaaaatatgcactcagcctggttatgtcagaaatgtttatttcctcatgttctcagtttaagtttgagcccatccagtgttactacttttgaaaatccaggctggacacagtggctcatgcctgtaatcccagcctttgggaagctgtggtgggaggatcccttgagaccagaagttgaagaccagcgtgggcaacatagcaagaccatctctacaaatttctaaatttatcatctctaatttttaaatttagcctagcatggtggtgagcacctatagtcccagctactcaggaagctgaggcaagaggattgcttgagcccaggaatacaaggctgcagtaagctatgaactgcaccactgcactccagcctgggcaacagagtgagactctgtctctaaaaaataaaaattaaaaaaaaaaaaaataaggaaaaaggacagaaaatccaggcactggctgtgcagtggagctaacagctaagtttgatgttatgatgggttatgtgtgaatgatgttagtgcctgcctggtccttctcatcctgatggaccaacatgcattttattttgttttctgtttctttaaaatttagtatcttctatttatttttttctgttcccaatgtgcaccctttttgttcctttttcaattgttcctgtccttccctttggatttccgtttcacagacttcacttcagttctctcgctgttatgacaaaccctggttggtaaacagtaaagctggcacccctatcagggacagccattctcctgacctccagctgcccacccccgaggtagagtatggctttgctgactgaggacacagtcaagacgaggccctcgctactggacttgaccagctcttcttcctgacacgaatccctgcactctttcatctctgtggtgcttgctgtcacagctgattcatctagtccagtgttttcaggggtttctaactcggattcaccaaaattggagagaaataagagatgcctgaaactagattaataactttataacaatcttgagaatgatatttgctgagaatggtaaatgatggtcattgctgtagatttgtttattgatgtcatttataatcaggcctcttggaatctccaaatgtcagatactcagacgagttatgaacacttgaaattcaactatggcgcatgttctacaatgttctgtctttgcttagaacagaagagtggttggcgccacctgccctgagacacatgtccagggtggttggtattgccacaccacactggtccgaggcgtgggtgctgtctccttcagccaagcacagcaccagtgaacactgacctgaggctcacattctagcttctgaatttcttggcctaggcacttgagtttctgtagccttgatttgaatacacatgccagcaattaagcatgttcaagtgcagccattaaagtgcctgaacgcttttggaagagcagtgttttagaaataaaacatggactagtggcttgtctgatagtagtgcagtttgcattccagctcctaccaagaaacattggattcttgtgcctcaagacagtgttgccttcagtcttggaaagccttagccagggaaacaagggatgcacaagaagtcaatggctatgaatgagctgctgttttgaggttcatttcacttcaagctaaaactccagttcagaaatatatctggtttagaatatgatctggggacctactgccactaaactactagactcaccctgcttatcttgcttttcttctttccttaatggctccagtttcataaaaatctcagttctattttaaattttagatgtttaatgatgtacaaattctcatacagttctgataaatcagggcttttgttctgtcttaaggttttattttctgtttcatttcattttgaggcttcatctttccttacttattggtgttctgtagccaggccatctcctgacttggaattctagcccgggttctagctgtggtcttccagcagcagtgcgcaggaaccttagcttctgaaactggtgttcttcctcctatgtggccaggaaattttgtgcttgagtgttaatcactttctatcgcttatgctttttctttataaatttaagaagtacagcaaacaatgagatggattgcttttctcttctgtttgcataaacgtcttaaaggtcctggaaaacaatttacataattgatttcaaagaaaaattagaatggcatgctgtagcatgtggcataagtaatgttttgggggtttttttgtttgtttgtttgtttgttttttcattttttaaaaagcaaagtagagacaaggtcaaataatggatgtttaaaacatttaaggatcagcctggtcaacatggcaaaaccccatctctactaaaaatacagaattagctgggtgtggtggcaggcgcctgttgtcccagctacatgggaggctgaggcaggagatcacttgaacctgggaggcagaggttgcagtgagccaagattgtgccactgcactccagcctgggcaacagagtgagactgcctcaaaaaaaaaaaaaaaaaaaaaaaaccccacacagatttaaggctggacatggtggctcacccctgtaatcccaacactttgtgaggccgaggtgggcagatcacttgagcccaggagttcaagaccagcctgggcaacatggagaaaccctgtctctacaaaaaatacaaaaataagccagccactagggaggctgaggtgggaggattgcttgagcctgggaggtcgaggctgcaatgagccatgaagtatgccactgtgctccagtctgggtgatggagcaagactctgtctcaaaaaaaaaaaaaaaaaaaaaaaaaacacccacacatttaaaatactctttttcctccagttaagcctactatctaaaaaaccaaaaaaaatcactcaaataggaaacatagcacctattggtagcagtgataataatatgtagctcttttccagtttgggaaatgcttctattcatcatttattcatgcaagtttttattgagttcctcttctgtgctgtgcagaacacaggaagcaggggagagaatagaagtgtacaagcagtgttctgagtagtgagacaagacctctctactaaggtcatcctttcaatagagcccctgcagggaatgagggggtgagccacacgtgtatctggggtaggcttggggtgtggtgattgtgcaacaacagtccaggcaaaatgaacagcaaggggacaagactggtggaccctcactgggccattggtggaacagcaaggaagctagtgtggctgggatggactgatgaggagtgtggtagaaatgaagtcaaagaggcaggatttaatccctgatttcccaagagagaagcaaagacacaggtgttaatttcaatcagtcctggaacccagactcaaacccaggtctcctggttcttcatgcacagacttgttcctgatgtctcagtcccacagtcgtgtgcttctcatagtttatttgatccacaagttaagtaattttatctgcattttaccagtaaggataatgactaaaagatcttactaaagttactgcacctacttagtgttaagagattggggccaggtgcggtggctcacacctgtaatcctagcactttgggaggctgaggtgggcagatcacaaggtcaggagatcgagaccatcctggctaacacggtgaaaccccgtctccactaaaaaatacaaaaaaattagctggacgtggtggcgggtgcctgtagtcccagctacttcggaggctgaggcaggagaatggtgtgaacccaggaggcagagcttgcggtgatccgagattgcaccactgcactccagcctgggtgacagagcgagactccgtctcaaaaaaataaaataaaaaaagattggagtaatacttgaatctccatatcaaataggtgggctaaaactcatttcaaatttttaaccccaaaatcttgatacctagtattatttgaatttctttttcctttactcattcaccataattgtttgttgtaactattgtattcttactgaggattttttttttttcatttctaggggaaattagtaaaacaaaaggtatttgaagacattttgaaatttttatttggaacataaaactttgattttgggaattatcaaaatatatgacctaggatactttaagagaaatctttgttttcctggacttttaatttgcttttcaactaagcaaatataaggaggtgtaaggagaccttttaaagttgaatttctggcaaagattttaccaagtaaaatgtgacctttttattattttttttaaggttatcccatcatcaggtagcaagttgaaacgaccaacaccaacttttcattctagtcggacatcccttgctggtgataccagcaatagttcttccccggcctccacaggtgccaaaactaatcgggcaggtaagtacctgccccgtgacctacaagccaggctgagaatttggaaacaacagcctatgtggaatgtttcactgctcccaaggagcgggtaatgagagtggcacttagtgtgatgcccagaaagacagacctgcagatgctcaagtgacctttactttttctgtcattacagctagctttaagctttccttctgagatgagatgcttccacagccaaagctgggccatgcgttctcatcagaaatgatcacatttgagagaatgtaaaaggaaatgtgggtcttcctcagacaccagtccagtgttgggatgagcagcttgctagtaatttttccaacacgtcatacttactatggctgctgttgaaccaagaaaggcaggggaagatcacatctgttctcctgctactgttcctcatgggaacctaggaatcttccttcatttcctggctggctgcttcccctcattttgcctctatccatcctgcccatggattagcccggctggcaggctcacccacctgtgctgaggtggttgagcaaccttgcttgcctccactttggggccatggaaggtgacagtgctgctgatagagtggctttctaatccccaggaggcagcttctcaagtagaatcacaaagccagaaaaggcttcagcaacttctgtatggatgaggaaactggggtgcagaaaggctgtgagatttgcttaagatcacacaggatcagaaccctagcttctgctcacttgttcttccaccccatgccatctctattaagtctgctgttttattcttgaattccagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagctt

SEQ ID NO: 37014 - DNA, 104955 bp, Homo sapiens
cgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaaggttagcagccgcccccgcccgctgcagcccccagcccccagcccccagccccgacccgctctgcctgccgggctctcggctccgggctctgaaccggttccgggcgcgcacgggagggggcgggggcggtgcggccgttgcgaggtggggtgttgggttacaggcgcctggcggaagcgggagcgcccctgccccggagcccgggaacgccgggccggagcgcggggaggtggcgccgctggcgggcaggtctccttgggggtccgtggtccaggccaccctgcggctgttgcaaccatccccgcgtgggctgtgctcgggggcggtggtcttcaggctggggctgagaccccggctcggggctgcttgctccggatcgattttcccttttcttccgcccctggccacctctccatatggcgtgcggtggcagcgccgcttcctgggccgccctgggttcaacctgagcggcgggcctcccgggaccctgctgccccttaggcggaggggagagcgccggagagatcggcggccgcctccggatctgcctggagaaggaccagctggagtgcggctggggacgagaaaactggggggcgtacgcgggctcccccgcgggccctgtgggggcggggtcaggacagcagaccgttttattgcttaactcagtgggttggaagctgtaaccccgacatgggcttgcgctacgtcctgcccctccgacccccgggaaaggtgggcagctcggttcgagttgaggggctgcagaacgagggtcagtcttaggggatatttggggccagtcactggggatccctacttagccacggagctgcatcccaggcaggcgcggtgtgccgggtgcgcgccccgccacgggagctgggctcggagctggcgatgggacccgggcacagtggccagtggcaggaagaggtcagaaaccactcgtggtggtggggggagggcgcctcaaccctaccgctgcttcctgcctgcgcggtgagcctgtgcccccaggcggccacgtaccctgaatacccctttccctccccctcctcccggctgcccacttccatccggtccctccccgtttcataccctccccacccccaggctgatctgggaatggggttttgggtgggggggggacaggatggcgcgtccctttggatagtgcggttagggctgggcttgagggagaacgctcatgtccaaaaatggtaacattcattcccttttttaaacttaaaaggggggtagtttatagagccgactgaagttttttttttcagccaaaggcatcctgtattagctcactcaggaatcctaggccctgaaacggagcccttttactcacttcatcagacaggcagaggtaatctaaaacacacacaatgggcttcctcaaagcaggatgacctgggccgcggtgcccaaggcctatgcagggctgggccctatacagcgacatcggtcatctacatcggacatgggaaggtcccctgacttcgaactgacttctttgtaatgtgccagttgcttaaactccccctcttcctgtcatcttcctagtaagagctgaagactgggggctgcagacagtcccccactcacttggcttatttcctgggaccatgggtgctgtgggtggaactgaaaagtgagtgagtaatttggagatccctatggggcaccaggcagaaggctctttaataatttcagggtgaagccttcttgagaatggattttaaattagaagtgagattagggtggtggattggggtcttccctgggggttagaatcgaaggagaaatccctgcttagggagcacctgctttgtgcctgggaggggcaggagtaacagagctgcctaggaactaggcccctgaaaggactgtgagaccaagttcctaggggacagacactgagcaccggcctgaacatcgtatttaatatttctgaatgaatgaatatattaaacgcagtggggagaagaatatagattcccagggctctgacctgggtggcagtgggtgtgccccaggcctttgggcagccaggtaggaagaggtggtctgggaaactgggttatcctggaggcaaactcaacagtgccaagaactggcatttgctgatatgtgccaggcacgaacaaggactaggaaaccagggccagagaggggaagtaaccagctccaagtccagactgtgtttggtggggctgggatgcagccatgtttgggactggcagcttcccctcacttgtccctccttggcaagggaggcaggaaagctgggcctcgcagccagagccagagcatctgggaaccaggagagccgacacgtgctttgggcggggttgatggaggggccatggcagaaggagctctgggcctgactctgaagattcagatccacattttttgtttgtttgtttcctgttaattctctagattatctttcgtgggcctcagtctgcagaatttctggcctgcctagttctcagtagggtgatattaaggaggtggtattacaggtgagggataagacgtaaggtaaacgtgttgcttttgacactctttctactgactgggaggcggggtttgtgtgggaccagagtccacaagtggacagaggctgatggttccagagggaggcaggggagtgagtgtgaggaggggaagaggaggacacagtgtagagggatacaaaggtcacccggtagaaggcagaagaccctctttttagctttggtgcagccatagctatttctgagactttgggcaagtctttccatttcatcgagcttttattaggtcattcagcaaatactttgtgagcactcattctgggtcagacacagttccaggtattagggatggggcactgagcaagacagaccaagttcccgttcttgtggcatttccattaggtttcctcctctgtaaatgggacacatttctgcccgtggagccctcaggactcttctggggaatcaggttaaatgatgcattgagaagtgcttccttggtgaaagtatggcctgatgtggaggcagggagaagtctgtgcaggcaggaggcatgactcaagaagctgcactggcttggccgaggcttgtccctctttcaaagaatgcttcggtacggagttcatgggctggtcgccatgcctccagacacaaaatgcagttatcttccagacagagcacgtggattagaggcatttcctctacttttccaggtttcataaccttcctgatctttgaggctgggctctgaagtcacttttcctaggagttgctgttattttcagggtgactgcagcccccagttttctcccttatgtaatttcgctcacattcttaggtgtatgtgtgtacccagtcaagctggaggtaggtcaagctggagagagcatcagcttggtgtaggatcctggctctattattttcaggcttgtgaccttgggcaagttcctctctgagtctccaattccctacttataaaaaagagctaatacctaccttgctggcttgatgcgagcagatatgtaaaatggcagcttctgctgttaaattttattttctctcttccttctgaagtcctagagattatggtttaatgtgtgtttccacaggtgccagcctgtggccttttacatgtaggaacttaatcaatacttgttgagcgaatggatgttgaaacagagaggcagcgttggcaagtgcatagaggtggttgtgaataaggcccacatcccgattctgcagacaggtgaggctaggtcacaggaagaggggacacattgtttgcacttccttctggacagcaaggccattgcaggagctatagccaaggccaccagtcaaggtggaggactacagagagaggaaaatctgcaggctgtgtcggacttggacaccccttttcatcttctcgaggaaggcatggggctgggcacctggctgggggccataaaccatcagtctggctcaaagacttgtcacacaagacctgggggcctggagccagggtggggcagctggagcctgagatgtggcctagtcacagatgtgctatgtcgggtctctaggaaagagcccagcccttaacagggtgagaatgtagacagttccttctcatgaaggcaatcagtagatgttcattaaacccctgttaggtatcagatgctctgcttgctgtgtagagtgtggaaatgaaggtttaggtagagagggaaccagaaagatgcagagttgcaacaggctctgccaataatggccattggcaggagctggtggaattggaggtgcatctcaaaggaaggcggttctgctgggagccttacctttccctggcatttcagccacgtgtgtgtgtgtgtgtgtgtgtgatgttgtaggacagaggtggggagaggggagatgcctgaaagggcagagcagagcaacagtgactatccatgctggggagcaccccctcccattctcccttatcattcttctattatagtttaaaatttttaaatttatgttttatagagatgggggttttgctatgttgcccaggctcttggcctcaagtgatcctcctgccccagcctcccaaagtgctgggattacaggcatgagccactatgcctagcttcattgttcttttccatttgttttgcccctcccagagctgacctctcacctttctgcgagagacggccaggccatctggacaggtcacagaccagattctcaagtccacacctctctacagatattgttgggatcatcccagccagttaaccccacctgagctgcctccatgtgtaacccacctgtggttttcctggacttggtatggagccaaagggtaccttccccactggccctgcttttatgccctctttagagtgcatagagagatgttggtaggcccatgtctctgctagaggggcctgtgggttgggctgagttactcgccatggacagtggtggggtcctggaacccaccagctgagatggtttgggcggttctagtctgcacctccccagagaggtcatggcagagaggccaggcacagaggaaacccgctgagcctgcttccttagttctggcagatgggtcagcccccacaggactcaggattcaatttagcccggggttctggctccatctcccacagtgccggtgccagtggcctcctaagtactgtttggccaaacctggctctgactgagacaaggagccttaggagtagtagggacaggagacacagcaaactagggctcagagccaccctggaaccccttcttcctccctcttcatgcatgaccaaggtttctgtatttgtccattctcatgcttctaataaagacatacccaagactgggtaatttatgaagcaaagaagtttaattgactcacagttcagcatggaggcctcaggaaacttaaaatcatggcggaaggggaagcaaacatgtccttcttcacatggctgcaggatggagaagtgcagagcgaaggtggggaaaagccccatataaaaccattgtatcttgtgagaactcactctcacgagaacagcatgtgggtaaccacccccatgattcaattacctcccaccgggtccctcccacgacatgtggggattatgggaactacaattcaagatgacgtttgggtggggacacagccaaaccctatcagtttcccacctatccccaggctgggcatcaagtccaggctcccaggaatccttctcttctcagcagatggggggaaacgcatggagagggttgcccaggctcccccttctctgcctctcctgctttccctcctttcatgtcgtaccagggggttatctggcgggcaagtctggttatctgggcatggtgagtctggtctagtgatgggcaggccccaaagctgtgtgtggcaacgttcatgaccccaactggccccttccgcatgcaccattctgccataaagttaacaagattccttttctcataataattatagtggctcgccctttttgagcacatggtaattatcagcaattgtcctaaggactctacatgcatgagcacatctaaccctgtgagatgggtcctcctgttatcccattttgcagatgagagagctggctcggagcagctgcggaactcctccaggcccacgcagccagcaaatggtggagctgggatctgaagccaggcagtcgggctccagcatttgcactccttctcaactttgctctgccgcttatacaacaaatgcttgcgtgggtagaacatttaacccaagacaaacatatacaaacaaaaccccggtgatggaaatgttctggaattggatagtagtggtggtttcacaacctcacaaatatacgtgaaaccactagattgtacattttaaaatggtgactttatggcatggaattttatctcaatttttaaaaacctaagaaattattaactaatataaagaagaaaatgacaattgcctgtcatcccacctcccagaggtaaacaagcattcacaggatttctgatggcttctgccatccttgtccctcttcccctgtttgtgtgtccccttctctgtcatgcccactttttagagctggggtccaggtttatgatgagtgagaggagtttagaagaggaagataagggcgggagcttttgtagaaagcgggatgaaggatgtggctctttccttggaaactgaccaggaatagatcatagatatgcacaggcaaacagaagactgggtgggttggggagagggtggccttcattttccaagtctcagtccttggggaaaatttctccctaacctctgtctataaaccctcttggcctgggattgcttctctccgtgtgctctccccagggttggcagggtgggagtccaagtgaggcagctttccttagggttgtaggcaggggaaggggagggcagggccagggtgccccccaaaggaggcagctgtaccactcttggaggttgcctagcaatcgtggggaaaggtgacctagcccactacagaagcgggaggagaataaaaggcagccaaagatggaaatcgggcgtacattgcagaggaggctgttcccctggaaactgcctccttggtccttggctacagcaggctacttctggggtggggatctgttctccattaagagggagtggggtcttccctaggcctgccacccacaggtcagggctgggggacctagggaaacccttcttgcacatggagtgtatgtcagatgcgtttgtcagtggcttcatttaacgttgacaacagccttgtaagatatgtgggatgatgacacttcatagatgaagatcctgagtttagagatagagaacaacatgttcacagccgcacagcgagagaggcctggaaatgaaggtgctggcacccttgactcttaaagggagccattcattttgcttcaaagcatttcacaagcccaaggtactcggaggtaaatgtaaacactgtccacctcctgggaagggaacagaagatgagagagggaaggctggaaaggtgtgttacctgttttatatcaaccatccaaccaaccaaccaaccagtacttattaactatgtcttggttttccaagtaagtacaaagacgaatagttcacactgattaaatgctgaatggtttggagtacctccacatgtcaaacaactctttggggaagggactgttagttttcttggtacagacagggaaatggaagcccagagaggttaagaaacttgaccaagattaggcagattgacctcagaactcggcttttaaccagaagtacagacacactctttgctattaaggagtttatgtttgaattgggaggcaaggcttatatggaattgaaataagagaacaactcattgtggcgcatttttaacatttgtgcttccatgtgtggctttctcttcagtaatcatggtgagcaaacttgtgaggtcttatccccattttacatgcagggaaagtaaggctcagaaaggttaagcgactttaccaggctttccgtagcctggaagtagagttggttttcaatccaggtctttgacgggagggtctgtgaggtttaaggggatggacataggcctcagtgaaggtacttttcttggttttaaaggtagtgaaggatgcaagttgtatttctctgtgtttttcagttgaagcagtaactgtcaggaatagactcaaatcccctgaacctggaggcctccccagtcccacgttcctggtggcctcttctggtgctgaccccagcttttgggagctagcttcccctgctttaagattcagcagcaccctccccttctctcttgttttggttccttcagtttcacctgttctgtctgtccttccctttgtttagagagtctcttcctttgtggtcaccacgggaaccaaacaggctttgaaccaggcagccgaggctcaggtttattttgattttaaaagcctgtgcacgtgaaacccgtaacgtttgaggttcttgtttaagccttgagacgatttagaaagttgatgagggagtgggggacttaggttggcttttggtgttacagggctggggagtttttgtgccaggtcagagatcagcaccaagtggggggcagtgccatttcctgacccccagctttgaaccttccaggcctaaatcagaggccccaaatgttcagctccaggccaaagagcagtcggctgggggaagggagcctcctctctgttaccttgtttttcctgtttcttggtggtgggtgatcgtggggctgttgaaagcatggtcacaaggcctgtgatttgaggccaggccagggcttgtaggggagcatttttatgggcctgaagatttattttttaaaagccatctgcaaagctgattataattgatgggagtgagacagcatctgagctctattttcaaatcatctgtaggtgaaatgacgggaggggaggcaacttcaaggtgggtgggctccttcaggccggtcccctaatggaacttggctttccaggctggaagaggcaccaagccttgcatgtgggtgggaggggttcttaaaatcagactctatcttttctccttatgtctgatgtggagatgtccaacgcataacagcctgtagtttggggatagagaagtggagcttttaattcttctgagtcaagtctcgacacccccaatatggggtcttggtccaggaaaaagagggcagcctccaccgaggtcctctgtcttaacacttgtgtctgtcgggtctgtgagcaggggtgcctgtctgtcagcgtttggctgcatgtgtctctctggctccaagaagcccctctgttgtttttggccacctccttgaccttggcagaggagtggctcccttttaaactccgcagacatcctccagataatagataatggcgctttccagtcgagttcccgatattttgtaagggcctttctttccaggaacccaaagtgcttttccagacttggccctgggagctgggagatgcaggaggtggcttatgaattgtgttttcctggaggcagggaaatggggccagacccctggtttcctgtccttcatctcggatactggtggctggggctgcatggaggtgtttttgcatgcatgaagtcctgaggcctcttattagaaatctgcatattttcccaactttagctccaaatgaagttttgctttgtagctttctttttctcttcttctttttcctctttctctcttttcttatatttagaggttcattgtgtatagtttctttaaggaatgccacattggggtctcagttatatagtgggcccgtgtgccaccccctcactgagtctgcttggcatgggcaaggaggccacagtagcacccaaaggtgcctggctggggggcctgtacctgatgccttttccccagaagccactggttcggaagcaagctcagcataggcccacattgctggccctgggactgttctgggaatatggagctgagcatccctgcgtcccgctgccctgcccccagcagcagccagccctggtactgtgctttgggccaggcacatgtctaagtgctttgcagctattaatgtaatcctcacaatacccatatggatggcttagtaggaggtaaaggccatttgagggtatttggaaagacctgaaaggttcaggtggttacagcaagtatttctagattttctgaccttgaagccagttcacaaagaccatgttggcttcagatttttattttcaggaaagagtaccttgtagagttgcgaccgcagtgttctccctgatcccgtaaccttccctcaccggagttaaccgctgttccaagtttggtgtttttgttcctatacatttcttgcctatatagctgtctgtatctttgtgcctgttttaaaactttgtgtagatggggtcatacccaatgcatcactctgttcattgctccttttgctcccacatctcctttgccctggagctgtaaaggtagacctgtgggagctctgccatccctgttttgtggctgagactgctgagttccaaagcacttgcccaggtcacacagcaacttgtaggtggcaggtgggactgaacccggcttcctgcctctgcggtggcgttcgtatgttacacctgccaccctgcaccccgccagtgttcaaagacttgctgatgtttgatgagggagggcaggagacgtcagtctcagtatcttactctctttccacccacacgtgtgtgtggcatctggtgtccgtacctatgggtccctggtcccttgcctgctgccctcttttcctgggcttgagattcaggttcctagggacctatgccacgttgccatttttttcacctcccagggtagtagttgtgcttttattacttcttgataaagcaaatgtgtcatgacgaaaaggtgcgtgaatttgggaatgcttctaaatgagtttatattttatggctcagcagcctcttgtgccatttggaagctggctgtgctctgcaagacaagagactgctctggatatgaggcttgggctgcatgtagagttttggaagaggccagatgtggggagccacgatgagccccactccgccaggaccattcctaggcttcaaggacaacaagtggggtcccagttgagtggcctttgtccctgtctgatttccctcctcttgccttcttatcttctggctctcagccactcggccattgccttgcccagttagtacctgggctaggagagtcagaaaggacagatatgtggcagcctgcctgccttcattacactttcttggggcactgttgtgaaactcctctctaaagacatttagaggattctcaggggatgtcactgatctgtaactgatctgaggctccttggatgatcaaaggtggatttgtggagtctcctggggtccccctagtaatggactttcaggagctccctgatgagctcatcccagcaccccaaagagcaggtaagcacgaatcaagcttgcacatactaggtattcaccgagtatccagtgttgatgaacagtggtggtgagggcctttggacaggagtgtggcagctgtagtcctgcaggagacaactgacagatgctgagggcctgggtggtggtagtctgagtcaccaaggaccaccccagagatgaggttgattgctgggaccagggcagaggcccagttggctcctcaggactaagaggtgtgtcctggaatcagaaggaggacaggggccagggaagctggccttgtcattgggatggggtcatagcctaggatgacctcagcccctgccatgctgctcagcgcccctctctgagctggtgcgtccaatggtaggctggttggaactggcacagacctcccagctccctaccagccagcctagctgcgttttttctttggctaacagcccatcagattccaaggtgctggccatactgacatgtccctcttcatcctgccccttcctctctggagggtggggttattgcatttggctgagccctgcttcagaaaatcacagggaatttctggtccttttgtgtgggtttgtggaccttaaaggaagtaaaacctgggtcttggttttccttctccttccagtccctctgctgagggttctctctggagtgttggacgtcagcagcccactgtctttagccacagtatcccgaggggtgtggatctagataactgtggggcctcagcaaagctttcacctgcctcctgctccctttctgttgggactttgggagtggcatttgggagtggggataggtgtgaaaagactgtcttctttgatttattaggccagagagttgtttggcagaaacctatcttgtcccccaggaacaggaagaatggttgtgtgttaggtaccggggcctcaggagacccgaggtcttgtcctagtgctgcctgtggccactttgtgatgctggataagtcacacctgaaaccacctataaaccgagaaattggatggtaggatggtggtggggctctgttctaaaggctgtacttggattatcacatgcagatgatctctggggtctgcggtgatgccaacattctgtgtttctgccctcttggacactcagcagagttaagcacttctttttttaaaaacaaaattagttacttttttattttttgagacagggtctcgctctgtcacccaggctggagtgcagtggcatgatctcagcttactgcagcttctacctcctgggctcaattgagtctcccacctcagtttcccaagtaggtgggcccacaggagtgtgtcgtcatgcccagataattttattttttttgtagggacagggtcttgctgtgttacccaggctggtctcaaactcctgggcttaaacgatctcctgcctcggcctcccaaagtgctgggattacaggcatgaaccaccatactcatccgagtcaggcacttctaaaggtgaccttgcagttgactcctgggctttgtagcctggccctgaagttaactattcggcgaacacagcttctttaggagccctctgtgtcttcagctttgaggagtttgttctcaccctctagggaggatgcaagtggggccaggtgaatgtgcttcctttatagacagacccagaagccagtgctcttgtgtgtcctgggctctgcattcactctggctctggaaatacctgcttagggtgtggtcctgagtgggaggccaggtgcctggggaggggagaatcagggaggcactctcccttgtttggtgttggtgaagggtaacttagctctgccttctagtctgggtgctccaggtgtgtctgggggtggggatgctggaggtggctcaggagaattgcaaggtggactgatcataattggtcctttgtgtagacttggctgacccacaggcctggtgtgaggaggctgcttgcctgtgggctcagtgggtctgaaacactggctggagccagggagcaaggctttcagcctggaatctgcccaagggactggtgtcaataggtggccttgtctttcacttgtttatttgcagagcccagctctggcccttctctcctttgcagcagtttgaagaaatcaatagaatgcccaagccagaagggacctgcactgtcacctacccctcttctccctcagataaagggatgaggtccatagtggtgatctgatttgtccaaggacagtctgccatgagttcattccttgtggggctagatttggtaaggattctttattctgggtacacgtaagccatcttctgaagttatccttgcaggtgggctccagaacacctgcagatagatgcacatggggcgggcctctgtattctgaaggcagatgaagctgctggggttctggctagtgtgtgggtggtcaatttcagatgaatttcacacatgcaggcagctgcaccctgccaagttggaggtagtgatccacatgcgggcccttacactctgatgttcctgggactggctcttgcgtttgcagttgaggagggaatggagagatgagcctgcaggagagaggcagcctggtggcggcggtgatcttggtgttaacagccagcacttattaccgcatgtccagcactgtgctaagtccattacgtgcattataccaaggaatcatcatagccgccctatgaggaaaaggtactgtgacatttttagtcccactttacagaaggaactgaggcttagagagattaaatattttctcccaactcacagcttttagtggggcagttgggctttgatttcagggctgcctggccagagtccacactgctaacccctgtcctagttgcttcctctctgctagctcattccttctggtagcaagcaccagctgtcagccctgactggagaagggaggcccctcatgagagatggagctgagtctccaccctcccgggccccatacacttctctcctgacccgtacattcctgtgcaccagggaagtggcccctctctggtcgtggagactgaagtccccgtgctgtgttgagcagtggaggtgggggtggctcaggtagaatggagggtacttgactcctgttttttgagggaaagttgcctttaagttggagggatgctgttggcttcctgcagctgcttgctgccttttgatgacgcccctgtgcatgggggccttcaagtgtaggtggaataggcagggttggaaaggctcttttctccccacagtccaggagaggcagtgctggagccccttatttgctgttcatcctttgatgggtcagcataacctttatgttacaaatgccaatagatatttaattcctggggtggcataaggtagcaagcaatttagaatttaataaaattacaaattcttggggagatgattctgatttctctctttatccatgatgcatgctagttgcatgaataaatgaatgaatttttttaaaacttatggaaaattcacacacaggagtagagagaatagtatagtgatttcccatatacccattactcagcttcagcaattagcaacagaattgcctgtaatatttaatcatctgggctattttattggcactgagattagtgtgctagtgtgaactgctaggaacttctcaagtgagaaaggacaagcggagaagaaatgatatcatagtatgaataaaaactcatctttgtggtgctgccatgctaggcaagttgcaggtgctcaccggagggtttgaactaactgctctggataactggccaggtggtgttgggttccagccccaggtgggaggaaagtttctgaagggtgagttcagctggatacgtgagattctcaaacacacactggggcagaaggcactgcagccagccctagttcatctactcaactcatgtttactgtggatcatctttttttaaagttgacatttcaaacataagaaaaagcattgagaatcataaaatgaatatctacctgcttgccacccagacttaacaaacataaagcagacattctttccagatgagggacagatgcatggtctctgtctctaaggaggcctgtgagtgagagacccagggacgggcaatttccttgtcatatacaaagatatcacatctggtatagagaatggagttccaaggaaggctccagcccatcctggaggagacaggtaggacttcctggaggaggtgatcatgtgagctaaaaatcaaatctggaatatgtgagtcaggccaagcgggtgcgggggcagggtcaaggggaggtgggcctgcaaagggtgtaaccaaaggtaagaaaaagggagtgcaaagttctggggagggaggggcaggaggtgagtgaggagtgggctgggtgcagctggagtgaaagatatttgggagtgggcaacagtgaggactggtgaatcagtgagggacaagctctgggcatctttagggcagtagcaggcaccaggcttgtcctgagacctgctcagtgcgtggctgcctgaattagactccacacattgagaggattatagaccaatataatcccatgcaaagaaacccacacagcgggtgcggaagggcagaaactgtatcaggactatttgattgacctgggctgcttagagcaggctccaggctgtcatttgaaagaggggatgtgttgggttgacccaatggggagaagtaggacttggtgagagttgtgtggacatggaatctggctcagaatagaatttctaacagccttccaaagaagggatgcatggttgggcgagagtttcatggtcttaaatgtgttgaagtagtctcaggttggaagcaggcagggctggggtgtggagggaggagggctctgcattgcctggccttcaaggcctctccttactctgagttctgagatttaggctggggagggtgggtaagtgacctgtgggcacaggcaaatggtgctcctgggaaggcggctgtggaggaggtgctggcccgttgccatgggaaccatcactgccgtgggtttccagttccaaggatgccctggaagggaatgagctcactccacctgcgagctggtgagtcagccctgcctctcctgcttgctcgccaaggctaggcgggaatttgagcagtggaccctgcctctaccccctcctcagaccacccaggcgcccgtgccctggatgtgggctcttgtcgtaaaagatgcagggcaataaaggcagctgccagccattctggcatcagtggggatcctgactcggggaagctgctagcctagttggctaaaccttggctgtgttgcagagggtgagccattctctctgccggccactcagctgatgtgggctgcacaccagccacagctgtactgggccagggcttgtggtccagggggtagatgggtgccgagggcaagctttcagggtgtcttgtgaaggagaagtacaggctgggtgggtgtgaatgcctgtcggtcgggcgtgggggtagtttctggaggtggatgaggaatgcttcccgtggggagtggcttctgatctggtgctggagggatgaggagcaactagtttgcccaccaagtcctaggcatctgaggccagccagggtcatggctcctgcctcctccttctgtgcccctccccagatgcccagttgtgagggagtgatcagaacatgtcgggggtattgcaagaatctcaaacagctgtgacttgagtgtacaagccatttttatccaagaccctgtgaaatccatggcaccacccactgggggctggtccctcaggatccacatagggcctatagcccacccccgtgcccccgcgccctgtgccccgtgtggcggcctgtgagatgcatcagaacacccaggggaacactgcgtttctagcctctgcttgccttacttgcttcacccacatgggcctctgtttccatttgagaagatagataagttaggggagaaaaatgaccatcttagaccctttctcctaaacataaccatttatattttcagaaacctatttttatttttaatcttcatgcctgcattattctgatagcggtaatcatagtgtacataaaaattagctctgcttttttatttccccacttggcattttatcaaaaacactttttcttatatagttacacagcctttatgttccttgcctggagaaagtgagatccaagtatagagattgtttcataaatacatgtttatttgtactttcctgcctctttccaaaaagcatttgaggtggatatattaaaagtctcgtgtataacagggttttttgttatttcgttttagagacagggtctcactctgttacccaggctggcgtgcagtggtgctgtcatagctcactgcagcctcaaacttttgggctcaagggatcctcccacctaagcctcctctgagtagctgggactacaggtgcatgccaccatgcctggctaatttttacattcttttgtagggtcttgctatgttgatcaggctggtttcgaactcctggtctcaagaagtcatctgacctcggccttccaaagtgccaggattaccaatgtgagccaccacacccccttccttcagaagttttttgttgtttaatttttttttttttttttaatagagataggttcttgtcaagtcaccaggactgctctcaaactcctggccttaagtgatcctccccgcctggcttcccaaaatgctgggttgacaggtaggagccactgtgcctgggccagagttttaaattaaagttagaagatccagagctatgtcatagtggaggtgagacaattgttaagaaaacaatgttaaaagaggttagtttttaagaaattttaatgtaattcccccagctttattgaggtaaaattgaaaattttaaattatatatatttcagttatgcaatgtgatgatttgatagacatgtacactgtgacatgattaccacaatcaagttaattaacacatccatcacctcacatagttgtcattgtttgtatgtatgtatatgtgatgaggatactaagatctgctgtcttagcaaatttcaaataaacaatatacaaccgacccttgaacatcacaggtttgaactgtgcaggttcacttacaagattttttttcataaaagttataccgactgtgcctgcctctcctgcctccccttcctcctcctccacctcttctgcctctgccaccccgagacagcagtagctgtcctccttcttctcctcctcctcagcctactcaatgtggagacaaccaggatgaaaactttcatgatgatccacttccacttactgaatagcaaatatagtttctcttccttatgattttcttaataacatttttttctgtagcttaccttattttaagaatgcagtatgtaacatacaacatggatgtcgatgtgtttttaatcaaatgtttatgttataggtaaggcttatagtcaacactgggctacaacagttaagtttttggggagtcagttatatgtggattttctactgcatagtgggagtgtgagggtcgttgcctcttacccacatgttctggggactcaactgtaggattattagaaatagtaactatcctgatggaaggtttgtaccctttgaccaacatttccccatttcgttcaacccccctggctctagtaaccaccattctactctctgcttctatgagtttgatttttttagattccatgtacaagttagattatgcagtatttgctatgtcttgcttatttcgcctagcctaatattaaaagaggttagtttttgtaagtcaaccctgaccctggttctgagcttcctggcagccgaagcaaaaagagaacttggaagtatcaagtgtttatttcttagtaaaagaaagtataccagttcacgagaaaggggcactttttgtaagcactaaaagctgagttttaccattttaggagagtggtgcagtaaacagtgctgtcagtattagtttcatggaacacacagaaactttttgtatacttgtttcttaaatcagctcccattgaaagccacaggtatggtgttaaatcacacttgtaggaaggcatttctgtggggagctgaggcaatgaactcgagctccactgtttccagaggtttaacctcagagaggcacaagtcctttgagatactcttgagcacttcttggagactctgtcgtggcagttgtttgacaggagctggagagcaggctgtgtggactcctggctctgagttcagaggttttctgaggtcttcacagaaaagagagctaataggttggtgcaaaagtaatcgcgggttttgccattaaatgtaatgggaattttgcaccaacctgaatatttgttttgggtgctaagcatgtgaagggcaaagctgcttttttattatgaaaatgagagcctggcccactctccctttccagaaggatggctgtcgaggccaaagttgtcttctagaagcagtttgggatctgcccacagaactgggatgaggcccttcaggaaggaaacagtgtggtcagtcggggctgggcctgggcaagtcccccttaccagctgcctcacgccctggctgctggcatgtcctctgctaataattcttccattattggacacttccgtggtttccagttttggcctatcgtagataatgcctctataaatattcctttcatgtggatgttttcctgcatttttggataatatccaggagctgggttttttgatcatactcggaaaggatcatttctgagtccttttccatgtgaatcaattgctttcaaaagactgaccagcttaatgtgccacctgtttttttttttaattgaaaaggaaagtaatatttattgtggaaaatttggaaactacagcaaactacaaagaagaaaataagaattagcagaaattctaccaccctgagagcacagaggtgtgtggcctggtgcacacacctggttcactgctgcagtgaactcgtctcttgtcaggcaggggtttgagcctcggacagtcccctgctagtagtctgtctaggtgcatggggcacctgattttcctctgcctcaaacggtcttctcagccactaatttgtctgcctctgagcatacatttctaaggttttgaaggccctgttaacctattaatctgttaatcatagaaagcggtttagaaaacttttaaatgtctaaatgtttgggaggaaatgttaaattatcactgattggcttcttagtagattcctcaacagctaccacctgccaggcgtgaaacccaagaggtcgggaccccgggctgatgcgcttcggtgtgagaagtggtggaatcgcctgggaaagttttgcccagatctgactcctgaccacgttcctcaagttcctgtctggctctgaggcttgtctggagagccagggtgtttggtaaaatggaagggaagtgcgagcgatcataaatgagaacctaaacctgccgtctctcacttccctctcttcacttcgctgaaccagacattctctgggccaggtagacacgcccctctactcccctgtcattaggaggaagcttccagggcagggagaccccttcccatgctggccagatgccttgctgaactcttgaccagggtactggttgtgggctgagggttgctgaccccctgcaacccacagagttgcttctgttactgggtagctccaccatcacctaagcagttacatgtcagactgaatttcccagaatatggggcaggaagaagatggtccattcgtggaattacttgacctcaaatagagagcgaggcttcagtccttaggaactgtaatgactgatcaaagagttcccggatggctttaaatgccagaatgggcatggcaggtgtgctgggcactgtgcacacagcagtggcacacctgatggccgagtcattgttcagcatataggagctgatgcacagaaggccccctctcctgccactctagcagtttcattgagttgggtgggatctgggcagggaccacagctggaggtcacaggtgtctcttgggggaagaggggatgaatgcctaaatgatggcatcttatccaaacccctcttaccatgcatggaactctcagacagactctgttagagatgtgccttcaagatagatgctcgatgttcttagagctgtgtatcctccggccagcccatctgacacatagttgcaaacagctttcagttttccaatttccaggggctgtggatgattagaactttggaaccatgggattcaccagagagaatcttggtttggggatgtttccttggggcagagaagggggaagccactggaatgtctcagctgctgtttgtgttgtttgggtgaagagctccctgttgggatctcgtgatgcctccagcttgtggccatgtggatgggctgggattgatttgttctgtctggtttgttagacactctacccgctttgtctctccccacccagaaaaccacaatgaactctaaaggctggtccaactaagattcatggtaactgggagagagagagagagggacttgaggagacaagagtgacttgtgctttggtctgtgaaggagaggttcctttgcgatgaggattggaggtgggtcatgcaatgaggggcctcctgcctaagctgtattcagtgatcattcgctgcaggtgaccacaacttccttgtagatattctagctcccctgggtatgtccaccctctgctacccaagtggagaggttcactccaaggctatattccttataggatggcccgtggaccacctaggtttgtgtaaaactgtagcttcctgggccttttccagacctcctgaaccaaatgctctgttagagcccagaaatctgcatttccagcaagcgccctacttaatttttagataaagctagataaccctatgaaggattatctggaggaatattattgcttcagtctgaatggaaagagtttagctaaatgaactcaattcctttacattttttccccctttaatgtttttcactttttatgaaaatggagacagggtctcaccatgttgcccaggtgggtctcaaactcctggacttaagcgatccccctccctctgcttcccagagtgctaggaatacagaagtaacccactgtgcagcctctttttttttgtttttgagacagggtcttcatcgttctgtaacccaggctggagtacagtggcatgatcatagctcacgacagccttggacccctggtctcaagcagtcttcctgcttcagactcttcagtagctgggactatagtgtgtgcgccactgtgcctggctccagctgcttcactcttatttactcttcctccaggaccttcttaatgaagctttgtctccttgtggcttagaccgtaaattcactagccacccccaaatgtgaatcaagtatttcttctggacgccaaacccccatgacttagagcaaaagtgaagaaaggaaaggcaatctgttattgctttcctggttgtaaactgcttttggatttggagcacgtggtctggttggctctctgcaaggctgctttaaagcaacactgcagtgctagcagtggaggccctgctgatcagtgattcatcccagggattctgaggggccatccatatcaggcaggtggcccaccctgcccactgatccctctcaccctgctcagcaggtcctcccctgccaccgagcgcaaacatctgtgtccttcaatgacctgcccaactctgtttggtttcctgcggagagagggctttttaactttctgcttcctgcctcgccctgcttccctggttggcccaccggagtgacctctgatcctctagtctcagttgagccaaattctgactgtggactgttgtctgggttctagctttctttcaaaccgcgtgacagtaggggtttgggttggctctagacacggtgagcgcctagtcattgtcatgagactggatcatttcagcctgggggtctgccagcagttgtgtgttttgctgggatagactcagacagctcccttgagacattcccaggcaatgggaagcctaggaggcctgcaggactcagtttacatgcaatctcctactgactccacacctggggttcattttggaggctctaggtcaagaaaccctctggctgcttccctctttttccctgtgggagcttcatagggtagatgtggaggccacagtgtatatggggaccaggaagctcagaaatagagggaggctgatgatgggggagcagaattgagtgtggcatggaggctgccaggggagctgttacaggtctgcttgcatcagagtggactaggttgacgagaaggattagtaaagaggagctgggacttgaagctaagatttaagaaaaaggatctccaggacacttcatctggaggcccagagaaggcaaaatcttccagtcaaagcaacttagctgaggaacaatttttaaaaagaaaaaaagtctgaccagggcaaggttctaatagagcgagtgatgtgttcatttcttaaggtgttgcacattggcacagccttcaggttagcatcatggctgttgatgcagcaaaagctatgaaaatgctcagaccctttagccctgtaatttcaccccccaggagtgtgtcctaaggaaactgtccagctgaaagaaagacatgcttaaaaatattctctgtatgggccgggtgtggtggctcatgcctgtaatcccagcactttgggaggccaaggtgggcggatcatgaggtcaggagttcgagaccagtctggctaacatggtgaaaccccgtctatactaaaaatacaaaaattagctcggttcggtggcgggtgcctgtaatcccagctactcgggaggctgaggcaggagaacctcttgaaactggaaggcggaggttgcagtgagccaagattgcaccactgcactccagcttgggtgaaaagagtgaaactccatttcagaataaataaataaataaataaataaattctctgtgtgtaacagcaaaactgggggaaaaaagtgcttccatatctaactaaccctggggaaggaatttaacaaactatccatcctgatacatcatggtggtgtagtatttttgcagcctttaaaaatgataattaggaagattatacaggaataaaatattcaacagactgttgaaagtcggagaacactaaagagtaatacattataattgatcgtactgtaaataaggaagatagtgtagtaagtagtgtaaataaggaagataatatgtaaaaatacaaatggctatgttaaggctagaggattcattattttaaaaaattagtatttaaattttatggcaagtcagagaatttctatctgaagcatcattcctcttcaaatatttttctactatcacttgtcccttttcttttttttttttttgagacagagtcttgctgtgtcgcccaggctggagtgcagtggcgcgatcttggctcactgcaactccacctcctgggtttaggtgattcttctgcctcagcctcccgagtagctgggagtacaggcgcatgccaccacgcctagctaatttttttttttttttgtatttttagtagagatggggtttcaccatattggccaggctggtctggaactcctgacctcatgatctgcctgcctcggcctcccaaagtgctgggattacaggcgtgagccaccgtgcctggtcacttgtcccttttcttaaggagtcatggcaactgggtgagattgaatgacccactttgagcatctttagtgtgtgttgtgcactgccaggctctgcggagtacgcacagtgtaagatgtggtcctctgagcttaagggcagaggatatgtgtctttgctggggagataagatgtccctgtgctgggcacgctgattagtgctgaggctgatgcatggctcaggcatggagtgggggacatggaggctgagggtagggagtgggtggagtggtttgggcctttagctggggctggaagaaggaccaggagagctttcaggacagggaaacaaccagcccggcattggggaaacctaggaagaccaggagagttgagtttgcctaagagggattttcagatcatcacagctgtgagtgagctcagagttaaataagatgtctgttattcaccctgttttctagagattggaaactgaagtccaggaaataagctcttccaggaatctccagagtcccctggggacaggggtgggtgcgcaggctgactccctgtgggttggctgcgttccagtggcagatgcccctagggatgggaaatcatccccccgaccctctcaggaaaccctttccatcccttctgggttggtggcgtcactggtggtggaggatcagcattccttctcctttcaaatctgcccgtgccctgcttgggtgtcaggccctcctgggggctgctccatccacactttccatttgggggactttgacattttgtttaagtggagatgtgattgagagtgtgtgagggtgagaaccggaggctctggctctttaaggctcggccttcaagtgaggtttggcagagaagatactgaacgtttaattttagggccaaggtagggggtgggggaaagtccctaccgcatctggtttgtgttaagcctgtgccttcagaaaagggctgtgtttatggttaaaatccagcagggatggggggtgggcgggatgccgctttcccctactaggcattgcggcacagggacagggcacatatctaccttccttctcattctttgaccccatcccaagcccgacagttacaacttggagaaaactgcatgtgacatccattttatctctgcagttaaagccagatgtttgctttcaggcagcctccagcagctggactttgccaggctgaagctgtattctttgtgccccagaactccctgccgttggccgcctgtcacttcgacctgtctgcagcccgcagggtcccgggtgggtcattgctgctgcggagtccaagctggggcctgtcagaagctgcccagggctggcctccagcaggcctccctctggcgatcccaggattgagaagttgagtcaatccctaggatgtctagactaccagcgctggaaggtcccacagaaaccagagccagccccctctgtcagataaagaaactgaggcccggaaagctggagactgaaccagacctccctcagctctcagcttggctcactgctcttttgccagcttcatgtggcttcccttttggctactgtttgttttgctcttccatgctctactcccttaaagggccggccctggggacagggagtagggtgaaagatcttcagacccaatgggaagttcacaaggctgcgcttgttcactgctgtttgccagcattagtatagtacctggcacagggtaagagtttagaaaatcttgaatgaatgaacgaacgaatgaatgagtgaatgaatgatggggttacttggcctgagggtggggacactggtgctgcacttagagccattacttctgggaggggtaccaggcacgagtctccacacccaaagctctccctgttccaagaccacgtccagtcttctccaggccttcctcagtcccagcccatcacccggcttttacaggagcctggagtttcagagctgaaaggggccttggatatcaaatgttgcatcaccttcacgttagagttggggaaacggagtcaagggcacacagctagtcagcgggaacgtcaggaccagagcccaagtctgtggggttgcagagcttccatgcatccctccttgggcatttatgttgggagttgaggttagaaagagaaggccctgtcttgtccattgtgcctccccttttctgtatcttcctctgtgggatgagctgtttcctctttctctccctcctcactctggcttcctctcctgtagtggaggacggtggggtggtttctccataacagtctgagtaaaaaggctgggcccctgggattgggccaagtcattcccttgtgtcttcctagaaagggaaaaagagagtcggctggctcacttccttccggggaaaccagcgcctgagtcaccctggagtcagggcccagggaggagcctgcccgtcaccccgttgcctctggccatgggtggcgcttccctgccactgtttctcaaagggcggggggccagggaaggcctgtgctatccagctgccctgccgttcgtctgccttcgtcgcttcttgggagagtttcttggccttctgcaggcaggctggtgctggtggcaaggagggcaggcaggtgataacattgcccccctctaactggaggtcttaaacaccctcctgaatcacaatttgaaatgtttttgatttacaagtcttcaatatctgttttgttttatgataaaagtttgacatgcttagggccggacgtggtggctcatgcctgtaatcccagcactttgggaggccaaggcagccagatcacaaggtcagtagatccagaccatcctggctaacacagtgaaaccatgtctctactaaaaatacaaaaaattagccaggcgtggtggcgggtgcttgtagtcccagctacttgggaggctgaggcaggagaatggtgtgaaccagggaggcggagcttgcagtgagccgagatcataccactgcattccagactgggcgacagagtgagactccgtctcaaaaaaaaaaaaaagtttgacatgcttgtggtaaaataaaaaacaactccccacaggtaacactgttatttttctataccacagattttatatgtttgatttatatatatatatatacacacacgcatatatattatggtaaaagatacataatatgatatttaccattttagccattttgaagtgtacgtacagttcagcagcattaagtacatgtatgttgttgcgtaaccatcaccagcatccatctcctgaactcttttttttttttttttttttttttttgagacaacaactcactctgtcacccagactgggagtacagtggcacaatctcagcttactgcaacctcctcctctcgggttcaagtgattcttctgcctcagcctccccagtagctgggattacaggcacctgccactatgcctggctagtttttgtattttcagtagaaacggggtttcattatgttggctaggctggtctcgaactcctgaccttgtgatccgcccacctcagcctcccaaagtgctgggattacaggtgtgagccgcagcgcccagccccatcttctgaactcttttcatcttgtaaaactgaaactctgtacccatgaacaattcctgacccccagtcctgataattccattctactttctgcctctatgaatttgactactctaggggccccatgtaagtggaatcatatagcatttattcttttgtgtctgggttattttcacttagcagaatgtcttgaaggttggtccatgttgcagcatgtgtcagaatttcctccctttttaaggctgaatcatagtccattgtatgtatgaccatgtttggtttctccgttcatctgttgatggacatttgggttgttccccccttttggccgttgtgaacagtgctgctgtgaatgtgggtgtacaaatacctgtttgagtccttgcatttaatttttttgtgtatatgctcagaaagtagtactgctatattttatgctgttactggttgtgcttctcaggcaccttgggtcccctgggcagtgttgacaggtcagcagagggctttggataccaccccttccccctgccagcgccaggcctgccacagtagctgtctgcagaggctagggctggcctggccatttgggtccccgagggcacactgtggagctgcagagctaatgaaaagttttggaatcttgtggtgcagaagggcctttttgggccaggtccccacccttccttcctcctgacctcctcgtgttttggacttggggaagggggatgcagcttctgggagccctggggaggcacggggaccccgagcttactttgggacctagaggcccattcttcttatgacctcccccacccctgcctccagttcttcctgtcctgggctgtttttctctccgaggctctcccagagggttagtgtgaaaaagatttttggcccgttaattacagagactaatgcaaaacttcctagcttcctttggaggaaaattctatttcttgctaacagagcaggagctcctgtcctgatgcctgctttcaccaagttgggccccagagcagctcctcgctagagccctgtgcacagctgactggtctctgtgggctcactggttcgagcttcattatgagctgctttgaccccctggcagagatctgcacgtggctgtcttttgggtgccccgtgcgcctcaggaggcagtgtgtctgttctgtcagctagatcacagctctctgagagcagagctgctggttgtttttctttgtggcctggtagtggctggtctggtagcctgtacttcctggatgcccagttacagagaaagagaggccatgaaaataatttgggatttggcattggagaactcctggcttttggtttggggcctgctctttgctagccggcttacttaaccctctcgagcctgtttttccgtctctaaaatagggatcagaaaaccttacttcttttttttttaagatggagtcttgctgttttgcccaggctggagtgcagcggtgcaatctcggctcactgcaacctctgcctcccgggttcaagccattctcctgcctcagcctcccaagtagctgggattacaggcgctcgccaccatgcccggctaatttttgtatttttagtagagacgggggttccaccatgttggtcaggctggtcttggactcctgacctcaggtgatccacccaccttggccttccaaagtgctgggattataggcgtgagcccaccgcacccagccagaaaaccctacttcttaataagcttgttgtgaagagtaaatggggtcattgttataaagtgcgtaggtaagtgtcagtgaatgtcagcttttgtcaccgttgtgcctctgctaagtggaagggcctgggggggactccctgcagaaggccaacttcctaggacctctgtgtgctttctgtccatccaagccctactcccctgggagaggctgcgtgtgaggttgtctggttgggtggcagcagcttcccctgcagaaggaaactgcttcctccccagggagatgggagttgctaaactctggcttgggccggctgtgtgctctaagcagggattatgtgcgtgtgtgatgagggcggtgccttgggcttcattccagatacaccgtgttctctgacctcgcactcccttccttggagcccctcactccagcaccaggcattgtggctcagaactcccactgctccggattgctatttgacagtttcataggtgggtcctacttccctttttagatgataggctccaggacctccatattcctcatatttggggacagaaaataagagcttctctttccatgcagtaggatgcccctttctcctgtgggatgattgggaccggcctgtccaggcttgggggagggaataggaacgggaaccctgcttggagctgcattctgtgttcggcccctccctgcagaagacttcaccttgcagagactgcagagtgttagggagaacccagctttggagccagcagcactggtgtggaggcaagctctgctgtctgacttgctgtgtccttgagctggtccttattctgagcctcagtttcttcctctgtaaaaagacaatctgtcttgcagagttgttgccgagactaaatgagatgatggatgtaaaccacccaagctggcatcccatacctggtaggctccctaagtgtgttgttattttgtgtgtggatgggccaaggggtgcttttagcgaaccattcttctccacacagaggtgtggtgagacagacttcctatatacatttctgtagcccagagttgcccaaacttgcctgattataggattcacatggagtacttgttacttgttaaaataccaatctgtgagtcccatcccagaactcctgaaccagaatggtggttgttggggtgaggggtctctacttttaaccttttttataatcgggccagtctgggaaatgccgtttccctcagattgctctgccagttgctgtgtcattccatcttcacgggggcccattggaatgagacaagtatggccccttggaaagtgggagactttgcaggtgagactgaagcttgaaggggctggcctgaggccctgagctccttgtggtggaagcagatttagaactgagatctcccagtgatgtgtgtccattgtgcctgcaaacattccactaaagcatggaaaaggtgaaggtggggatggagagagatggagtgacaggaaggaggtgagggctgagggcctccatgatggccttgggaacctgcagagactaagtgggggatggatggtgggacagagccctgagccccactaggatgcttccccaggtgtgccttctgaaaaccagggccccagtgagcatgtggggccttgggcttcttagaaccactgggaatccacaggtgtcagagcgtaggcgcggtcttaggcagcatggacccagcgggaggggctgggactcctcctcagggctgctggtggagtcctggaagtcctgtgggtaggacttctgccacttctcccctcttcctctgccttttttattgggctgggaagttttctagaagcacaggcagggctggctcccttgttcagatagggaagttgaggaataggtatttccagggtcagctgatgatgccaggaactggggtcccactgccttgtctgcttcctccttctcaaagttggcctggtccattagagaaaaccccttttaggtccttactatgtcatcctttccagtttacccttaagaggcccttaaggaggatttcaacctctgctgggccccacccccagagggtgacttgattggtggtggtgaggtgggctggtgggctggtgggctgtgagcggaggggccctgttacggacagttgtgagagtgtggccggggcacggtgacctgctgccaggccctggggagagtcacgctgactgagcctgtggttgaaagtgtgtgactgccaccgcgggtggaattctggctcctgcatctactgttcgctgtgaccttgagtggctgtgagctcttggcctcggttttctcatctgtaaaatgagatgccttctggggtggttaagattgattgggttgacactggtagaacacttggggcagtgggttgggagtgacatcctgatctctgaagctcttccactcagacctttcaattagatctgcagcctcaggactttggacctttggggactgctgtgaacagcgagctgccccaggtgtctgggcaggcagggagtatgggtgcaaagctgtggcctctctgcctgttcctccttctgttggctcaggtctgaaaatctgggtgtggcctctgcccctcctccccgtctctcctgagtatctcttgtatccacctgcttctccctctcctacactgccaccctggactggctccctttgtctctggctgggaccttttcgtgatcttgtgcttggtctcttttcagccactcttttccatctctgatctgcccttcccatggcatttagaggtctctttctaagatgcaggtggaattatgtaaccagcatctgattggcactcccagcccaactcagcccgccacagccccatttgtttctttcagctaaaataaaatgtcttcggtgacttccactgctctcaggagaaacaacagctgcaggaacccgaacacccatgtggctagttgatctccagtctctggcaccctcttcttccctcctgcactgtgactttttttttttcagttttttgaacagaccttactctcttttctctggggcctttgctgtttgtttgttttcttcttcttcttcttttctttctttctttctttcttttttttttttttgaaccggagtcttactctgttgcccaggctggagtgtagtggtgcaataggctcactgcaacctccgcctcctgggttcaagcgattctcctaccttagccttttgagtagctgggattatgggcacgtgccaccacacccagctaattttgtatttttagtagagacagggtttcaccatgttgcccagccccacacacgcgtagggtgacctacagctacctgctccacacacgcatagggtgacctacagctacctgacccacacacgcatagggtgacctacagctacccgccccacacacgtgtagggtgacctacagctctgcctatacctgttatgctggtgtaattattagtagaccccctggtgccttggtttggatgacaggttatgtgggcccccttcacatttacgaacttttcatctaatactccccagccttatagattcactgactcccttggggcagtgatcagacacactgcccccctacagccccccaggatcagttcagggtcctgttttagccttatgccttccaggacctttcctataggcactggatcttagtgtacaaaaatacacgcattgataaaatctttgcttattgtttgtcttctccattagactgcaggctccatgacttaggacagtgcctgtatttgcccacgatgtaaccctagtccctgatacagaatgagtgctcagtaagaatttatggaaggaaggaatgaatgaatctggctgcagctgtctggcaggggaggcctggagcctgggcgagtctgtagaatctgcagtggcctgcgtgagggaggctgccaacatcgggccagtccaagccctagcaagccagttgcccacactctggcacacatcatcggcttggtggcccctttaattattcatcggtctttctcaatggcctttgtgttcagaaacccaagacagaattcaaaccctctttccatctccctaaaactgagacctggaagaaaaacctgctggcccattctgcatccccagggggccagcaggtccacagcctcctctcgtggctggctttaagcgttgaagtgtcctgggctgccctgtggctctcctccccagtccactgggctcagggactgcctgggcacagctgagtgggtgcccgtgtggcttgagactgagcagggactggtgcaggctggtgggcagagctggatgagtccccatcattccccagcctgaacggagtctgaaggctggcctggaagagtttagcctcccagcagagtggagcaggctcaggctttgaccgacctagttcacacctcagttctgcctcttgccagctgtgtgactgtggggaactggcccttggtgtcctgttcctttgttcctttaacctagaattgttgagtggacttgctgagatggcgcatgcctcgtgggtgatgataacagtgagtgagcactcactgagggttataatggtagccaacatctttgagcaaccctaggatatgattccctctccttccctcacctccccttggggctccctgaagtccacgttgccatcagtgtccccatcttgaaactgaggatggaacgctgatctttcctttcaaggttggggggagggggctggggagccgaaagcaccccagggctgcccttgctgcagtgtctgaagtgaagcctaggagccccggtgctggtgggcaacagcaggcgtggatctctctgatctttgaagaggactgtgaatacactgaccacaggcggaagccccttgtcccgtcctgccctgcactacccagaggtccctgggcttctcagcagaggtggacagatctgcttgcagctgcccttcttcccacgcttctggaaatggaagttcccacagacacattcctgttcctcagcttgctgctccctgcttgctgataccttgccgccctgtccctcaaaccgggctggccataccaaggtgttggcgagctgctcagcctgctgagctgttgacaccccagaccaccgccggcctagtggacaggccaggaaggcagtgatggcactgggtcacattgtcctgggcctgggtgagggtttctgtgctgctttttaatgtgctgatctgtgtgtttgtgttttgggagaagaaactttgtgttgcggaacctcaggtgaagagaattgaggtcgttaggctcctccgtcatggcccagtgtcatctcggggccatgcaaggcctctgtgtgtccgtcacattttatcctacaatctcctgtgatggatatgcagattgtccccagctgctctcctgctgacacaaatgaggcaacgatgaacattctcccatacatcccagtgcagctgtgtgaggattgcattgagcagggaattgctgggttgcagggaatttcctgatacgctgctgagttaccccctaaaatggctgtacagtctactctccaccagccgggcacgagggcttccggatccctcaaccccaccaacattcggcgtaatcaactttctaattgtttgcctgtctattaggtgtaaagagatgcattttagttttgagctgcagctgaagaggaactctcctccaagtgccaagactgctcccctcctccagtcagctctcttggaaccagaaacttcctcctgggtggtgttgagaatcatggtgatgctctgcagaaaacctctcctctgtaaggagtggcagtttatagatacagcccgttaatgcctcagtccctgcaggaagttcttttttttttgagctggggtctcactgtctcccaggttggaatgcagtggtatgattatggctcactgcagcctcgacctccctgggctggggtgatcctcccacctcagcctcctgggtagctggaactataggggtgcaccatcatgcctggctaacatttttaaattttttgtagagacagagttttttgcctgttgcgtaggttcctgcaggaagttctgctccctgggagtgtctgctccagtcccaccccgggggtgcaaatcactgctgtgacttgtggtggcttgtgatgcttccacagttgctgaacttgttgcctcatcccctggtatctctggcatcctgcgggcttgggtttcctggagctttgagaattcctttgcaaagtcatgtggctgctgccgggtggttgtccctcagggaggaggtgggtggcgctgtggcattggcttggagtttgggctggatcagtgctgaggtcctattgatcaagttttgactgagtcagagaggttggggtgcagtgcctgctggatcctgctagcccagatgaaggaacacactgggtgccaaggtgtcccccatgatcccttgatgctacctgggaccgtttagtagacaagggcaattccatgggtcctggagtcgttctttttgtctcatgcctttccatgagcaccctttctcttgtctttcttgtactttagtaatgaactctagacactattaactacttagggtgtgctgggctttttgcatagattatctcattgaaactccttaccaaaccagttgagaaaggtattatccctgttttacagatgaggaaactgaggctcagaaaggtcaagaacttgcttaggttccaaggttagtaagtggcagacccatattgaacccagctcttctgtgcccaaatccgttcttagccactaagccttggtcctcagagtgtggtctctggaccggcagcatcagcatcacctggatacttgttagaaatgcagtttctctgccggcctagaactttggaatcagaaactggcggtggggcccagcaatctgtattttaacaagccctccaggtgattctggtaaatgttcaagtttacatattcaagtttgagaaccaccgcactgaattatcctgctgttcttttttctattttttctgcctggcttctccccttttgtcattgggccagtcactgtgagcccagactttgaaccctggctgctcttcaggggcttcatgccccttttaaagaggtgcagtaattcgtcctctggggcctccacaggaacccctcccaagtccccaaaagcagttgacagaactgatgctccagctgacagcctggtgaccggaaccaccatgggggtcagagttcccagtcactatgcccaaggaggtgctttgaggggtccgggtgacccaggggtggactgtgggacagaccaggacagaagctcctgctgggagattattttaggggcacagaaaggagacttggaaaacttccttgtccaagcaggatctctttctttcttgcaaatttgtaatgataagtggtttgacctttggagaggagcttccacacaggggtttggaatctaggcaggtccttgtttctggtcaacaaggcacattcaggagaaatgaccctggggagaggatagaagctaattttttttttttttttttaagtagagacagggtcttgctatgttgcccaggctggccttgatctcctggcctcaggcaatcctcctgcctcagcctcccaaagtgctgggattgctggtgtgagataccagagccagccttatttaatttttgagcccctaccgtaagtctagttttgtgctatttaattcttagcccaaccccaggaggggtggatttcatcatcccattccacagataagaccatggaggtttcaagctggaagactgagggtcatacctcaactacatggaggggtcaagttaggggccagagtctgccagaccccgggttcccatattgtatgagtagcaggctgggccaaatccctgtcagctgggggagttctctatggaattgagtgacccagagctctcagcatctgtgccaaaaaaaccaaatgacctcacttttggtggcttttccttctttggggaaggaatgtgctggccactgctgggagctacagcctgctgaggcctgtgtgctctcagacctgcaagggccagaatcagactccagacatgggggaggggttacagcaggaccaaactgtaaccccggaggaccggggaggaggctgttctcacactggcctcccggagcgggtgccactctgcttcgaagaccagctccgcccatttagtaatcctcatctcagcaggcttaccagccactgttcagtagctgaactagctcaattacatcagtcccccgagagggctctggtccagggcctgtctttgagcctggtttctttccaatgggccaaatgggttaaaaacaaaaccacgtcttgatataaaaggcttagcggggtcctggaacattttagtttaaaagagaaataacagctttattgagatgtcattcacatacccatacaattaacccatttatacaacttcatggtttttaggatagtcacataaatgggcagctatttttgccatcagttttgaacatttttatcaccttagaaagatattctgtaccccttagctatcacctcccccaactcctccgttcccagccctaagaaaccactaatcaagccgctttcggtcttcctaggtgcttttgtgttttaacatctagtgagtgcttggtctgcgtctggtagcagactgagccctttgcactagctcacatagccctccctcgtgactactttatgggctgcaggctcattttatctttattttattattactattttcaccatcatcattctggcccacagaagtctttactgatgtgagaaccaaggctccgggaggcccagtcgcaagtactggacagagctagctggtggctggcagttggggtgggctcttgggtccctgggaggggtgaggctgtggatggtgacagattggctgaggcagttgactctcattggcgaggagctaagaggacagacctgtttcttcactaggatcgtgtgtccacctgttttaaagtggctctgatttctcctgggagcccataggttccacctgtaccaggcaagaaggagctgggcagtctgccttctggggggccttggatggcagggaggccagatcagagtctcatggtggcccaggagccctctcaagcacggtgcctttgttaggcctcccagaaaaagctgcaggccccctgcttcttggccctggtgaccctctgggtgtctggtgctatgtcttttgaaatgggctgtagatgggtgtaaaccaggaaatgcaggctccactcccccctccccatctcctcctcttggccagaggcccgtctcagagttctctcatcagtggggaaaaaaaacaacaggacttctttcttgctctgtgaatgattaactttgattaaatagacagtggatgggaagtgagagcatgctgaccgctgacattgactgggctcctgatgtgtccagggtatcttgctggctgttttgcttccattgtcataatcttcacaaagtggtgatgttctttatccccattgtaaggtgaggcaattgacacctagacagtttaactaaagccacacagccagtgagtggtgaggacctgctgggttaacattgtttaagtgtctgttgtggacacagcaccaggctaagtctttcaggacatagggtctaatttggtcgtctttcattctgtgccattgtaggccttgttatccccattttacagatagggatcctgaggctaggattaaatctcctgtccaagcagacagatgtaatgtgaggtgtgggctggcactggagcctaggtctgtcttgttccaaagtccaaggtgcacccccagtcccccctactctgaatctccaggaccccagcactcacatgtcctggggacaggctgttagagcagtgccaggtctcagcagaggcctggtggttgtcagctttttcagcagccactcccaggtgggtgggaagtgggcagatctgggtggagatgttcccgaagactctgcttttcatcagcgcatgaaccagctgacggctggctttgaagggctggcagtcagcccctgataagttagccagatactcctatttaccatgccagaacactgggcatctgagatcacttctgggcaggtctttgcttagacaaaccacccagggcccacgccctggccagactggccatacttgtatgggggtcagagggattccagcacgccccctggctgcacctcagtaacgtcttcaacatcagtggatgctgcagaggactcaacgctgagcacaggtgctggcctggccttctccaaggaccctgctggttcacacaccccgcccacacagcagggggctggcttgggctggcagggtgcttgcctggggaggctggtgagtttgtttttgactcgatgagcctagaccagagtcctgggtgctctactcagggagaagaacgaccatcagacgagaagctggcttgtataggaagctgtgtaccattttcaggaagtgtagaagctcatttgggtgatttcctggggtcacttggccagagcacagccctttatcttacccagttagcagtttgctgtcttaattattggggagatgtgtgtgattgctggtgtatcctcatgtcctgctccctaattatgactttctttaagattttacactgataaggcactttaaagttcttcagagccttttccctatattatatcttattttattctcaaactcattcttttaaatagatgggataattttttcattttttatctttattttggaaacatcctttttcctcctccataatacctgagccttgtcccacccttgccaaataatcccagagaaatgggaagtcctctctatcctatcctagaggtctgacataacaattaaatgtatatattcccagacagacttttcttttttcttttttttttgaaaaccactaactttattgatctaaaaaactttacaaggacagtgactgttctgccaaaaaaggagccaaatggtatcaaatggactgcaagtgagggtgggggtgagagacggggccaggaatccatgcaggaaagctgataactgtcaccagggaattggcaagggaaaaaggaaggaggaggcatacaagagcgagaatccaaaaaagttgaaatggttaggggagaaaactctcaaaagaccctggagtacatcagaggtgagtacaatagcaatcttttcctctgtagaggacaggggaggagtcccttcatggctgcaaactctggatgagggctggggattgagggcttcccagagagcatcacaagaagttgtcctaccactcttaaaggcatcagaagcagttctgggattgcttggcgttggcaccacaagtgtccttcagccattcctggaagaggtcttcagttttcttcagcaccagaaactggccaaggacaacataggctttgtcaaagcccctttcctccggcttcttgcccaggacttcacccggccaggctccccactggctcttcccccatgggctctgccacgaactctcggtgcttttggaaggttgtcatcttgattaggcctaatcggcagcttcaattcccgtaacagttcctcccgccaccccctagacagactgttcttttatttgcatacttaaaaaaaaaaaaaaggtaatgacagcacattttggtacaaaactcaaacaaaagcatattctgtgaaaagcaagtgttctctaccccctgccttcccatttctctccctggaggcagccgatgatcctggtccttctgtgtcctgctaggaatgttctagcataaagcttttagatgctgtccgggacactaacgtcaggattctgcttgctgagaagggttaggagctggctgtcttgagacagaaacactgagtatgttttgagttcatggagatgaaattgtccctgggaaattttttggctttctttgagagcccaccaatcagaataaaccctacacaggaacaaaagattgttgccgggtgctgtttggttgtgtcttctcattaggcgtgttctgatgggaaaagtttctgggctccagcctgcaaggtaggagggacttgtttgcgctagcagagctggaagggattgaagtgacttatctgaggtcacacgcctggctgagccagggcaggtcccaggtttcctgatcccatcctctgaacacttaactcccctggcctgaatggtggctggtatttttgattccgggagagtgggaggatgtgcttggaagaggtgtggccagcacgtgagtttggagcctgggctgtcccaccactgcccagctagtcttgtttggctgcaggtgggttatcttgtttattccactgtgcaacaaatggaaaaagcacctttgtcaatggaggcttctctggggaggtcagccagagtggatggcctggattgtgtgttgaggcttaaacatcagaatagagcgctctagccgggtgtggtggctcatgcctgtaatcccagcactttgggaagccaaggtggacagatcgcttgaggtcaggagtttgagaccagccaggccaacatagcaaaaccccgtctctactaaaaatacaaaacttagccgggcgtggtggcacgcgcctgtagtcccagcaactcaggaggctgaggcaggagaattgcttgaacctgagaggtggaggttgcagtgagctgagattgcaccactgcactccagcctgggcagactcctctcaaaaaaaaaaaaaaaaaaaaaaaaaatgaacagagagctctctgacaggagaagggagagggagcagatcatcataaaaaccaaccacattgccaggcacagtagctcatgcctgtaatcccagcattttgggaggcagaggcaggtggatcacctgagctcaggagttcgagaccagcctgaccaatatggagaaaccccatctctactaaaaatacaaaattagttgggtgtggtggcacatgcctgtaatcccagctagtcgggggagggtaaggcaggagaatagcttgaacctgagagatggaggttgcagtgagcggagattgtgccattgcactccagcctgggcaacaagagcaaaactccatcttaaaaaaaaacaaaaacaaagcccacaaccaaccacatttacagacaactgtaaaacagcaaaaaatcctaatcagttcagttactggagtgcaagccctgttagcattttgatgtgttttgtttttagtcatttttttcatgtttgtgtgattgcccacatagttttaaacttgcagtacatacagtcttgaatcctgctttttttggttaattatatataagcagtttttttcatagtaacatagtttcagaacccatcattttggccatgtaatatttcattaagtggatgatgaagcctaatatacttaacctaataccttattaatacaatttctgtctctttctaatttttctctctcaaggaatactggcaagaacatttgtatgcttacagcctttgctttatatttagaattattagtctttattcaggatggtggcccagaattgggctaagggctggtgcccatcttagttcaccttggtgagttgctgtccatcagagttgtaccaatcgcctgcccacagtaatgtgcctttgtcattgaacccaccagcagtggaaatgatcagaaaactactttgcacatgtaataagtgacaaatacaccttttgaaaattcacaagcatggcagcatgtgcgtgacatgtctaaccacaggcccttgtgacaggtattgacgtgggttcctcattgatccagccccaggagaggcgcgcccgctgccccttacgggaagtcttgccagcttttgccgactcccagatggctgatgtccccaagacctgtcaggagtgttaactgtggtaggcacagctgtctgctgcgtgcttgttttagcatgtcatacattattacgtgtgtaactttattagcagacttagaaagctttcatgttttcccattgtgaaactaaagacccattgggtcttaattcacatttagcctgctgacatttttggggggcctgtgggatgtcttatttttatattgtggcagcatttcaaaactgagggagtctacataaaaatctagatttttttttttttttttcttgagacagggtctcactctgtcaccccaggttggactgtagtgacacaatcatggctctctgtagccatcatctcccaggctcaagcaatcttcctgccttagcctactgaggagctgggactacaggtgtgtaccaccatgcttggctaaattttgtttgattttttctgtagagatgaagttgcccaggctggtctcgaactcctggacacaagtgatccttccactttggcctcccaaagtgctgggattacaggcataagccactacacccagcataagttcagatttctgtctcttcttcattggaggtgtggcagccaagggcctatgttcccatatgaggcacagaggagctgcttctgccccgggccacctcctgccgtgatacagaggccgtattctagttgccattgagtagctctcatgcaccctagtatacttgtatttcaggatagccatgttttcttctgggtagaaaaacaaaggatagcccaagagggccactgtttcaagaacaatgcataagaatacagggaggtggccgggcgtggtggctcatgcctgtaatcccagcactttgggaggctgaggcgggcggatcacttgaggtcaggagtttgagaccagcctggccaacacggtgaaaccccgtctctactaaaaatacaaaaaaattacccaggtatggtggtgcttgcctgtaatcccagatactcaggaggctgaggcaggagaattgcttgaacccctgaggcagatgttgcagtgagccgagatcgcaccactgcactccagccagggcgacagagcgagatacatcgcaaataataataataataaaaaaaatacaaggaggtaaggactaacttgtcctacacttgacccctccttgtgccttagtttcctcatctctaaagtggggagaataatacttgtcccacagtgtcattgtgatgattcaatgagttaaaggaggtaaagcactcaggagaggatctggcgtgtagcaaatggtcaatacgtattagctgctgctgttattacgatctgtggcatatgtgtttgtctcctccagatgaggaactgaggggtgaattttgcttgtcatagcttggggttgggcgatgttaccagcaactagggtgtggtccaggggtgctgctgaacatctatgatgcatacagcagcttccctgcccccaccaaaaaatttttcagaccccaaatatcagtagtactgaggttgagaaaccttgcttagaccttggcgtgtgtgacccttggtctgactgaactcttctaacaggtctagaccaggtgcagtggctcacgcctgtaaccagcactttgggaggatgaggtgggaggatcacttgaggcccaaagtttgagaccagcctgggtaacatagagagacccagtctccaagaaaaattaaaaaaaaaaaaaaaaaaaaaaaaaagctgggtgtattagtcagggttctctagagggacagaactaatgagatagatgtatatataaaggggagtttgttaaggagcactgactcacacactcacaaggcgagctcccacagtaggccatctgcaagctgaggagcaaggaagccagtccgagtcccaaagctgaagaacttggagtctgatgtttgagagcaggaggcatccagcacgggagagagatggaggctgggagactcagccagtctagtcttttcacgttcttctgcttgcttttattctggctgtgctggcagctgattagatggtgcccacccagattgagggtgggtctgcctttcccagtccactgattcagatgttaatctcctttggcaacaccctcacagacacacccaggaataatactttgcatcctttaattcaatcaagttgacaatcaatattaaacatcacactgggcatggtagtgtgcaccttgagtcccagctacttggcaggctgaaaaaaaaatcctctaaaccaacattttcaagggctgcctcaggctcttatagagtcagagtgataaaggaccttacttagctcaactggaggggctgcttgaatcccttccccagtgcccttgccgagccctgccttcagccgcaggtagcacactgtacagccagcttgtggtctgttctttattatgttgaactctaatcttccctgaaactttctgtccttcattctaagaatagtagctcccatttttggagcctgtgtgtgggtgattctgcttagcattttccacgtgctactgcaacgatcttccccaccctgtgaggtggttctattaccatccccattttacagatgtggagatggaggcttggagaagtcaagtcacatgcacaaggtcactcagtggatccaggtccatcttgccgtagaatccacattcctcaccattcctcaccactggcctattctgcctggtctgtacccagcaagtttactcactcattcatggaaggatctttagatatttgcagtgaatccctcagccatctcatctctcctcctggtcatagagccccagttcccaaagttcccctcaaagggctgtctggtctgcttaccatctgtaatgatctctcttgcctcttgacaacacctgtctgtccctgggctctgcctctgtctgccaggctgccccagaggggctgcccatcttctgccaactctgctgatgttccatcaactcagactctctgtgccaatgctggctgcggtcccctggatttcatctggttggtgttttcacttcacagtgacccattttcagtgataccctatgagattcagcttacctgtttgaccattgagaatctcagccttggttctgctgttcccttccagcacccacccatgcctgcacctgaaatccacgtcattcgggtggagcagaaagtgtgaggggctggaggagtcaggaggttgagttgtgaatataatccagccgtgtggactggggaaagcctctcaccctctcttttttgtgtccttagtcgtaaagtcaaggtttgacttggatggtgcctaacacctcttctagctctaacattcttttatgaggtgtgttaacagcataaacttataataattatacccccaattgtggtggcaatagtaacaatagataattattgcagttgctataattttcagtgttttaagtggactgtctcattgactcctccaataatcctctgggtaggtgctattactacccccattttacagatggtgccttaaggcagagccatgtcaagtcacttgtccagggtttaccacctgctagaagctgataggcctggatttgcagtcttctttagagtgactaaatccttgcattcccatggatacttttctgcagagtgatccgagtgaatcccatggccctcctgctttagggtcttgtgatttacctctccctctccccatgaccaagggtatgaaggatgcttgattgtaaaagctcatcccctaactcatgcttctggggtaatcttctgtaccccagctccttgcagagtgtgattattcagacatccttttagaatctaaaattcaggcagtgatgatgacggtaggaactaccactttctgcacacttactatatttcagacacattgatactatattgtcattattcacataaattaacaacattactatgctaaaattatttactgaataagggtacttcctgtcagtcatgcctgggagatgctattgtcccccattttacagacttgaaaactgaggctcaaagaggcctgttgtggctaaagaaacattgcagtgtgtctgtctgagcttgggggcagggaaggcacgttctcaaaagccatattcctttccaacacattttaaaggaagtatatcacatgataattgtgaaagatgtgacgaaaagaggttagcggagtctgtgagagcaaggctatgagacctgtacagaaggtggacaatgtgattctgtctccatggccagctccatggctcctagcctgggctggggcccctctgttggcgcctggccaggtccctctttgcaaccctgaactacagggctggacagttgcactctccacctcctcaaaccaccttcaaactggattagacatgggcagtggcttcgaggtcattgagaggctgagcaggggtccaggctgttttgcggcccctccctctgtcccgggtcctcagagactctgcagggccggggcaggtggagtgcagacagggctgctgagaggggaacaggccgttgccgctgctctgcgggaacatcccagtgtggtccttggtcccaaggacttttcctgggacctctcggcatccctgaagccatttctggaacggagtgtatccactgaagacctgccatcccggatctcctttgtcaggctgtgagcctgagtatggcccaaggaggtgacttgaagatggctcttggggtgaggggaggccagatagggcagggcttcatcgggctgagcagtaacatggccctgtaccctttgtttgaatgcggctgggccacaaacctgccggggtagcactccccaccacgctgggcgtccaggctggaggtcttggggccgtgggtctctagcatgggcctctcctgtggctttgaccttcctctccttgctggacccctggagcactgctaaggagcaggtgccaccccctcatgctggagcttgagcctcaagaccaaggctgccccaggctggaggggaggatatagttgtatggtgtgcgttcagctgtcagacctcctctgcggaggtgcacaaggccactgtcaaaatccctggttttctgcacccacgccactgttccagccctctcccacgaacgcaccacagttccagccctctcccacgaacccgccacagttccagccctctcccacgaacccgccacagttccagccctctcccacgaatgtgccacagttccacccctctcccaggaactcaccacagttccacccctctcccaggaactcaccacagttccagccctctcccacgaacacaccagcaccggtgcaaaaaagagctcgcatgttgtcatcttggaaacagtacagcgcgtggtggggtgggacctacgacaggagagtttggtggctgggggcagggagaggatgtggggtgggagtgcagaggagcaagagcaagtcctctgagacctggtcccgggatcattttgggggagctagtcctgtcatcttcctcctccccactgttcactgagcacttactaaatggcaagttttttacagatgtttttgagttaatctttttaacttttatggagcgctgttactatccctgttttactgcaaagggaactgaagtttaggaaggttaatctgaaggtcacacagccagtaaatagtggatctgagaactgaatccagctctgatgcgtcccgaagtgcatgttgttgatcaccgggtcacagccaccatttcctcctctagcctaaactttgcggtggctgctgcttgttggggaaactttccagtttgagaggtgcccagagcccccttcaaggcagtaatctatggggcctctgaggattgggggttttagtaaagccatgttccagggctttgtccaggagacctgagcaaacataggtgtgttttgtttcccagggctgagcctggcttttccaggaaagggggctggctgctttcaacagcacttttcctctttcaaaagcagtgtctttttacgacagcagcctcttcctcctttatctcatcccaaccccctccacgactgggtagtaaacagtgagaatttatagcccccagctgggcgggtgggctcagggcagtgcctgctaggaccctggatgtttcaggccacattggacctgaaagcatcccttcgagttgctggggctgacacagttcccctcaaggaaatagaaaaccttaggctgaaggttcagtgctgggggactgggagtgggtgctggggatggccaagatggtgataaatgagaaaagaccacccaccccagtgtcaacgcacactcaagtgtgaacgcacagcttgaagacactgggcagaccagtgtcagctgggagagaatgtgcaaaaccaaagtaaattatatttgttttaaagagttaaaaatcctttaatatttttctaccaataaaaagaagttaaaataaggataaaggctaaaggccctctcatctcctgcagtgccagcagcggaggaaggatgcttggtacatacgcttccctgtcctgctgcgtcctctttcctccgagctgtcttctgtgtccagggggtccctaagagcactgtttgtcccatcaccccctgccctgagagcattcagcctcacccacaaggtgcagttggatctcccaggaccctctcagctttgcatccagttccccacttgttccttcacctggctgcccaattcttacgtccactagaatgtctgctgcacagaggcagggacttttgctgtttagttcactgctgtgtccctgactctgtgccctgggtctctgggatataaaggtgaacattgagtttctacctccaagagctcccaggctgggggtgtggagctgacaagtggctaggcataatgggtgaatgcagggtgctatgggtgtgtgtccagcccagacagagcaggtggctatcaggaaggcttcctggaggaggtgatatctctacccagtcttgaaagatgagtgagttagttaagcaagatagagaggacattggaaatcagtgtatgtcccctatctaccctgatctgtgtgccagtcttcccagagctctgggatagcacaatacgccgtttctcttcatcatgggagtaggctggcctgcagagtggagatatgtttgcagggagagagaggtattccatattggtaagttactagtgagacatgattgaaaaattaagcccaaagtcacagggtatcataatgctgtccctttctccccgcctgtgtggagggatagcttctgtccccctgttccctttcttgttcataggctcttcaacttttgctcctaaatctaagcagctatttcttttcccctgatactcgctggtgtgatgttcttccctcttcctacccacttattgccacttcacctttagagttccccagggcaggaggaagggattggggagcatgaagctgtgacctttcccatgaggaagagtatttctagtgtggctcctactgtcacatgaatgatacactgcccatcctttgaattttgcagggcaggtgggaagagagctgaatggctctggtgttgggtgagccccatgtaattggtagtgccatttggtgcagagaagtctggagttgccaatgaatggtttagatctaaagcaagggagctcttctctctggttgccacagagtggagacagctggagagagacacctgttttagatggacatgtaaaactgcgatgcatgcttttgtttctcatgtttgttgagacaccctcttcctgtttgagccactagctggtgctgttggcacaggatggcttagttgctgcctcacctgatcataatctgcttaatagagaagtaactatgaagctgatggtctttgatttgacctccttacattccctttctggaactcttcatgcttttgcagcttagggtgcccctatccccacccaaagcacacacagatacacattggggtgcttactcttctcccttgtcctgacaccctgcatctgaattctgttctcagcaaaacttactactcctttctcttagctggctgccaagtgagaaaggatttaatatactaatttaccctaaggtatcaacagggcttaatatgttccttcggggttactctgtcttaaaactgtgaagattgaaactaagtcttataacttaagaggtaacttgtaagaatggaattgtggcattttcaaatgtgggtgggcatgagtctttgagagagggctgggaggcggatgttaagggaatttgctgcttcatgtatcctgcttgctcccacccatgtagcaggctctgtgtagggtccctcagctgctgccctgtgggtagctcagtgcttggttgatgcagtgaatgagaccatggtggggcaactgtgttgagaggctctgctgagtaggtgtccacctcccaccccctggcaccattaaatggcttgtccaatgagggtgacaacaccagccccctgaccacttgcccttcttgtctctgcccagacattcacggcatggtgtaactcccacctccggaaggcggggacacagatcgagaacatcgaagaggacttccgggatggcctgaagctcatgctgctgctggaggtcatctcaggtgaggcggaacctggcccaggacgagatactgtctattggtgctgcctgacaccttggcatctgctctgcctatgagcgcagctggttttggtctcttgaaacaagttggggatgacatgtatgaattcatcctaggagcgtgggtctgagttctggttctgctgccagccatccaggtgccttggacatttgtttcagcatccttgtttgttttaaaaaaaaaaaaaaaaaaaaaaagggtttgaaggaactgaggttccttctcctccccagtgccaggattctgtggccaagaatgttaaccatgggtgactgtctccaaatcttggctccattactacttatctacctgtatccaggtgacccaggccattccccagcccctggtttgtccagatgtctggagggacagctctactggaacacacatctcatcctgcttatgaatgcctttctgccaccatcccttaaggggtgggagtcctgtgagtctagccttggttgatacactgggccatgttagctactctcttcaccttgatgccggtgagccttagacctaatcccagcccagccctctccctcgagccacctctgaaatgctgaacctcgctgggcgtctccaccccaatgtcccacacagtcctctcagcatgtccaaaactctgtgcttgtcactcctgccctagcaaacctcttttccctcccagagtcctgttcttctgcacccaagctgggatcatagacagctcttctttgcaagttgttactgatgttctgtttattctgattccttcttctcagtccttcttttaacccctactgttgtggtgtcagtgtggcctgtgtcaactctcacctagatgatcccacaaaggcctttaccccagctcttcctggcagtccacccctgtcactgtagccagagggcttgtccgacagtcagtccaaatatggtcacactgttccctctcacagccctcagcccgcggtgcctctccagggctttgagcctgcaggccacattccttagcatagcttatggaatcctgcatgagctggcacctgctttgttttcaactaactattcccaaaaaggtatcagaccttcgatcctctgccagttgtggggtgggggcagggggaacgtgcagctctccccagatgacatgcactttctgtttcctgtgcctttgcacaagctctaactgccctttttttttaaaagtagttttttctactttcagataaaacctgtgtgtgtggtaaaataatatataacagaaaatgtatcattttagccattttaaagggtgcagttcagcggtattaagggcatgcactgactgttgtgcagccatcgccaccgtccaccttcagggctcttcatcgtctcaaactgacaccctacagctgttcaacactagctcgccgctccccccggccctcccctggcaaccaccattctactttttgtctctgatttgactactctaggtataccttgtacgagtggaatcatacagtatttctccttttgtgacactggtttatttcacttactgtgtcttcacggttcatccatgttggagcatgtgccgccatccctttcctttttatggctgaatcgtattccattgtatgtatgacctacagctataaaatggctccccacattttgttcattcacctgtcggtggtcacttgggttgtttctaccttttgggtattgtgaataatgctaggacatggttgtacaaaatatttttaaaatccctctttcagttctttttttgtatattccccaaagtggaactgctaggtcacatgggaattctctgtttaattttttgaggagccaccgtgctgttttcctctgccgttatttatttatttattttcttttttctttgagatagggttccaccatgttggccaggctggtattgaactcctgacctcaggtgatcctcccacctcagcctcccaaagcgctgggattgcaggtgtgagccaccgtgccttgcctctaactgccttttagaatgtccctgcttcctacctcctccactacccttccccagttttaaacaaatctggccttacaatttatcattcttcaaaatgcagcttgagggtgtccttcaagaaggcttcacccttcctctctcccctaatctgagtggactgtgccctgcccgcaccacccccctacctgcccagctccccagcacctataataccccattaattcctctgctgtgtcttttatcacaaagtgtagtcattttcggttcgcttgttttcttctctgctccacactgagctccttggggcaggtcatcttctctctgtgtctcaggtgcttagaacagcaccagacatgtaggcggtgctccgggaacattagaatgactgagtgcccagagccgggcttgtcctcatgatacccagtgtgttcctgctgcataggtctgacgtgtgcccaggggacctgtgcatttctgtgaagcatgtgtctctttgccagggttgggaaagatctgttctgtgaaatgatctgttctcccctggacaggaaatgctgggatacctttttctcctgatcatcgttggagatgggtagggtgccccaggatgaggagaaggaggggtatgctgcctacagaggttctcaaagtgtggtccttggactacccacaccagaatcggcaggattgcctgtcaaaatgcagatttccaaaccttaacccagtcctcctaatcacaaacttagtgagagggggaaaggggctggacagccacagattagccagttctccaggtgattttgtgctgactgacgtttgagaaccactggcccaggcctgggaagctttttccattctcccgtgtttaacccttgcctcctccactgtcctttgcagaagcccccttccagccagtgtgcacagctgctgaatggctggggcactccgcttagctggacaggccccaagggctggggctgtaacaggagcagccttccagggaggggacgtggtgctgcctgcatccatcctgtggggagggagcctctgtgccatctccccccggacaggaaatactggggtaccttgctgggttgcagccagagccttgggagggccccaagtggaaagtcttgatttaatttaaaaaacagctgtgcttccctgggagctgacagccagatcccatctgtggcaggaagtctgccgtcttccagaagctagcaggctgctgggaggccacctggagaggtgctgctctgacagggtgggcctggcccagaatccccgtggctggtccctggagtcctcgcagccagattgtcgacctgctggggagacagtgggtgtggtcgggatatcagggcaggcacaaggggcctgaattccaggctctgcgatggtggttctcagccttttggggtccttggccccttagagaccctgaaagctatataccccttccctaggtatggctctatgctgcacttagaaaattctcagatcatttcaggaggcccctggatgctctttgttctggaataaaagtgctgttaatggggtatttggagagccagctcctctacctttattttctcaaaggttctgaccttgaaacctgagcagcagaagctactgtgtggaatctggaggtgggggtggagggttgacctggagctgagccctgggtgcccacaggaggcagcataataggacaagaactgtggttctcagatggggatgggctgctataggcaactccatttaaacaccagggaagtccataatacttgagtgacctataccctcctcccagggcaaagggaaggctagaaggagttcagggcctttgcatgtactgttccttctgccttgatcatcattccttgctttgtttgcctggctgcaaagactcagacctttcctgaccactcctcagttcctccttcctcttcctcctcctcttttgaagagcatggatctttctttgtatttgttcattgtatatatttatttgtgtttctctatttaaggtctgtctctcctactggactgtaattacataaaggcaagaaactgttttgttcacccccctattcctagcacccagccaaatccctggcatgcggtaggggctcgataaataaatgttgagtggatgcaagcagatttcgacctgagaagcagaagaaagaagaggcagggtagattctccctctcattccctgccagggtgacattctccagcccctgagcagcgtgtgagcacacacacacgtgcacacatgcacatgcttctgcctagctaagctgtgctttggatgagggtgtagtggtagtagctctggcccctggctcatagcgtctcaccttcctcttcctccctcttgatccaaacaggtgaacgcttggccaagccagagcgaggcaagatgagagtgcacaagatctccaacgtcaacaaggccctggatttcatagccagcaaaggcgtcaaactggtgtccatcggagccgaaggtaaggcctacctctggtggccccaaggagcctgattttctttgtccccctggttctcttggccttttttgtgctgcctcctgggcccatgcatcacttgggggcattgggcagtgggtccccagcacctccatctggtcgcctgtggaggctttgtattgcaacagcgcttttcttctagtctcagccctgcccaaaaccaaggacttagacccctgttcccatgcctgcacctgcttagccacgtccttgctctgtggagtcctgtgtgtgtggcatgccacctcccccatccagaggcctgactgcacggtgttgcctggagcagaggatttgtgtatgggctggaaagggtgtgcagacacaggctggtggaggctggaggctgccccgagactccccggggccctgggaagactgaagtcccgaagcctctaggaacatttttaatagcatttccctgcagtgtagcttcctaactctttaacttttacttagaaacacttaccaaaaaagctattagcatttccttaatgattaaaagaaggtagtgtaatttcttgtgtgcatggtggtggctctgaaaaattgagagtgggttgtttagagtgggcagaaaatgttctatccaggccccttcagtcctgtgaccatggatttagcaagtatttatggggcacctgctgcgtgatgtcagagacctaaagatgaacgaatctcactcattcaagacacatcgtggctgtgagaatggattgctcactctgtggcatatacttaatcctcacaacaaccctatgaggtagctctaagaattaattatcctgattttgccataagaaaacagatgcttaaagagattacgtgacttcctcaaggttccgccatcagtaagtggcaaagccagaactcaaacgcaggtcttcgtgacaccagaggaatgccctgagagtggccttcccttggagggggcaggggtcttgctcctgggaagtccataggagcagatctcttctctggttgaagcttacagtcccctctcttctagaaatggagggatatttatcaaatggagaactttaacacaggctcagcaaactgcagtgcatggggtcgagtccggctgatttggatttttggaaatattggaacacagcacaccggtgttaatgtatcatcagtggctttgtgctgcaatgacagagttgagtagttgctacagagcttatatggatcatagagccagaaacatttcttatcaggccctctacagaaaaagtttgctcacctctgccttatctggaattcaggccagtgcccaaggtggtcacgcaaggtgccttatggattccagcatctcccccaccagctgtgagcttctcaaaggcagaaaccttggtttctacatcctgtggccccagttcctagcagcatgatgcacacagtaggtgctcaatacatgttaaaaggatttacatatagcagtataatctgctttgtgatgaggaagatgttctctgccttataataagaaaagaacagtttgctttattagggagcaattcaagacttggcagaaaaagttataactaagcaggcgtgggaagccaaagaaagtcacccaggtggttagtgcaggctcggatgcccctggggcagggaagtgtagagaatttgtgaagtggttcaggggtcagtggcaggggtgggtagggaccgtggcaagctagagagtcatgtcctaagcgggatgggcaccttgtggatgtaagaagttgctgctgtgtggatccagtgctgctagatcttccagtttttcaaaagaagccagaaatccagattttttgaaaagaaaaatttggcaactaaatttaaaaaaataacttgtttgctctttaaagcctctaccaaaggggaggagggcagggaaggggaaggtggaagagaatagcactcaccgagtacccgctctgtgttgctagacagggtgctttacgtgggccatctcctgctacactcatgatgggctcgtaggatgggtatcaccagccacgttttacagttaaggaaactgaggctcagaaaagttgctagagtggaagagtgtcatcagttgagcccaggctctgagccagactgcttctatgtggcagatccagggttaaacccaggggtaggctccagagctgaggccttcctcttcctgttactgtcggcagtgctgcctccccagtcagagcccaggacagaactttcttttctttttttttttttagtagagatgggatttcactgtgctagccaggatggtctctatctcctgaccttgtgatccgcccgcctcggcctcccaaagtgttgagattacaggtgtgcgccaccgcgcctggcctaagatctgaaacttctttttttttttttgagacggagtctcactctgtcgcccaggctggagtgtagaggggcgatcttgactcgctgcaagtccgcctcccagtttgacgccattctcctgcctcagcctcccgagtagctgggactacaggcgcccaccaccacgcctggctaatttttttttaaatatttttagtagagacggggtttcaccgtgttaaccaggatggtctcgatctcctgacctcgtgatccacccgcctcagcttcccaaagtgctgggattacaggcgtgagccaccgcgcccggccagaactttcacatcgaattgtcttcagtactgagatggcagatcaagcctgcccctgccatgctggcctcaggggtgaggagtgagaggaacactggcgtgaactctcatctcactgctgctgctgtgctgggaaggtcattcacctggcagcctcagttttcccgtttcctttgacgcaggcctagcttctctaaagattttgaaaaggctcctttattttttattttttgagacagggtctcactctgttacccagactagagtgcaatggcacgatcttggctcactgcaacctccacctcccaggctcaagtgattcttaatctgcttcagccttccaagtagctgggattacaggtttgtgccaccacgcctggctaatttttgtatttttagtacagatggggtttcactatgttggccaggctggtcttgaactactgacttcaaatgatccgccagcctcagcctcccaaagtgctgggattacaggcgcaagccaccacgccccgacgaaaagttcctttaaagtgagacgttctttaccttctccctgccctgaggagccagtgttttcagctgtggcttccaggagtgaaatcatccactcccatcaggctgagcaccaagattatgccacaatggccgctctgctgagccaagaaactagatgaggcagcaaatggcgttttgtgggcttttaaaagtgaaatggagtttattgatgtcgattataaaataaaaggcgatgggcagatggcatagaatgagctctcctggaaggggagcgggggaacgttgcaggttgtccatcctgggctgctgaaggctgtgactgtggagaccaggcccagcagggacacccctcaccccccaccaaagtctttgaaggattatcatgcagtgcaaggactaagacctctggctgactccgaagggcagaaccaggcccagaataggtaccctgtaggtaggtggactctgggagccttgggaaatggagccggggctctgggagggttatgagttccctgtccctgaaggtgtgcacatgaaggctggagacaaggagcttccacacataaaggggaggttagagcagatccttaaggtctcccctacgatatttggttctagaatgcatagacttcatggaattggcctgggtgagtggttggaatgtagttaaccaggggagagaactcaaaaaggattttgtattttaaggtctttgggcaggtggagcctgagggtttgggtgctgtgagcatggaggtgggctcagtgaggtagcatgtatctttaggatggagggggcggtgggtgccataccacagcattggtctgggaggtggtggcccctggggttctagtttctgtcacatggaatttctgcagcattcattctgccgtctgaatactgaacagatgacggtgtccctggagagagaaggagggagaaacatgttcccagtaaacaggggatgtgagcagcttcatagctcgctgtagaccaagaaggtctacattacagacgctgttaatctgtcaccaaggtttttccacaaagcccagttgtggccttggaaccctccctttggggccagccttctaagcagtccctgacataaagctgcctgagagatgaggcacccctgctgcaaacgttgagaagccggaggcccggtatacaggacctgccatgccagggaaggggaaggagagtggatgggatgggagtcaggtgggaactggggctgggcgtgcatgggctgctaattaagcacgccctactctctatgctcgtgcttggcgcctctgttttctggagtgaaactatgcctttggtgtgaatgagaattcagtaagcaaaattctctggggagtttctggggaagaagaagaggaataagtaggcaagaccctaaaaagaagccacctgcctctcccagtccctccgggaggactccaagagggcaaatctgcaggcagtgagctcagggccagcgggaggccctggagtttggccgtcacagagtggggcagcatgtgggggaccaagggagggctagcattgcagccccactcctaggaaggccaaaccatgggattaccactcagagcttttttctaggcttaaaaaatttttcccttatattttaaacactgtttatgaaattttttacctgcttttcccacttcccatgctaaaaaatttttctaagttattaagcactcataagcattaatgtctgcgttcattgtcttttttgttttgtttttttgagatgagtctcgctctcttgcttagtctggagtgcagtggcacgatctcagcttactgcaacctccgcctcccgaattcaagcgattctcctgcctcagccccacgagtagctgggattgcaggcatgtgccaccacatctgcctaatttctgttttagtggagacggggtttcgccatgttgtccaggctggtcttgaactcctgacctcaagtgatctgtcccaccttggcctcccaaagtgctgggatttcaggtgtgagccactgcgtctggcctcatcatctgtttgtcgtacttcgtcccaggcctgggccctgccctggaagagactgaggtccattgtgttctcagggggccaatggcaggcctgtgttagctctgcccattcccccacttgtggttagtgtttgttcactcattcgttcactcagcagatgctgatgggggctttgcctgtgccaggcttcatactgaactctaagcagtgatgcaaaacaggaagtattcttaccctcaaggggcttacattctagaggggaaagagagaaaatacacatgtacacctgtcagatggagaaaaccaaagcagggaggaacttgggtggtcaagggaggtgtccatgagaaggggacgtgtgagtgaaactggcaggaggcagggacaggccacgtgggtatctagggaaggggagctgcagggaggcccgagcaggggggacggggaggaggaggaggagaaggaggggaagaaggagcagggggaggagggggaacaagaggcccaggcggccagaccacgagggcctctctggccactggctttgactctcagggaggtgggaagctgtggaggttttttagcagagggtgatatggggtctggggatttacttggtcattctgtgtactgtgtacctttgcgaggtttctaagtacggggtgtgataaatagccttgcagcaagtgcattcattcaggaaccttactctgcatttcctttcattggctagggatagattcctggagataaaattatactgccaaaaagctgagcaactgtaaaatgcgtgctccttgtggccaaattatttcccagattaattgattaatttcccagaaattattattattgttttttaaaccaatttacacttctagtgtggtggccttgctgacatcaaggcgtgtggttttcaactttgggtttttttgtttgttttgttttgttttgtttttaagagacagggtctcaacttgtcgcttaggttggagtgcagcggtgatatcacacagctcactgcaaccttgagctcctgggctcagtccccagtcctcctgcctctgcctcccaagaagctaggactacaagtttgcaccactgcacctggctaattttttcatttttttgtagagacaaggtctcctatgttgccccggctggtcttgaactcctgggctcaagcgatcctcccaccttggcctcccaaagtgctaggattaaaggcatgagctacttcacccagcctaactttgttttttaactttgctaatttaatagctgggaaggtgatcttatttctttgattacaagtgagattgaacattcttgtgaattggttatttgtatttcatgttttatgatttttttgtcttttgcctatttattgagagtttagtatttttcaattgtcttttcaattgagatgaactctttaaaccattggaaataacaaatgaaagtgcattttttaaaatatcaaagatttatgagccgattcctttacttttttattttatttattcatttttttagagagggtcttgctttgttgcccaggatggattcacagctcactgcagcctctgccttggctcaagcaatcctcccacttaagcctgagtagctgggactacaggcactaccatgcctgtttaatttttgtatttttgtagagatggggttttgtcatgttgcccaggctggtcttgaacacctgggttcaagcaatccacctgtcttggcctcccaaagtgttgggagtacaggctcgagccactgtgccaggtctatgagttgattcttgatgagtagtactacctccccacaatgtggactgcaaaatgctggctggctgtgttgcttggtagcaaaaggggttgcatgctgctcagctctctgtttctctccaacccaagcatttggatgtgggactgtgccccgcctggtgtctggggctctgggaggggcatttttacttccctgtttacaagaagggttacatcctattccaagtccaaagtggacacttgttcctttgctcagcatcccatgcagactcagcaggttacccgctcccctgggaggtggctgtggccaagcactgctccatggactacacccggctggtcatggaacagcatacagttttgccctcacttttgggaaaggggctaagatgttagagtataccatccttaatggaaatccactcttgtttcaggggtttgtgggatgcaaatcctagtagggtcagaactgcctagaaattgatccttctcatggttctattgggtctcccctaaaattaatgttgcaggtaggaaaaaaaaagatattctttgggtaccttactcttaactgagcgtgtcttaccatgggccggattactatctcctggtctggaagcaggtgatgagtgggtgtggaatctacatttgagtatcacttgttcaaccacaagaccatagattgctccatgtattgggctccttaaaatagggcttatttatgttgtattccctgccattaggcctggtacagaaaaaaagagaaaatctacttcatagaacttgtagattctaaaactctaaaaggtgctgcttagactaaatatattgggttatctcttagctgtgatcttgaagctattgtttgattttttaaaaaaacatctgttttaatacccaaactgatggcattgtgagattgagtcagtggatagttcaagatggcaatttacaaaactttaagtttgtgactttctcttgattccactgtttttccacgtgtgggtggctattttgagagctgtgattgcccagagagccccagctcacagaattgccagaacatttgtgattgcttagaaatcctcccctcttcatcaggctgggaacacagatcaggatttcaaatgcccccttctctgtggccttccctgatgtacccactgtctccaactaggattgattacaccctttttttgtgccccaaatagacttctcttccagcacctgtcacagtttattgcattaactttaagaaacatccaggccaggcatggtagctcatgcctgtaattccagcactttgggaggctaaggtgggaggatcgtttgaacccaggagtttgagaccagcctgggcaatatcgtaagaccctgtctctacaaaaaatgaaaaaattagccgggtgtggtggcctatctgtagtcccagctacccaggaaggtgagatgggaggatcgcttgagcccaggatttggaggctgcagtgagccatgattgcaccactgcacgctagcttgggtgacagagcgaaaaccctgtctcaaaaacaagcaaaaatcctgtttccctctagaagtagagctctggagtcttttgattcctagcgtggggcatggagtgctgtgggtgctgagggagtgttaattctgtccccgctgaggccctttctgatgtgtgctgctgctgtttctgtagaaatcgtggatgggaatgtgaagatgaccctgggcatgatctggaccatcatcctgcgctttgccatccaggacatctccgtggaaggtgggtttctgctttgttccatcccgccatcaccatctcgtctccctccctgggcttagcctggagaactcccatacccagggcaacggacgttgatcaggggccatgtcctgggcttcttgctcatttattgggcatcagccttctcctccagtcaatgtagaaaaaagaactgtttgccattctgattctcataggcatgttggcctcagggaaactccccactttgggaaagcccaaggctgccatggggaagtatattggaaaacccacctggctcttgggttgttaatctgaaagggtggggaaatagcggctgggaggaaggaccaggaggggcgctaaccccgtcctccactttgctcccctagcaccctctagtggccatttcacagatctgcaagggccgccatggtctggagaggtgatctctacgcttgattccacactcgggcagtttttgagctttatgtctgctatgcctgtatttatcttgcataataatatttgtgtattgttgtgcctgtgataaaacacacatactgaaacaaacttttacaagatgagatggagatactattttttaaatatttgttttaatggcatagacatcataaacatttttaatcaaaggaatttcttaatgaaaacaacgtggattcaattcaattgctttgtgatggagatctaggtgtgacactctgtgatgcagcaatgtagagttccaagttcggtttatgggtacttggtatttagggttgaagtggttggaaagagggtcatagtagtcacctggggtgtggttcttgttaatgatagtggatgtaaatccatttctcaaatagccttcttgatgattttgattcttttgggtggacttcttgtcagctctgcagtcatcattgtgttactcttgtgatttagctgacgaagagcttaagctaagtagaagcattagcttttccaatttttaaattgtctgcttttgcttaggtggttatggtctttgtaggaacccttgaatgtcattttaaagtccattttgtgtgttgaaaataaatgagatcattcatgaacacagtccactgagtaccttaacctccaattcacaggcacaaacacagggtgtattagtccgttttcacgctgctggtaaggacatacccgagactgggtaatttataaataaaaagaggtttaatggactcacagttccacatggctggggaggcctcacagtcattgcagaagagcaagggagagcaaagggacctcttacatggcagcaggcagagaatgagagccaagtgaaaggggtttccccttagaaaaccatcagacctcgtgagacttattcactaccacgagaacagtatgggggaaaccacgcccacgactcaatcatctcccaccgtctctctcccacaacacgtgggaattatgggagctacaattcaagatgagatttgggcggggacacagcacaaacctagcaggggggtagtgtggtttgcagtctttcttctgtgctgggagctccgtgagccccctcagttgcctgcctaacctcatagacacgtggctgcttcacacacagagggcagcagtattgatccgtgcagtaaatataaggaaaccttattttttagattaaaaacaaaatctgtctaggagtcctaatgctttcttctcactcagctgtgtgcacccctcaggctgtgggattcccctgtctggagacccctagatgtgtagatttcccagatcaaatcttcctccccaacctgatagaggttgccgacttattttgtatcattaccatttctttgaataaaagagagtagggggagctaattcttgaagtttgaaaaactgttgtctcaaaatttacacgtgtaacacgactagctctgaacagcttcccagcttgctttttctgtttctcaaataacttctcaaactctgtcaagggaatagacttgatggccagggctcctccttcagtagctgcagggttggcatcaaagggtcacagtggggcctcctgtgagccggcatccctccctccaccgagtcagccctctgacctcgctgcccatccccttccccatagagacttcagccaaggaagggctgctcctgtggtgtcagagaaagacagccccttacaaaaatgtcaacatccagaacttccacataaggtgagtgctggggtctgaggggctctcacagaaccaggctgcctcccccgggagctcccagacccccttggctgggtcagtctcagctttagaacaaagtggagacctctgggggaagaagtagctttccttgggaaggggatgtcgccatcgctctgaatccccccgtctctctccctgcagtgtcttagatggggctgctgcctgatataactttggttgatgcttttgctactgggagcgcccccaaggaaattgtccaggaagtcccagcccagggctctggaacagcagactagggccataggccttggtcgggggtagggctggatatggcaggtttatctgaacttgtcaacccccccacaaagtcttgaccctagtgcctgggatttgtggcaggaagaaatgtcccttcccatcctgtcttctaactcctaccccagaaagctctatgtgttcatctctctggtgtctaggaggcccctgctttgccctggttgcccgtttgttcagcctcatttaccagcctgctccttcttctctctccccgggcagctggaaggatggcctcggcttctgtgctttgatccaccgacaccggcccgagctgattgactacgggaagctgcggaaggtatgtgtgcccacctgaccacccgctttgggtccctggcaggtggggtgggaaaagagcaggactaggacccttgttgtgacagtccatggtccagcctgagcagtgttggcctcttagaatagccagacagagccccaactgaaagtgaagagaaaacaccttccctgttagggcaacttcattacccttgtgcgtggtgtgtgtgtacttgcacacatacacagcccatcaggaaaatatcacagctgtgacagcagctttgtcagagggatggaatgatacatggtgtttctcccttctgtttttccgggatttgtaaagaggagacactattttcatcattgaaaacagtgcatattctaagggacagttcatccccgccttgtcctttgacctgctgtgcggtcctgggcagcttatcccacccatggatttggtttcctttattgctcaagtttggctgggggattttcttttggtttcactcccgccttcagcatgaagctgcagtgatttttcttgagtgggtgtgtggagtggggacagatgcaggagtgggagctgtgtttctagcctcatggtggttctcaatgtctgagctggttggacgacactgccctggaccttggagaagcctgtcctggaccctctgaccacactctccaggttccctcctggaccctctgaccacactctccaggttccctcttggtccatcttggtgccaagaggccacatggcatggccatccaaggaaagacccttcccacgccccaagttggtgacctggagttggggttggaatgtcgcctatctgtgctcagatctcttggcaagggaggcttcaaggagcggctggacttgtgtgtctctacttcaccttgatgctggagaacacagtgttcagtgtagctcttgccttgcctgggcctccaggaagggcgtcttgcttctcagtggccaggagaggtttaatatcactggggcaggagctgctgtgcaactcatggtggtggcaggccctttgtttcgggcgggtggatagcaagctgccaaaaaggatcttgagggaggaaaggagcagatgcctacccgcttccctgcaccgtgccccgccccacccccaccccatacacactgccccgtcacctgaagcttgaggctgaggcctctgcccactggaagggcccatctgctgaaggagaggagccacagcaggggccagcccttcgccagctaacctcctgggggaagaggatccttggcccacctcctcagctgctttgcaaggaaaaaaaaaaaaagagaaccttcctgtcctgctggaaagttgtgtggccaaatcaaacgtggccaagggggaatattctacaggtggcagttttttcttttgaaggcatcaccacttcctattcagctgatgggctttggtgacaggtgtgcacctatctctgtccctgcttgggtatgctggggtgtcagtggccagttcatccacagctgttggacatccccactaaaggggtctgtgccgaccgtggctctagagccccctcccttattctgaaggatttggaagcatcagccatttgggaggtgaaagtccaggggttctttctgatacccagttagcactctcccacgcactatccctctctgtctttttatttatctctgccagtttctccctgttttgctgtctctgcctctccttctgtgtttttttgtttttgtttttgttttgttttttgagacagagtttcactattgttgcccaggctggagtgcaatggcgtgatctccactcactgcaacctccgcctcctgggttcaggcaattctcctgcctcagcctcctcagtagctgggattacaggcgcacgccagcacgcctggctaatttttgtatttttagtggagacgggatttcaccatgttggtcaggctggtcttgaactgctgacctcaggtgatccacccgccttggcctcccaaagtgctgggattacaggcgtgacccaccatgcccagctttttttttttttttttttttttaagagagtcttgctgtgtcgcccaggctggagtgcagtggcgtgatcttggctcactgcaacctccgcctcccaggttcaagcgattctcctgcctcagcctcctgagtagctgggataacaggcacccaggctaatttttgtatttttagtagagacaggatttcaccatgttggccaggctggtctcgaactcctgacctcaggtgattcgctcaccttggcctcccaaagtgctgggattacaggcatgagccaccgcgcccagccccccttctgttttttaattgtaatttttttgtagagatgaagtctcactatattgccgaggctggtctcgaacttctggcctcaatgtgaccctcctgcctcagcctcccaagtagctgggattacaggaacagccaccacacctggcttccactccttttaattcagtatcatcatcagtaaaatccagcccaaatcctagcacacacctgagcccagtgaaccaggaacacccttccagagaacaaggaggttgtgagaccaactggtgccgaagaatagggacagagggctgaggggctccgactgggaagctcttccttcctgcagcagccatgggtgggcatggggccctggggtccctggaactcacgtggggcgggtgtgtgtatacctggacctgagcactggcagctgctgctccaggccctggatgagaatgaccttgactactcggcagtgttcatcctcctggctgctgttggagactttcccagagggaccccaccttctctgtttagagcaatttcctcctgaaaacatcctggatgatgtatttatctttgtgttaccctatacttctccctttagcaaacagggaaactgagtcctgggccgacacaaccagcttgctttaggttagtctggggaaccaagaatagaggagaagggcccagccagaaactcttccactaaggttttttatcctctgcattaaaaacttatacaataactggtacaatatacaaaacaaaatttaccactttaaccatttttaaatacacttactgttcaggggtattccgtacactcacattattgtacaactgttcctaccatccatcttcagaactcttttcttgcaaaactgaaagtctgtacccattaaacggtagttccccgttctttcctgcccccccggcctctggctgctaccattctgctttctgtctgggaacctcataacagtgaagccatatggtgtttgctgtttttttttttttttttgagacgaggtcttgctctgttgcccaggctggagtgcagcagcgcgatcttggctcattgcaacctctgcctcccgggttcaagcaattctcctgtcccagcctcccgagtagctgggacgtgccaccacacccagctaatttttgtatttttagcagacacggggtgtcaccacgttggtcacgctagtcatgaactcctgacctcaaacaatccatctgcctcggcctcccaaagtactgggattacacacgtgagccactgcacccggcctgtgtccttttgtgtctggcttatttcactgagcataacattctaagagttcatccatgttgcagcatgtgtcagaaattccctcttgttgaggctgaataatattccattgtatgtatcaccacgttttgctcatccgttcatccatcaatgggtacttgggttgcttccacctcttggctactgtgaataatgctgctatgaacaatggaggtataaagatctctttgagaacctgctttcaattcttttgagtatctccccgcaagtggaattgtaggaccatgtaataccatgttgaattttttgaggaaccaccatcctattctcacagcatttgacattccacctacgtttatgttgcattcatcgcacaaggattacagcttctcaacatccttgccaagccccgctaagtgttcttgcgaaggtagcagaagccagaatagtccaaagctgtggctatttaaaggagcccccaaatttcatgaaatgtgagcaccagaggggctcctgctccgaatcttgactagtctagagtttagagctccctaccccaactcttgagttatggatggagaagctgaggtcaggttagctacccacgagtcccactggttgagggcagagctgaaaccagaagccaggatggatggtgactaggccagtgccctgcccttggcacacgtttcttaggaactccttcctacccccgactcaggctgcagactacttcgccccattttcctgacaatctgaagcttgaagggggaaagagaatgctttaaacctccaaccagtgagccccagtggtgagaccagccttccacatctggagctgtcccctgaggatcgagctggggctgggagaaagtcgctctgctccccagtttgggtggccacccaattgggagtagccagtgacttgtggtggctctcactttatcatcccttcctccttttctccctctaggatgatccactcacaaatctgaatacggcttttgacgtggcagagaagtacctggacatccccaagatgctggatgccgaaggtgaaaggcgctttccttctgtgtctcttgcccatcgcccacctgccactcagcggctaagaaggggtggaccccagcagtccggggctggacgggaggaggcctggtcttctgggaccgcatttgaggagcatggggatcacagcctcttggggattcttccatcgttctttgagctttggagagagaggtgttagttgattctgcaaaggtcttaggggctgttcttgcatcgactgcctgaggatggttcttgtctttgccttggagtcaggatagcgggtgctggggtgtggggaaatgtgcccttgttgtccggcacagtttgggatgggaagtttcccttgctgagaggtgcactgtcctcaccctctgagccctgggtggtctctggacagctgagcttagcatctcctctatgccccagctctgactggggctggctgggcatggtgtttttctcatctgtaaccctggcttccttctagcatcttctgaggagggtgctagagaactatggcttggactttctcagtggtggaagtgtccagttctgatctgtctgggaagatcccagccagaggcagtggctccatgttgggtagggaaggaaggagggggcccaagttgagtgttgacttttctgttcctcaccaaggccttgctgtcccagatgctgctagccaggatgcctggatggggacaggttcagggttcgacactagaacatccttaccaaagattgggcctggggctggaaacccagctcttcctggctgctgaccttaccattgcccctctccctgtgtagagcgtctcggatggggtgagcaggggctgtggggggaagggaagcatctgggagcataggggtctgtgggcttatgaagccagggctggcagctccaggctggggtcaggctgggtcttgtcccacctccgcgcttgccccttgggaggagcctgactcaccacagccccttccctgtgtgctctccttggccccaactgctcagtgctgaagggctagaaaggggttatggagacaggaaaagaccacggtggggtccagactgttccctgcccctctgccccaccagtggcttttttttttttttgagacggggtctccctgtgtcacccaggctggagtgctgtggtgcgatctccgctcactgcaacctccgcctcctgggttcaagcgattctcttgcctcagcctcccaagtagctgggattacaggcacccaccaccggctaatttttatatttttagtagagacggggtttcaccaagttggcaaggctggtctcgaactcctggcctcaagtgatccacctgccttggcctcccaaagccaccagtagcttttaaaatttcaaaatgtcatgaggaaaattttcaaacgcataaaaacccaggcaaaagcagaaagaatagcacgatgacctttcctatttccatcatccagatagaatggctactgaggtcttgccacactttgtgtttttcttgttttctttgttgaagtatcttaaagcaattctgagatatcacatcattttaccactgcatacttccgaatacatccttaaaaatagagttattttcttagtcaatgataaagttatcacatttagcaaattgataattccatgtgatacccagttcataatgaaatttccctaattacctatgacatttctttgagggttggtttgttttaatcagaatccaaacaaggtccatactggcattcggttgtgtttctgacagcttttcccatctctagtacttctctcctccctttgaccccttttattcctgccaatgaacttgctgcagaaatggggccgctgtcctgtagcaagttccttatactgggtttgtccgcctcctttggggcttcatttcacctgttcctctacttacattcccataagcgcaagttgacgccagaggctggttagattcgggctccacattttggcaagaagacttggtggtgctgcgagcttctttctgcctcacgtcgggggtgtatggtgttcttggaaccagctggctttaactccagatttttcttgacagacatcgttggaactgcccgaccggatgagaaagccatcatgacttacgtgtctagcttctaccacgccttctctggagcccagaaggtacccggggccccctgctccttccatgcccagcacacctcctgctggaccccaaaccatgtcctcctgcccgcctccacctctcctggtgacaggtatctggatggtctggtctctcggacagaggcagtccctagttctgaagtggcgtgttgttcttacctggctcccgtcccaccccacacctctctctctcatcttctactgttaacaagaaaattgggcagcagctcactttctgggacccagatgactggcttaagcaggaagggctgtgtgcatgaggcagccggggtggttctggaaggctactgaaaggtgaacaggagcagcccttccatgcccacgtctgttgaagccactggctcgatagagcagctggagctcccttagaagggcaatgctgggagacacctccagtcttcacttacccacttggcaaaggcatcataaagccccacctttgtcctgctcatgggcatgacttagcagatctgtcctcagccccttgggctctagtgccttctcctgtatcctgcctgggactcccatgcggccatgctgcactctgtgttctcagacataagcagaacctctgggaggaagggagaggcggtgggcagctgtgagccccgtcaagtgtcctggcccagttttgctccgggaggcctgagattaaagttcagtcgtgcaggttctgcaccacacaggggttccacgactaaagggcactgtccatgctgtggacattgaagatttgaacattttcatcaccaggcttaggcagcatacacccctcccccagacctccctggtaggcaggactccagaagaagcacaacatcaccatgaccacagaatcttcacgtctcatgcagatctcctgccctccacatggcatctgagtgaccgttttaaaatgcatgatgaggccgggctggtggctcacgcctgtaatcccagcactttgggaggccaaggcaggcggatcacttgaggccaggagttcgagaccagcctggccaacatggtgaaaccccgtctctactaaaaatacaaaaattagccgggtgtgatagcaccctcctgtaatcccagctattcaggaggctgagaccagagaatcgcttgaacccgagaggtggaggttgcagtgagccaagattgtgccactgcactccagcctgggtgacagagtcagactctgtctcaaaaaaaaaaaaaaaacaaaacaaaaacaaaacaaaacaaaaaaaaaacaaaaaaaaaccataaaacaaaaaaaaaatgcatgatgggagcccctgccctctcccacctctcctatgccgtccctgcctcagactctgctcacctcccacccactccctcccctgctgtttcattttttctctttctgctcattccctccttttctgtctgtccgtctgtcttgtgtcctctttctgtccaccatggctgtttgggtttattctgtgctgctgccgctgcctactttctcctctcaacctcttctccttctctgtgcagatgtgtaggcacgctaaggccggatgggaaggccgtgtgacctaatgtttcatgtcacggccacgccttctcgggtgtgcagaaggtgagctctccctcggcctcctccactctcccctcttgcccatctcttccgtcctccctggacactccagcagcaggccctgggatggaaggagggactagagaagcccctccttctcctgcaggggaacaggactctgaactttggccaggacacttgaagatgccagagaaccccagcctctgaatgacctcctgtgtctctgtccctatgccctgggcatagcggataccacaagcgagagagaagcttgtggtctcagcttcttccctgcaccccgcatcaagagcccttatcccaggcagcacagctcttggcagtgctttctatttccttaaacatccaggacctcttccctctctctctctccctccttcctgcttgagcaaggccaccctcgcaaatttagccagcagccagagcagggagaactcttcctgccttctccagggagtccagaccagagccctgcctgatgcttctcaaccaggctgccatggacagttgtgcaggttgcagactactcacaagtgccacgtgtgtgcagtggacaatggagatttgaatattgattactaaagtgatcctgcagatggcagtgaaaatgtcttctaacaaaatcagtaggacattttcccagtagaagtgcccttggggaagaggtaaaaaatgatccagagacaccatatgggctggcagcagccctgttccctgcctggttgggcacccaagaccctccggaacttccttccagggctcattggtgcgggccagagacaggagaccagccccgtctggaggctgtttctcataggtatcccccgagcctgcccagcccctctcagcccctcctctggccttccttctgcttcctctttgtccttcccacatctcctgctgctgttcctgtgcccctcccctggcccctcgcagccagggtgtgaacagcttctctcccttgccttggttggcctcctggcccaatagccacgggtgtgcacctgcccgtgtccgtggtcaggctgagctctctgctatggtcttttcccctcttcccaaagctccttccttctcttccagtctctccccttctccttcaggggtctgtcccgggcttcatgcccattggtgctggccttccctgtctctgaagccttctctgtgtcctggctggtgacaaagcttggaagggaatgtgagatgcgtgtgggtgtagtgggtatgaagtgggtgtgtggtatgtatgggtatggggggttctgaggagtgtgtggtttgaggtatgtatggtgtgtgggggatgtgatgggtgagatatggggtgtgtgtgaggtgtgtgtgtatggtatggatgtggtgggtgtgaggtgtgtatggggagtgtggtgtgtgtatgtggagtgtggtgtgtaaggtgtgtgtctggggggtgtggggaatgtggtgtggaagggtgtagtgtgtgaggtgtgtgtatgaggtgtatggggtgtggggactggtgtgtgtggtgtgtaggaggtgtgaggggtgaggtgcgctgtgggtgtggtgtgctgtgggtgtgaggtgtgtttgtggtgtgaggtgtggcatgtgggtgtgtgtgtgaaggggagtgctgtgtgtgtggggtgtggtgtgtggtgtggaggggtatagtgtgctgtgggtgtgaggtgtagggtgtgaggtgtgtgtgtggtgtgaggtgtagggtgaggtgtgggtgtggtgtggttgtggtgtggaggggtatggtgtgctgtgggtgtgaggtgtgtgtgtggtgtgtgaggtgtgtgtggtgtgaggtgtggcatgtgtgtgtgtgtggtgtgctgtgggtgtgaggtgtagggtgtgtgtggtgtgaggtgtggcgtgtgtggtgtgtgtgtgtggagtgaaggggagtgctgtgggtgtggcatgtgtgaggggtgtgtggggtgtgtggagtgtgtgggatgtggatggcgtgtgggtgacagcctgctccccctcccaaatctcatgccacctccccatgcccccttccctttcactcatccctgttgcaaccatttcacgctgcttttgtccacacctgagggcaaggtcacagctgggttggtggtagtggtggtcgtcctctcatgtcctggtcaggggtctgacccagagttgcccccaccacttctaaggtgactgctttgagctgagcaggcaggggaggggaaccctacctcgccttgtgtggtggggctgatggaggagaaggactcttgctgactcacacactcctgtcttgtctgtctccgggctggcaccgatgaggaaagtcttccaaaacccgtgcccagtgccctccatcctctccactgtctttctgtcgcccaaccttgtatggtggaatgaaaaggcaacagcgcctaatgtgtgtgtgcacgtgtggtgcacagctcgtgtgcctgtacaggcacgtgctgtataataagtctgtgtactgatttccctcattagatgaggaccaactgctgtttgacaggtgggttttggttctaattctttctctgcttccctctcccctcctcttcccttacagggacttagaatggatggagagcattaagattttgtttatgtagcttgtgttttagagttcatggtctgctgtttctgagaaagaacacttgaaggcttggactcgatctgagagaaattcatgagccatctgggaaaacctaaaaaaaggagccggcagtggctgcggtctgaccagtgccctgctctgccccagatctgagcagggcaggtgcagtcacaagactgccggccaccaaggttttcttgagcagcagaaacttgaacatgaggtctgtggggggaaggcttagcaaggccttgggaaggggcagacagtgttgtggagggaggtgaccacagcttgtgcaagaagcttcggggtatgcaggcggagcctgcagtaggagaggaagctggcaaggtgtgggctgcctgaggaaaggggccagtttccctctgcctggtcacccaccctggcccactcaccgtgaggaagctcggatgcctggtctgagatctctgctgatctggggctctcttagtaggaaccctgggcttggtggctgactccggacagagggaaagactgggcagtggacagctgtgggaagaagaaaaaagcaggtccagctagatttgggaacattttggctacagatgacatagatgagatcctcgtggcattcatgtgaatctgtgggttgtgggtggtggagccacagcacatcatctggccacgtttgggtgttttgatgtcaccttgaggacagttcctctctagactgtgcctgtatcaggcaattggatgctgattattagggtagcagtttggcttgggatagctaagtactccagggataataatagttcatatcttttaaaaaataactccagggataataatagttcatatcttttaaaaaataactcttgaatatacaacaaagtgtatatgttaagttgtataatagcgcagcttaaagtaggtcataaaaaaacatgaaaattcaggttgggcgcagaggctcacacctgtaatcccagcactttgggagttgaggctggtggatcacctgaggtcaggaatttgagaccagcttggccaacaccgtgaaatcccatctctactgaaaatacagaaattagccagacatagtggcgcatgcacctgtaatcccagctactcgggaggctgaggcaggaggatggcttgaaccttggaggcagaggttgcagtgagccgagattgtgccatcgcactccagcctgggtgacagagcaagattctgtctcaaaaaacaaaaaaacaaacaaaacaaccatgaaaatacaaactaagggaaaggaaacacagatttctagtagtcttctcctttggcacttggaagcaacattttgctcatttccagagaatattttctgaagccatcaattatctgttacatctgttacattatctcatgaagccatcaattatctgtgcatctgttacattatctcatgtcagggcacctggttcttcttgctggggccagagcagcccatctcctcttcaggaatagcctgaagccaggtctctcccggggttctcttctgaagttgcttctgaagctgcttcagttcctgaggttctcagggaaggaatctttcctcccctagaacacatctctcctttgaacttctggactaaagggttgtctttgagattctttatgtacttggtggttctgggtgcctctctcctagatccctcagagttcatggggttcttgtagctgtgagaggaaaaagctagaaaaccaggagtttgcggtgatggggaaggcctgtcacccccagcggcctttccttctgctcccgggatcgtgtcccgtgggcctaagcctggccttcccagctgacctcatcttacttctcaggctgaggctggtgggtgatgaagccgccttcatcaagggaccacgtggaagcaggtccaactcaccacccagtgggcttctctgtggtgcatcctgcctgtagggggagtcaggctgcgagagaaagggagaggatgaggttctgaggattctgccgtagtttttttagaaaaatcaaatctggacttcaggaacctgcttcctgaaggtaatgtaggagctgggctgtctctcaagggaacccggtggagtctgcagcctggcctgccatacagaaagcactcttgtgtctcccgtggtacttgtgtgttatttctgaaggctggttcactggttataatggatggtattctcagtcagtctccttctggagaggccatcctgggagcaggtggctgagactctggcttgggaatgcggttggatctttgtggaaagtccccaggaggcccacccggaatctcccccagacttcatccagaagggagcccttttgaccctgactctggagtagtcagcaggctcttggggatgggcgaggctcttgaggtcccataggacacatgtaaaatcccacaaatgcagaccttagtccaccagtttgataaattggcacacatcagattttatgaccatcgagccgatggatcaggagagtaacaaggtgaaggtggctttatccatgaaaatcacagccgcagttgcttcgtgccagttatgagtagctgccaaggggtttcagctgtttgagtggcacatctctggcatagtcttccggggtggcacatcctcacaaaaacatcagcctggaggaggacacgcgggtctctctgcagccccctgccccagccttgaagggaagtagtctggggcttccggcaagctgctccccagtcagtcccatgaggctgctggcctggttcccatggccccacttgctttctggggctccaggtctcctagacaggctccaggaaaagcatttccctcttcgttgcttcttgggattccccgtgggtgcttgttggttctcgagagagatggcgatcagtcaggagttgtgggtgagaagcagtcatggcatctccaggacagggttgagttggggtcagggggtgagggcctaaggatgtgactccctgtctcagtttcttgaggcccaggactcaaagtccccacctcaggggactcttagaccaccctctggccattcccaccttctccttattggttctcccaacccattctgacaccttgctctgcaggtcatgcctcccttgacctccttgactgtgtttctgacaaggcctttaggatgatctcattctgccccttaccccctgccccacacaccccagcatagtcatccatccacaaagcacatgatttggtgggcggattcgagaagttcttcaaggaaaaaacatttccgtcttccatcttagtcattccttccaattctaagcacgttcattctcaggaagctcttccttacaaccagcctcagttcatcttgctgcagttgaaacctgttttgtcttgttcatcaaccagttgtgaggtcctgtctttcaacctgttaatccagggatcatttttcatctgcagggcacccttctccagggtctcaggatgcatgtctgtcttctcacagatatcatcttctcccacccccaggctgtcttcctttctaccctctggcccccaaaaggctttgagttcacttcccccttggtgtagggttggaatgtatgcaagaacacagctggattttaaaaccacctatttgaagtggactcaggaatgctgggtccctgctggtgttaggggtacagtagcccccacagctgcagaaggcgctctcccactaaggtttcttagtctttgcctgggattgccattcagtcccctttccttccctttgctgctgaggccatcttgggtccctgctagcccagcacgcagcgcatgatgtgtgcttagctgtctggaagaggcctgtgctgggtttgctgggcattgagcccatacttggttgatccggaagtctggacttgggtgcagtagaatgtccgtcagttttctctaaagtgcttcaggctttgggccaagagccttgggagattctgcagggatcccaagaggtcccatgatttctcagtcagcactttatcccaggactcccggatttgaattcccacatctccaagaccctggaaaatccagccagaggtcctaagccttgcagttccagtgcctccacttggaattccaggatgggcatgaattttctcacctctccacctgacctgagtattttgattatatcagtcattggattagtttcttcccaacctgcaggttgggccttaaactcaggctgttctccaggggcccagttcagccaccaagacctctgtccaggctcacttgacccatgggacctggccatgggctggcaaggaggatggtaaggagagaggaggaatgtgacctcacagccttcttaactcccttccaaccacagggagctgcagggatgggaggggctttgtcagcacaggtgtgtaccaggtgcccctgctgctggggctggctggtcgtgactctctctgtcttgttgccaggcggagacagcagccaatcgcatctgcaaggtgttggccgtcaaccaggagaacgagcagcttatggaagactacgagaagctggccagtgatgtgggtacccccgggttcacctggcctgactctagcaagagtcagtcccctagaacgtgtacctccaagtctttccttggagcatagtctcaggcttgtatagtctctgatcccaatactgctagtccagggcagcctgagctctgttgtggctctcccagaaagtagtgaggtgggggcagaggccagtccctgagttatcatgagcctaggatatccctttgcctctcagagtcttcttgtttttttcacttgtcaagtgagagttgagccaggggatgtcaaagcctttccagcctagtgtactcttagtctgtgagttttgcttcagtgagaaaaggagcacatctggttctaagagggtgagggtagggttttcggtaaattagtgccggctcaggctagcataacagctaccaaaagtagcggctgtcccctactgttcagggaacaggatggcacagtgctgggtttcctgttctgccattggctacatttaggttaagcctcctcttcttgaaagaattcagcccgttgagctgctcagcccagcctcttggtggatctgctgcccagcatagtaagaacgcaggttctggagcccaagtgcctgggtttaaatttctgccattccagccaggtcaccttggcaagttacaggacctggtagggcctcggttgtctcctctgtaacatgcaggtgatcacagcccttagctttgtagtgtttctgtggtgattcagatgagtccatgtgtgtgatgtgcctggccccctgcaggtgttcagtgtattcctattgtcatgtgcacccctccaccttctccaccaccatcaccttggcccaaggaaaacagtccaggccgtgcctgcttgtgctccaggccagctctctgcccagaagccagcctcttcccttttaagtcagagacccacattctagattcttaggaagtcagatggcaagaacttctggaaatagctgttaaccccctccatggtatagatgaggaaactgaggcccagccagttagaacctggtactaaaacccaggcttccttcctgccttttagttgcactaacttcacaccaggtctatgggtcttcccttagcaaagcagggaggttgagtgacgtgactgtgagtcgatgtaccctagtagccaggcttcacgaagcctgtggttctcagagggaacaccctggaagctgacttcatggcctgggaatgtcagtggttgggaaggagtgtgctattaggagagaccccttccccatgtgggagggctgttgggaggaaagggaggctggccctagcacactccctccccgcctcctcacctcctgcccccaccgccttcccaccctagctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggtgagcactgggggtgagcctgggcccccagactggactgcctccacctctgagctgctcctagttgtggtcaaattcagctttatgggggtgcggatgggcgtgtttgcttctacctacatacactgctccagaagtcacttcccccttccagttaccacccaggctcaatcccaaactcggccatgtggggcagccccctctgcccagaccattctgggtcaggcttgcccttccagacccctgagcatctactccagacctccctctcacaaaaaatcatccctatgaacacaatgcttttgacaccctgaaccaaacagggcataattgaatcgcagtcaagttgatttctacttccatggaatcttaagtagttaaaaaatattattattgaagtaatagttttgtgggtttttttgggtagtatatttcaaagatacaaataagcaaaatacagaacatggaaattactgaaaatcttactacccagtatcaactttaaaaaaaatgattttaatccttttggttttttcgtgtaaatatttgagggaatcctaaagtatatgtatttgaaattaaacattttttcccggtttctgtactcaagtgtcccctgacagataactaaagcctgttttatataataagctgctttaggaaaacccccaatcttacattatattctgaccagctttccatgtcataaaatactcttcttttaggttatttttgttattcatccttcttgaccctgtccccacaacttagggaaaaatttcataagccagagaaacacacagaagaaaatgtaagaaatttgccatgacgcagctttttgtccttaagtgaaaagtaacaggagtgtcatgggcacatgacaggtctagaaggggagggtgaaaggcagacagcatcgtggggagacggcagcccagggggtcatggagggagaatacattgcaagtgggtatgcagtttggaaaattgcagtcatttcggggctccaaggctgaatcagtagcttttaggtggccagagccactgctagcctaagggtgctctatgagaattagacaaagtaccctttctgggggacagatgtagcttggcctggggacatgtggggagggtggcttgcagggtgcagccccagtgactgtccagctgggcactgttgcacaaactggaggcatggccctgtctgaaggggcgtgtgggtttgcactcagcatctgtcctcccagaattctggccggctcacccaggccggggtctctgtaggctccaggttattgcccagaggcctgagtccatgaatggatccaggacagtggggaggctgggcagctccagtgcctgcttgcctcattgcacattgttggtctgtttacctcgggggccctttgccttagcacatgtgtgacctctgtgatcggttagagtcctgcgggaaaccagtcctagtcagggagagtctggggccctttccccacagggctctgttctcaaagtcccatagctgggtgaccaatgtagatgcaggtcccatgccttgcccaggaggcctggctcctgggagcccagaaaataccagtgggagatgggaggtatggtggggcagcctggctagggtggatatggggcagagatagggaagaggctcttcctggaaggcatggggcaccttcaggggtctagggggctaggggacctgaagcctaggcccaagccagaccctgaccctgtacctcccatccccacaggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggtgaggccagcccagcctcctgcctccccccagggcttcacttccctactcttcagcccagccagcagccactatgctattctttgcttttcatttgtttcatttggtctcttactagttccatggctttaggcaagttcattagccttctggtcgcctcagcttcctcatctgtaaagtgggaataataatagtaccaacctcacaggcttgtaagaattgaatcagttaatacataacgaagttctgaggagagttcctgcatagtgcagtgctgtgtgagtgttcactttgcagtcaaatcctctaccccgagtgttcactttgttttttagttttatgggggtttttttttgagatggaattgtgttcttgttgccaggatcgaatgcaatggtgaaatctcagctcactgcaacctccacttcgtgggttcaagtgattctcctgccctagcctccctagtagctgggactacaggtgcctgccaccattcccagctgatttttgtatttttagtttcaccatgttggtcgggctggttttgaactcctgatctcaggtgatccatctgcttctgcctcctgaagtgttgggattacaggcgtgagccactgtgcccagccgtataatgtcatcttaaggaattatgtctgcaaagagcctgtttccaaataaggttctatcttgaggttctgggttgacatgagttttatgggggaccccattcaacctaattcagtctcctcatgggttgttgtgaggcttaaatattatagtacattgcatgcttgtggttttcatctcttcagctctttttcctctatttcctggcctccaattacagtgaaccagcctttgccttagcacatgtgtgtccctgttgctccaaccttgaggctcttgggggcgtgtctggtgtctgcttattggcagctaaggtgaactctgaagagagaggatcatacctaggatagtattttccccagaacctggaccagggctggaggtggggaacaggctgcctatctgctggggcccctccggccatttcagctggagcgtgggacagacctattggccggcggagctcaatgccctaagactcccccagtcagccctgttttgtactcctcagatcttaggttggagatgagaaggaagaaccataccccaaggccatttgggagtggcttggcttggtgtagggcagcggtccccagccttgttggtaccggggaccagtttcgtggaagacagtttttccatgcagtggggaggaggcagatgctttcaggatgactgttctacttcagatcatcaggcattagattctcataaggagcacacaacctagatccctcgcatgcgcagttcacaataggatttgagctcctgtgagaatccagtgccgcccctgacacaacaggaggcggagctcaggtggtaatgctctcccacctgctggctcacctcctgctatttagcccagttcctaacaggccacggaccagtaccagtctatggcccagggggtggggacccctggtgtaggggatgggagtgtgcttgactggctaaggggggttggctctagttcccctttgtaagtacaaatgctgggctttgcacacaatggtaagaggttgctgcccccacatccactgtgcgtgtatggagttatttatccagacgtgacgggcagagtggaggaggcacagtggggattgcactgattcatcacatgcttctgtcgggtccagctcacagccaaggtacaaagcaaagattgacctcgttgccttgccagccaccagcaggggcatgagaagtgctggcatgctggcacagcctctggggaaagcagtttggccacatgtattcagttctaccaattttactacactctgacctgggaattccatttcttgagactgtctaaagaatctatcctgggcgtgaggagtggcagcggccaggcagcacagtttcgcaaaggctgtcagcatgccgcggcccgcagacacctggcacgcgccctccctgccgccaggatgcccaaggggaaggtcagctctgctgaaggagccgccaaggaaaagcccaagaggagatcggcgcggttgtcagttaaacctcctgcaaaagtggaagcgaagccgaaaaacgcagcagtgaaggataaatcttcagacaaaaaagtgcaaacaaaagggaaaaagggagcaaagggaaaacaggccgaagtggctaactaagaaactaaagatttacctgcagaaaacggggaaatgaaaagtgaggagagtccagcctctgatgaagcaggagagaaagaagccgagtctgattaataccatataccatgtcttatcagtggtccctgtctcccttcttgtacaatccagaggaatattttttatcaactattttgtaaatgcaagctttttagtagctctagaaacatttttaagaaggagggtatcccacctcatcccattttttaagtgtaaatgcttttttttaagaggtgaaatcatttgctgattgtttattttttggtacaaccagaaaatagtgtgggatattgaattatgggaggctttgactgtctcgggtgtcagcttaacattccatagatgggggggttagtttttatatcctataatacaaagcatattaaatggcaatatggagtcagtcctgcatttaatatcttgaacattttaaattacttctgttgccatgttgtttttttagtagaattgtttcctaaagaaaaccactctttgatcatggctctccctgtcagaattgtgcactctgtaacatctttggttgtggtagtcctgttttcctaataactttgtcactgtgctgtgaaagattacaaatttgaatatgtagtgtacgtgctattcagttgtgaactggtgggccgtatgtgacagctgaccaacatgtgaaaatactggtacttgatagcctcttaaggaaaatttgcttcccgattttaagctggaaagtcactggaataactttaaaaaagaattacactacatggctttttagaatttcattacgtatgttaagaattgtgtacaaattgaaacgtctgtactgatcttcaaccaataaaatctcaattattaaaatacaaaaaaaaaaatccatcctgaacatggagacatccacactagggcaagctgagggcccagcaactcacagtagggcagtgaagggttaggggagtggacgtgcagcctttctgcagacgtctacatgagaagactatggagccagggcagaaattccaataatgtgccgccaatttttttttttttttgaaacggagtctcgctctgtcaccaggctggagtgcagtggcatgatcttggctcactgcaacctctgactccctggttcaagcgattctcctgcctcagcctcccaagtagctgggattacaggcatgcgccaccacgcccagctaatttttgtatttttagtagacatggggtttcaccatgttggccaggatggtctcgatctcctgatgacctcgtgatctgcccgcctcggcctcccaaagtgctgggattacaggcgtgagccaccgtgcccggcccatgtgctgctaaatattttaaaagcaggaaacataatttatatatgcccaaagaatatccacataaggaaagactgaataggagtggataagtaggcttacctgtaatttttttcctaagctttatatattaccattctgttttaaagaagaaagagtagggggaaggaaagaaatgccacctggggacacaaccttggctcccagcccagccttatttattgagatgggccgagcataccagcagcagagggttgggtatgtgagtgagggaggctgggccagcccccatcctgtgcctgtcaacttcacaaggcagctggtgagcgtcgtctaacaatggccctgggaggtcatttcttgttcctgctttcctcctgtggaaacaaatttaagaaacgcaagacctgcttgtgccctgtagatagagggcagtgtgtctgagggtcagagaaggcgctagccactgtcgggttctgtgcagagtgcactggacacactgaccgagggaaggggcccctgcagggctgccggcagccagtgacggtaactggggacattctaaaggcagggtactcctgaggtgcttgggttgtttttttcctggttataccagagggtgtggatggctgtgtttcccgctgtgtgtatagcgtcatgccctatgcattcccacagactcctgcatagccttcctgcgtagacactttcatggccttggaagtgctctgaggagagtgcttttccccgttgcgccggttggtggatgttctagttgcacatctgcttttgcaccctgcagatccctgcacaatgggcacctccttgagaagcacccccagaagtggagctcctggggccctgaggggtgggcggttgggaccaaggagatgcttctcactccagctcagccatgtggccctctctcaacccaggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaagtaggtggccccagacacccctaccctgtggtgaggggctgaggctgggctttctcagctgctgggggaggtgggggtgtggccgtggaagatggggagggtgggtacaggtgggtgcccaggtggggagggagtcaacgcaggagacaaatatctctcctggtggggaaggagcccgggaccactgccatcctgttaaaggccaccagttctcgcctgtagctagtacaggagcagagggtgaccaagacttggttctgagctttctcgttgggcctcgagggctccctgccattggccattgaggtgaaggctggtgtcacctccagccatgactgggaaaggggtcttctttggtctcctctctgccagtctcctgaaagaggggaggggtggaaggagtgcctggaaggtctcttgaagggagcgcccctggctcttcccagcaccaccagccaccccactgacagcctcagagagagggagatgggccatgaaattaacctgggtcccctgacttccttgtctcttccctccccagtgagctggactattatgactcacccagtgtcaacgcccgttgccaaaagatctgtgaccagtgggacaatctgggggccctaactcagaagcgaagggaagctctggaggtgagaggtcccagagggagatctaggcccatatccggcagccctgtggtgccccttcctgcttcttgactctctttgctttgggctaaaagactctatggcttccccagacctcccccaaccctggcctaaatgtggaagattcactttggcacaggatttggactttgccctcatggcgatgcctcctctcttgccctcacatgtctcatcctcccagtttagtgtgctttacagcccaaccccagccatttgagaaccctcctattctacacaccagactctgggacccaggccaggtgactgtgatgtgagatggttcatacagctggcaggaagagcttgttctttctgcctgattgagtcagtgcttctagacctggggctcaccaggaggatcttgataggagtgggggatgattctggacatcactgtactaacccttaccctatttggcactcccagcggaccgagaaactgctggagaccattgaccagctgtacttggagtatgccaagcgggctgcacccttcaacaactggatggagggggccatggaggacctgcaggacaccttcattgtgcacaccattgaggagatccaggtgagccccacctccactccccggaggctggctcccctggggcccctggcccatgctctgtgggtcacttttgcaggactgccccctgaggaagagcatcctaaggattttatagacccagaacctttgcatttgacttattttgacaagataatatatgtgcatgatctaaaatttaaaaaaaattaaaaaggtttatgatagggtctccctctgactccttatcctccagcccctagttctctccccaaaggtaagaatttgactacagtctctgcacacaagcaaatgtttgtttccatgctttgtaccctttttgtataaaacaaaaagtaccttttattatataccatattctgaaccttgatttttatttattttatttttttagagacaaggtctcactctgtcacccaggctggagtgcagtggtgggatcatagctcactacagcctccaactcctgggcttaagcgatcctcctgctgcagcctccctagtagctgggactacaggctcacatcaccatgcctggctaattttttaatttttatttttgtggaagtggggttttttctttgttgctcaggctggtctcgaactcctggcttcaagagatcctcccatttcggccttccaaagtgctgggattacaggcatgagtcactgtgctcagccatgaaccttgatttttaatgtaacatttatttggagctcatttcacatcaattagcagcttcctcaatctttcatgcagttgcagaatactggatttaaaaggttttgccaggagctaaggaagctcatgttgtgggaggtcacctgggtagtgagcctctggagcagcccttctccctgacctgtgaggtggtgaacacaccagagaggttgctgctaatttgaccagccctaaggatgaagctgttgcttttgatgactgtggcttcaccttcctgtggccatacctgccatcctggttctcagccacaagaatctttgaattgatgcctcctggtctcccagctggtgtggaactcaacctccatggcccttccactcacttctagcgctccctttgttcctcttgcccacatattcccatctctgtccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgagttgaagggcatgggccgagccattgtaagtttcataaaggcagggatttttgtccattttaattgatttttgtcaatttcatttaaaattgtcatatagtaaacactcattgtttgtccaaatgtcaaatgactgggtttccagaacaggttgacacctttactcctgttctgttactgaccggcccttccccttctgggtcctccatttcctcatctggcacatggacagatggctgacccatcctgaaagtcgccttgttgttcctgccccaggtgcggcagctggtgcctcggagggaccaagctctgacggaggagcatgcccgacagcagcacaatgagaggctacgcaagcagtttggagcccaggccaatgtcatcgggccctggatccagaccaagatggaggtgggtcccatgctgggaagcagtgctggggctcccacccctcccccccgacactatcctagccagccaggctgcctgtctccctgggtgggacccatggaggactgaggcccggagcccaccgtgggtctgctgttctgtagaaggctatgggggcctatgtgaagaagccctgctggcagtatctgatttgggagcaaagacatatgaggacaccactaagaagctgcctgtgggctcacgcctgtaatcccagcactttgggaggccgaggcaggtggatcacctgaggtcaggagttcgagaccagcctggccaacatggtgaaaccccgtctctactaaaaatacaaaaatcagccgggtgtgatgatgcgtgcctataatcccagctacttgggagcctgaggcaggagaatcgcttgaacccgggagacggagattgcagtgagctgagattacgccattgcactgcagcttgggcaacagagcaagactctgtcaaaaaaaaaaaaaaaaaaagaagctgcctatgaaagtcccatactagggtcagttcctgagcgcccgatccagcttaatccccttgatgtctcttgttgatcaggcctccccttcctctcctcctcctcctgagcaatgagcctggccaaagaaaatgattgatcttcccagaaagagaactgaaccccagtagagcatagaatttttttctgaattgtgtggggtagatagtggggtgctttagcagatcaggaaagaggccctgcttggctagagcatggcctctgagttccttaagaacagagaccatgttgagttcacattggtatgtgtcgctcccctgcacccctgccagcacattgtccttagtagacaggcaggaaatatctactgaattgaactgagtggacagaaagtgctttcacaaacaatggttgtttacatggatgaataacagacagaaatgggcattaggcctggcctgcagggatgaatgggattcaggtgggccagggcaggcatcccaggaggcggaacagcaggagcaagagcatgggtactgaggaggtgagtgaggtctgccgaggctacgaggatcctggttcagtgggtccctgagatggacaagacttgggaaagggcatttgaatggcaagcagaggagtgaatatttaggttagaactgaccctgcatcccctttctgaggctgacaggtacccgagagttggtaggtatttcatccaatgataacagtgcttgttatatacctctgtggtgctgtttccatacctaagagcacccatgctaaaagtgtcttactaattaccagtgatggcctccttagggctgggatgggaactgagaatcatttgagggcttaataagtgattttggaggccccagtccccaccctatgggagcagagtgaggtggtctgacaaggtgcttccttcccggtgagcaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggaggtgggtggggctggccttgttcctcttcgggagcccgtggccccttctgctctttctcctgggtggggaagtctccaagggaacaggtcatagttggaggataaattaacttcacccctgaagcctcacatcttcaatttttagtaccttctgctttcccaaggaatgtgttgagaatgcacatttctaggccccatctctagaatttgcttcactaattctggggtggagttcagaataagcacttctggtggttctgggtgctggtgggctccaaacactggctcaggcatctgctttgaaaatggctacttgttttaactgtgcaagagtgtgtgtgtgtgtatgtgtgtgtgcgcgcgtggctgtggggttggaggttcggggaatcacacatttttttgtctcaatctttcctacccccaaatctgccctccttcctgacctgacccccattggcaagtcctggtttctttgctctcccaggcagaggctgccaccctgccccttggtcatctagggtccttgtcctagtaggttgtccttgtcctggttccccttcctctggtgacactcagccacacagaaggccaagtttgatggctttggccattttgatggttggggagtaggatgggcaggggccgccaggagcccaggcctgggacccctttgctgacaggccccttgccgtcctgcagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggtgagagccccatcctgtgctttcttagtgcagcccccaacccctgccccagggccctggagggcacttccccgggacgtgggctgccatgcaagtgaggagggagagaaaggggaaactgccgtcagcctgccctgactcaatgcaccctgcaaaaccagccttggaaaacctgtgttggtgccccataagcttccctgctttccgggagagagtgttcagactgtgggtagaaagaggacctttgacccctgatccttgctctcctaccatgaggagtcaccctcagtgaaggcttgctgctccctggctgtggagacagaggagcagaagagactcctcctgccctcgctggcccctacccctaccccgacctccagtggcctctgggactctgctggggatgtcagaggccttggtcctgggttcccatcccagctctgggtcaggctgggttttagtgggctgccccttcccagtgccctggggcttgcgggcggtcccaaggcgtgggagcatgggcttgggtgctgcccaccaccccacctgcttcatggctctctaggcacctggggggaagcccctggggaagcgggggggctgggtcacttctgagggagcttctcacccttgtggctcatcacaccccactgtggtcctgctccctggagcagggctgcgtgtgctggggggagggcaccccctggagcctcgttggtgtgtctaaccgtgtgcacttttatttcccctcctcccccgcccccccaccctccctccgcatgcctgtccctgtgtctccccacacacgccaccctcccccggggcatgcccccctcacggctccacctccctgacaccgcatggctcgctgcctggcgcaccgcggccccaggatcactccggcacactgggtcccgaggagttcaaagcctgcctcatcagcttgggttatgatattggcaacgacccccaggtactcgcctcctgcatggagcacgctcaggggtggcgtctggggcaagaaataatgcgtttttcctttttctcttctctctgtctggatctcctgtccccctcctgtgggccatggggctcgtcctctcctgctgtctctgtctgccccatcactggtccaccctctgccctctgctgtctttcatggcaacctactgggtgcccgctgtcttccgtcctcgctgctcttcatcccatgggtggatttttgcatctccctgctctgtcttcctcctgtctttggacatttccaccgatgtgtgttcgcatcttctcctatgttcctttacctatcctgacccccaaaaccataaatctcatccccgttctggccatctgttcctgtcttcctggccccgggccggcccttcctcttcctgccttcccgaccctccttgtgtcttggtaccactgccccccacagaagaagacaggcatgatggacacggatgatttccgcgcctgcctgatctccatgggttacaacatggtaacgtaaaccccaccctctgtctgccctggtgagaaggcagccagctggcgggagcagccaagtcccaggagtggcaggctggaggccctcaggctaggggctgccctccctggaggagccccagggcccatgtccttggggaagatggctccctgaaagccggcccggccacgggcgtgtgtgtatccgggaggcctgacctcctcgcctcaatctctgtgccacttcatcttctggtacttctcactcccactgtggacagctgggctgaccctgaggctggcaggaaggactggtggtgtgggacatcccaggtttcgggctggcatgcgtcacctcacatggagcatggaaaccgagacttccacctctgtcctggcggtgactctggttgggcctgccgcccctctggattgtcccaggccgtcccccaccccccaaccttcctagtctgtccccccttgcacagacattctgagcagagcagtcaggtgactcctgagccatggtgccaagtgcagagcccacaggctgtccagcgcagggcatgggcatggggctaggagcagtgaacctgggagtaaatcccagccctgccgtcattagtgtgttacctcaggtgaagtgggggaaccctacaggactgttacaaggattaaatgaaggaatttaagtgtgtgcatgtatctggcatgtagaaaatacagtgtggtggggagagaacagattctagaaccagactgcctgagttcaaatcccagttctgctgcttcctggctgtgtgaccctgggcaaatcacttagcctgtctgggcttcagatttctcatctgtacaatgaagataataaaatacctatctttatggttgtagtaaggattaaatgaattgaaataaagcttttagattaatacttgatatgctacataggtgtcagccattgttaatcattgttgtcattatagttattatcaacatgattatttgctctaagaggaactcaggcatctgcagggtgtggggaaccctgagctgggtctcccctgttgggtgttgtgtccccatcatacccttaggacaacccaggttaggtcagggggatgtgcccttctcttccagccataggctgctctgagcccccagggtcttcagtccatatgagatattcccagcaggccatgggctgacaggcctgggtttggctgttccctccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaaggtgggtgtcctatgggtgggcactgtgctggggtggcaggcactggctggactgtgatctaaaggggtgagagctggaacatgaactcctcaaccgccccttcttccagggtcctttggcctctccttgtttgccacttctactcatttctgtaatgtcttgggctcagctaaggtgtcaggacacaggattagtataagtgacccttccaggatcactgcatgccagtgagggactccatagctgggatgaaatgacgggtggcagatgagaatagagtggtgtggatgtgtgatcggactcttggagtccatctgacaatccctgggacttcacccttggtctcatcccgcgcatcggcacggactataatgggagcaggaagagggactgtgggacccaggaaggaagcatgtctctcgtgttttctaccctgagcagtgatctactctgggtttcccagtctcccaagtaccctgcaacactccacctggcagtggatggatgcagggggttgtctccatggatgccagaggctcagtccaagtctccactgttctgagatggtcattggtagacctggatgttacccagaaccacagccatctccagcccagggacctgaggggatctgtagaagccacagatccctcgaatattagagaaaagactcacagagcagccagaagaaatggtgggggtggggtgggggcctagggtctgtgttctgttcagtaaaagtcacagtaaatccttatgccatccttccttcaaaactgaaaagattcaggccaggcacagtggctcacgcctgtaattccagtactttgggaggctgaggtggatggatcaggtcaggagttcaagaccagtctggccaacatgggaaaaccttgtctctactaaaaatacaaaaaattaaccgggcgtggtggcgtgcacctgtaattccagctacttgggaggctgaggcctgaaaatcgcttgaacctgagaggtggaggttgcagtgagccaagattgtgccactgcactccagcctgggtgacagagtgagactccgtcttaaaaaaaaccttaaagaatcagttagcgaagcaaaagccaatagggagggaatataatttctggaatgtctgtctataagggaataaaggctgaacctacaaagaagtccctaaagttctgatttaaatacaagaacaacgttatttgcatcatagcactttggagctggaaggatcctcaaaccatttagttgtagtggctaattttgtagaggaggaaaactagggcccagctaggggcctggtctcccaacttttggcttgacagtggcagctctaccctccctcaaactggttcccagggcactctggcagaggtagggcatggtgcagggcgactaccttgtgggtcagagcccccaaatgagctctcctggatcttgaagctcctaaaagaagcagcttccaagtagacctatcatgagcaaacctgggagaaggtagatacccaggctggagctgcttgcatggggcaaggcccgcatttctgcaaagctgcttaacatagcctggccatatttgggaagcagtgatgcccaaacatggatggtgttcttaatctgctggagggctcattaaaattagactgtctgtccgaggcgtccagagagctcagttgagtgcgtgtggggtctccccaggaacctatacgctccaccagagtatctgctgatactgctccagcacgcaattattgcagactagtgtgattcagaagatgattataggtgtaattggcacatggaattagattggaaagtggcttacaaagtaggtactgaagtggaaaacctgagagaattttaaaaatacatgttgtgtatgcggtatgtacatgtgtggatatttacgtccgtacatcctgtagttacaggagggaggcaaaatgcaaacggcacatgctgccttcacgccgccaggctttgcggctgtgtcgggccgcgccgctttacggctgctggactttgcggccttcctgaccactctctcctcgcagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttg

SEQ ID NO: 37015 - DNA, 104955 bp, Homo sapiens; identical to SEQ ID NO: 37014

SEQ ID NO: 37016 - DNA, 98814 bp, Homo sapiens
aaccccacaaaaattagctgggcttggtggcacacacctgtggtcccagctacctgggaggctgaggtaagtgaatcgcttgagcccaggggttccagggtgcagagagctatgattgtgctactggactccagcctcggccgagcgacaccctgtctgtttctttccttttctctctctctctagctctggatcgtacaagaagggagacaaggaccactgacaagatatggtatgtgatactaatcagatttggcttctttctgtcctgcttcaccagaggctggactctccttgtttcagtttctccgctttccacagataaatcttttgtttcccggatagccacttggcctgtttgccctttgctcccatttttccttgtttgcttctttgtctgaaaatttatgctgtcctgctgcctccgctgggcttcgtttccacctttgctggaggagatttagctgacaacctcacagatcttccccgccccttctgccgagctgatctttctcttggaaatcttacccgcagggaagggcgagtgtccgtgcctgcctgcctgcctgctgcagcccgcgcaaagctgagcggccagggcgctgctgttcctttaaagtattattaaaaataatatttcagcttttaagtaactccttgagtttgaatcaaaagctggaagaacctcctgggctctatgagcacctctgaatatgtctgactctacattctagaggcttcaatgtatttataattttggctcatagattctccacatcttttcagcttcaattcttgcttttcccagaaacaattttcaagcaggagagaatattgattggacttgattttctcagtttgggcagaggtttgcagacactttgcaggttgccagacccttcgtccagccacctgtcagctgggggtcatatggtatagaaagcagtcatttctatgcaaggtactgcttgggcctgcctccctcaaaggggtaggggatgcgggctggacaaagggctcgtgatcaagtaaagcactgtgatgacagctgctatttctatatctccctagacttgtcttctaaattaaaccttgactcctcccttccaagctggagccactgctaactactgggagagccttagcagataaagtctcatgcctccaggcgtttgtgcatcccattttctctgcagagtagaatctcccttctacttttgtgctcctggggacgtcctactcttcttccccagttggctctaaggttatcacatcggtgaagtgtttcattatcactttttagaagaaactgagtcttttagagaagttaagtgactttctgcattcatactcatactcaagaaaatctaactccacaataaccaaaaataaaaagtagaaaaaaacccacaagtgatgagaaaaaaaaaaatcaaaagttataaaaaataaatgaaaaaatgaaattaaaggaaaaaagattttttaaaaaagtaaaaaaaagaaaagaaatctaactccagagctctgacacaaaatgccttaggtgttattctcaatgagagaaaagggacgtgaatctttaagtgattaagtgaatctttaagtaaatctgtcgtactagcgtttcaggcggctcaaacaccacacgctcccgactacggcggaatggagagaatgtgcgcatgctcggcgggaatctgcgcatgctcggcgggaatctgcgcatgctcggagagaatctgcgcatgctcggccggaatctgcgcgagctcggcgggaatctgcgcaagctcggcgggaatctgcgcatgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggtataaagaaagccatggacttgggctttacccggactggggatccggagagggtggttcggaagcaggaatcgtgggatcgcggtcaagacaaagaatggggcaagagaagatcatggtggtgggctcagtcaggagggccgggaccgagggatgcgctatgagaaaagctggagatttggggctccaagacctgaatttgagcctcgctgactccacctcttccattacccacccatcccatccctcttctccctctctacctgctctttgtctcacctgcctccccacccgcctcccctctctctctctttatcccattccactccctagccccacttcctctattacttccgagcctgggttcttaagatctctatgagaatgaaaattagctgtgataaagcaactatcccacagggcttgttgtaaaacttaagagagggactatctgtgactaaaataacttaaactgtaaagcgtcgtattattagctttataataacgtagtatcccgcatttattgaaagcccactctgtgagggacggatctaaaccttttattcttatctcatttaatcttcacaaccccttgaagtgaaaactatttatccccattttgcaagtgggaaaaccgaggaataaagaactgtgggcttttcctggtgaaatccggatttgaatccaagctgtctggtttcagggccctggagaacccctgtgttgctagaaatctatgaccattggtgtcccagatcagtaacagaaattacaatgaattttaaagtgatttttttttttcaacataaaagagtggtagttgtctctgaagggtcactagagggagatgtggttccagggattaatgaatttattcaatacagataaacaagatacgagtttgagcaactgatccctagttccctcaactcctcattgagaaatgttgattaaaacgatcatgaacttttaataatgccactcacctccttttttcgtcctctttcagctgctgaaaactttgtagctctagtggaggagctgtttgttgcagatgaactggaagtaaaattctaacagcctgtattgcttcggtatagaaatgaagagttgctatgctacccggtttctctttctcagttttcttactgctgccagataggaactcagaaatatagaccattctgcttccagacaataagttccatatttgaaaccctttgatggcacttactggatacctaattcatgacaaaagtgctttagtcctctagagttttctggtttaaaagtagcttttgtgggtgtgtatcaaataagtgcagcagcatattttgtgactcttaagtttttttaggttatcatgccccaggcattgaaactgggatgtgcattttactgttctcaaaggaattttgtggtttattagcacgttttttttttcaaataatctaattttacttcagaaatctcttagtgcattgtgttgtttgtaaactagtgaaaaataatcttttcttttcatgtgttgcctgagatataaccacatttagaaatcatctataacttccctgataggaattcattcaggtttttaaaacatttctagggtcaagagatcacttaaaaaagagtagtttctttattgatcacttctaaatgttattttttatccctcgtatggagtcgcatcagtctccctgtaacttccatctgttgatcccgttgtctttcttggcagaccaatccttttatacaacagttgtcaaatatctggggggaggccagacacggtggcctatacctgtaatcctagcactttgggaggcggaggtgggaggattgcttaagccaaggagtttgagaccagcctgggcaacacagtgagaccccaactctacaaaaaaaatttaagaattagctgggcatggtggggtgcaactgtggtcccagctatttggaaggctgaggtagcgggatcacttgagcccgggagatggaggcagtagtgagccatgatcatgccactgtactccagcctgggtgacagtgagaccatgtctcaaaaaaaaggaaaaaaaaatggtggggaggaaaactgttatgttccctttaatcttctcatctgacttaaatatctagttatttccaactgttctttacatcatgtattcttcagattcttccctaagctgctcatttcatgttcatttgtaattaattttcctggtaagatgttagcccagaactgctcacagtttgtttgatcggtacaaagcactgcgagactatcagtcagagtcaaggaatgtgaactccagaaaggaccttaaacctcatctagtccaacagtttcctaccttttagtattattaacagtgagattaagtgacattcccaaggactcagaactaatgggtaggagagatgggactagatcccaggtctcccgattgctattatcttttttcaccagaagacccttcttttctcttcttgaattcactacactgttgatacagaccaacatatttaggcgatgaagtaagataggtgtggggaatgtggtgcaaaagacatttcacgttgttgattgattttataattcacactgaaattgtgagttgccatcaatccaggtctcttccagcttgtgttcaggtaaaatttggaagccaggtataaataactttacatgtattccttttaggttatgtttctcttattttcttagtctcctacatacgtgattgctatgtaatggcttgtgccttagcttatgtgattccgtctgtcacttacttgttcacatgattgactcctactcattaagactcacccaaggaaatccacattcaggaagccttttctgccccttcaccgctctggtatcccctccaccagtcttgagtggatgctcctcctgtgtctctcagtgcccagtgcatacttctatcatggaacattgttctggtattatttgttatctgtctgtgtcctctactagaatagatttggtgtctttattttagatcatcagtttacaaactgactcaaattgtcagggtatacctcttagcatatatatagattctagcagtcacttcttgtgacaaaaatgcttcataacaaattatgccccgaatcagtgacttacagtgaaagcatctgttctcatgtttgtaggtctgcaggtcagctgcagtttgtctgatgtatattgggcataaatgggtttaactctggcctgcaggttggcatcatatgtactcatcatgggtttattctggggcttaggccaaagaagtggcagctatctggagcatgttcctctcctggtagaaacttctgtagcttttagaaagtatcaggactatttaagggttttccatagtgaaaatttatatgtcttacacacattcttatgtagaacacatccctttttcacacctttcctaaatactgatacaggttcatgaatacaataagcaagggacattcttacagtcttttcttacgacttattttctcaaacactctttggaactttgtttccaggcagctgttgtgctgtgtatggacgtgggctttaccatgagtaactccattcctggtatagaatccccatttgaacaagcaaagaaggtgataaccatgtttgtacagcgacaggtaagtttcagattgacactgagcttgtaacccatgtttgaactgcttgttgcctctacctactaatgcaagataccagcctccttatagtgtccagcccctctgtttggggggattctggggagtttccttacatgtactcacatacaacttcacctaccactagagtctgatattttttcttccctcgttttggccccttcactagatattacagtttttatcggaaacaagaggcagtaaaaagtaatgtttaaaagcacaatctctagagacagatggcttgggtttgtatccttgctctgccatgtcatttactaaccttctgatgttgaacaagtccctcaacttgtttgtgactagttcagttatcttttgctgtgtaataaactaccccaaaatgtagtgtctcaagtaacattttaaaaattcatcattcatggttctgtgggatgactgggttgctcagttgggtgattctctattgaggcctcttacgcagttgcaatcagatggcagctggggctggagtcacccaaaggctcaactggaccagatgtccaaaatggctcactcacatggctggaagacgatgctttctagtggctgtgagctcagttggggctgtccgttagaatctctacatgtggtttctgtatagtttcaattttcacatgaagcagctggttctaaggagtatcccaagaatgggttttctatgagaccctgcctatgtggcttcttaagacctatttttagaagccccagaaagtcatttctgttttctgttagtcaagcaagacactaaggttaggtcacatttaagggaggagaattagactccctctcttgataaaaagagtagcctgcaaatacaaggagagaaagaacggatggtggctatcttggaggttagctactacagtgcctcagtgtcccatgtgtaaaatgagaataatgatacctgtcacatagggtagttttgaagaataaaagaattaatgtagataaagtgcttagaatagtgcttggaatattgtaaacactatgtaagcatcagctgtttttatttctgccccttctacttggtatgactgccacttttgctaagtccatgagttcctgcttctttcattgtctactgctgctcctcctggacacttctgtttcttctgtgtgtttacacttccgttgggcactagtacttcccacctgtcattctagatttttaaaaatcttgatgacctggagtccttgaggtgttgtgtcaaggaaggtgctctaaccctgttcttggttatagttgtgttggtggaattcaagtagtgtggctgtcccctggtatgctgttagagaaggtaagtagacatgagcagggcaggagagagggcccccgagaatgttgggcatttgtgaagccatggttaggcaattagaaatccgtccctctgaagtgatgagcagggcaagggaggggccccaaagctgtcaggttatcatcgaggggaagacaggcgggcataaaactatcactgtaaggtaataagtggccatgattggtgtcaggaattacaggaatcttaacagacagaaaacacctggagttagcaagctataatccttaaggtttcgagcatgcgcagtaaaagagcaagatggtgaactttaactggtataaaagctgcctctgggggcgctcgaccaataatgccgagttgccgctactgagcatgcgcatgactagtaaccacactacgcatgcggccccctcttaagcagtagcagggctagtgcgcatgcgttgattaattcgggctgctcaagggaggaacaaaggagactggaagcccgggaaaagatggcgccggtggttggggggcggggcggtctaaaaactaaacaaagaagggcgcagggcacttgatttttcacgtggccctcttggttctcttccaagtgtactctgctttctccagtaaactctcactttgcttaaaataaatttttcctcctgctttaaaccttgcttatgtctgtcgtttcaattgtttacttcgagaagaccaagaaccgagattactgcggagtcgccactccggagtttctctggataactgccgacttacaccccagtaacaagagtataggtgtttttttgtttgtttgtttttgttgtagagagaaagagtcagaatcaggaagtcagaatcaggaacttagtgccagtcccatactacattcagaatttcctcccctcccatgactgagattttgtctagggcaagattaccttgccttaagatggatgcttgtctaggcggcagatacctgcccagccagtatgctacgcatgcttgaatccagcagcaggcacccagacaccgttagtccatgtacaactgggaattgttgtgttgtttacagactaaaggattaaacagaccctacaaaaatgaagaatgacagaattccattatctctccatacagcactcttccccatcaatgtaaaaaggcttatgttaataattagacaggactgtcttttgtgtcagatactattttttgtttttatatttcattatgaaatatttcataaaataggcaaatatggagaatatacaggtaaccaattttcccattgtcttatgctgtaaatcctaatgtttcatatttgtttgattttttttttaataaagtgttacagataaacctggaggcccttccttaccctttttttctcttctccttttctcaggattttggtagttattaccatgtatattttatacttggacataagtatatattcataaatacttagtattgtataaagctgtcaaaagtgtaaatggttttatatgctacatgtaattctgcagcatatcttttatcaacttattttagatctattcatgttgatacgtgttgcacaaatttattcatttttactggagtatgatatttcgttgtataaatattctgcaatgtatttttgcattctcctgtttgatagtttgcttccagtttttgccctatcataaacagtgctgaagtgtaaacttcctatctgtacataatttttctagggtatactgtatatgcctgcccctgaaattgctgggatataggctatcctgcacttttttttttaacctctggaaaatttaaaccttagacattccataaagacatactaaaatcttttcacattacccatttttggttctctcattgagaattagagtttgatttcgctggaaatcatcaagaacacttactaccctcctatttccacacctcaacttctgctgaaatgaagggtgagacttatggtcaatgaaaaacatctgttcagaacctaagaattgtcattgtctgtaagtctcatgtttcatcccgcccaatactatatggccccagggacctgccatagggaggtctggttgtcctgctccctgaaggttaggtattttattgcttccagattgttctaatatggttttcagccatctgacatttttttctaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgactgtatcctttttctgccagagaagactttaagaaatttcctttattctgggaatcgtacagcagtttgatgagacacccccagagtttcagctatgagtatatgggtatattttgctctgaggagggggaggtaatgtgttaatagggtttaatgtgaaattaatcagtttaaaacagtgcctgggctcccagccctccactcacttccctgttctctgcatgggtgatactgagaggttgggaggcataggaagggggaagatcctagggagtatatgtgagcattgactatatgcagagggttttagtggtgctcgttagaaatgtttggaggcggatagaaaatatttttagaagagcatcctcccaatgttctctcctttttttctggatggaagatgtttttgtgccagaaatcagattgatacccaaagtgagatttccagtttactccacaggtcccctaattttaagggatcatcactcttgttctttttctaatcagttagtagtgctattcctgatcactgggaagtgctgttgtgttaggagtgacttgcaaatgctacattatggttcgcttcatatttaagaatggactgtggccaccaagaatgggttctagatactattaaatgacataatttttggttaaatgaatgcaatgtgttagattaccttttgtttatatttcttggttgtttttggcagaatatatagtttgatatatagaatgtatgaatatatgttagtgaactttggaagaagggcactcaggcaagtactttaagtcatcacatagttcagtgtccacaatttccagcacggtggacttcattggaaagagttgcgtgttcacatgaagagactgtttggtgatatccctatccttaactagctgagtcctggatgcactaatcgtgagcatggatgtgattcaacatgaaacaatgtaagtgttccaaggaagagagctggaagagaatctttttgcaaaaattgtatgggttaatgtattgaatgtattttgtgattcattgttaatcaagctgcatgtttgtgtgacaagagaaacattttatagaattgaatggttcagtccaacctctctgttttttaaaagttttaaaaggggaagggctgtactcggtgattatttctctggaagaaataaaacatttggcttatttcagtttacttcctattagacttaagctgattaccaggaattttaaaaaacactaagtggtataagccatatgtcattgatattaagtgcatggtaactctggccaacttcccttttttgttgtgtgtgtgtatgttttttgttgtttttttttttttgagttggggtcttgttctgtcacccagactagagtgcagtggtgccaatatagctcacagcaacctcagcttgatctcctgggctcaagagatccttgcatctcagcctcctgagtagctgggactacaggtgcacacccaagtccagctaattttaaaatttttatttttgcagagacggtctcactattttgcccaggttttctcagactcttggcttcaagcagtcctcctatcttggcctcccaaagtgttaggattacaggcatgaaccaccatgcctggcctgcttcctaattcagtatttatttaattattgtgccttggaagtgtatctctggagacatatatgtgcatgtacacatacctcttgcctgtcaggaaaatcatttgcactaaaatcccagacctaaatctgtgtaatcatttctcaatctctgtacatcctctgccaaatcttgccacacaaaatctgtgcatggagtcagagcaggatatttagaaagtgaacctgagcaaggctgaagttagagtatgctgggagaattctttgtttacattctgcctatgtggaggctgggaagggatattttttcatcacatttgagttcggaatccagaaacataacatttccataatacccagacattttggccaagatgttcaaagtataaagtgtatcagggttgattatgaatttaataagaacttaattggactactagaatgtaatcacatttattaactctagatccatttctaagcttctctcctcagtgaccaagtgtatttgaatttgtagaaaaataattcaggagaatgatttcttaatatgataactctctcttttagaggaaagaagtttgagaagaggcatattgaaatattcactgacctcagcagccgattcagcaaaagtcagctggatattataattcatagcttgaagaaatgtgacatctccctgcaattcttgtaagatcctaagaataatgcatgtagacaaatcctatgatttcctaatatagtgaatgggccctctgtatagagtacttggtttatgggaattttcgctttctgctccaaggctgaatctgtcagatgactgactactcagcaaacatttgctggttactctctgtgttctaggaactgttctgagtggtcgtgacaaaaagatgaaagtcagtgatccagaagaattgagcttagtggcagatcattgtttagtgttcttagactcaaagaattgaggattagaagaaccctttgaggatattcaatttgtctccttcctgcatagaaggctttacccaaacaattagcagattgatggatttttttttttcttaaacagctctagagaactgtgtcctatacagagtgcatgttttagggtagacaggaatgccaacttgggaatcattctaaatacataacatgtttatgtttaactcttttcagatccaaaagttgtggacacatatataaaatttaatttgcttctgttaattcagagatggagtataaaacttcaggggaaaaatatgtatttcacaatttattagggagagaattcctcctcaaaaagtaacttgaatattccctccgggatttactttctctgtgttatatccctaacaaaaatttcttttcactacactaacccttcttgctgcatttgaaacatattttttcttgtcctatttttggtgaaagttgagtgatggtatagaatgttgaattattaatcttctgggaatactcgtttttcaaattgagagctatgccaagaagcctctaggttagagtggtaagcctttggcttcataaaatgcctgcctgggggtattaagaacttgttttgcatgtgtgagtagtcttctcttaagactacagagcgacatctcctttctgtacgactgtggaaaaagagttcagaataacccatcaaaccaatacttgttaagatggtacttcagagaaattaagtgcttttaagtgacacttcttactgagttgaggtttttctcagtacttcagaagcccagcacagcttctggtcctttttcataatctcaggatgcctttacatgttagaagcagactgcatttcagtgaatgtcattcgaaagagctactctttttttccatgagcaatacagaaaagtgcagaagaggaagcatagcctttgcttctatttgctttttatttggttgtatttttttcttggtaatatgctttcttcctgtgctacaaacctccagcatacaaagtagagttcatagttttactgtttggtgtattccatgtacagctgattgttgtaattggactaaaaaaataccagcagctcagagaagccctgtgttctgtttttaatttatttttaatttttttttttagaaacgtcttctgtagtggcatagttatagctcactgcagcctaaaactcttgggttcaagtgaacctcctaccggagccttctgtatagctgagactatagatgcatgttaccacacccagcagtttttagtttttcttggttgttgtttgtttttgagatggagtctcgcactgttgcccaggctggagtgcagtggtgcaatctcggctcactgcaacctccgcctcccaggctcaagcagttctcctatctcagcctccctagtagctgggatttcaggtgtgtgccaccacgcccggctaatatttgtatttttagtagagatggggttttaccatgttggccaggctggtcttgaactccggacctcaagtgatccacctgcctcgccctcccaaagtgctgggattacaggcgtgagccactgtgcctggcacagtttttagtttcttctactgactactgaggaagcttatttctgatctaacgcagaatagacagaacagttattatttctttttccaggataacttcctttctcttcacttttacgacatttgtccttttctggttattgctttgaaaacaggagtaacctgatgcaaaccctgtgtctcacactttcctccctggaaactttttacctgataaatgcaggacatgcaaattacatcatgctgtatttgctaagtatatgaagaaaaattgtaaacagccttattttaagtgtagcaaataaaatgagaaatcaccttaaaaacaaatttatttctcacagttctggaggccgggaagtccaagatcacagcactaacagatttggtgtctgctgagagatctttgctctcaagatggtgccttattgctgtgtcatcccatgtcaaaagggctaacactgttctcacgtggtggaaggacataaaaggcaaaaatggcaaaaagcctctcccttcaaccattttttttaaggtcgctaattccatttatgagttccccaccctcaggacttcattacctcctaaagggcctctgtcttaatagtatcatattggtgattaggtttcaaaataatgattttgggggacacgtgtagaccattacagtgtggaagaggccagtcggagagagtgaagccagcataaaggcaaatgaaggtaaaatagagacagagagagtaatccttgccacagttgagaccctgggtctggacttcctaaggccttgtgccaccctgccctttcagttacttggttatgtagtagccagtgattttccccttttacaaaccaaagaggtttcagtcacttgaaactgggagaatattggctaaggtaggtaagagtcgtttgacagatgagaaatttgaaacttgaaaaggttgactgatgtgctcattttctcatagctgatgagttacagttacaggattagaacactaactactgttgatctttcttaatagcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcaggtaagaattgaaaacattgatgggaatttttaattgtacccacgtaaatttctcttttgattagaggtctcccaaatgtttcctttttctgggccactctctaattagtcattgcttaatattctgagttttattaaagaaatagtacacccacccttaatcaccctttttaaagtttgtgttcttggcacatgtttctcatttatttccaggacctgtgtcagtgaagttcaggaatatatagataccatgagaaattaacaagtcaaattgcaaaagatgaaatagtagatttcttcattatgccaagcttgggatacattttttgggcccttttttttttacacatctacaaaaaacattattaattatagaaagtggtctcagatctgagatagtcagtatcttcttatcatcctattaaggttttagaaagtagcatactatggtatagtgattttttttttaaacttttgatcacaaagcagtttgattgagtgaaaaaaaaaaaaacctgcaatgtaaagagttcatagcctacttactttacgtgggcgttggaaaggcaaaatgatttaagaaaagtgaattccttgaagtaccgtataacaataaagcaaactgctttttcaaccatccagctagagactatggaagagaccatctcctttatccatcttattcttggttggaattggacatacatgcattttgagcaaagaacctaagaagaatcggtggcatctagaatagtgtgtgtcctatggggttcaatttggtaaaagtggcaatagagtactttacatagcagtatggcttgggtggttcaaattctcaggggtaatactgcttgatattcttgaattatttccagcttatcagtctgtacacaaaatactggctgtttaagcacattgaagtagtgattgaacaactagaatttttttaagtagctacagtgtatatctccttaatattttttctaaacgaccatttttaatatttctgatgagctataattgacaaaaattatgttctgattttctaaatacagacagccttgaaaaatgataggtaaatttaggaaacagaattgcccacgggattgccctaggaatcagtgaggaatcctgtgaggtgaagtttcttggcgtaatgtgttcttgtcacaatatttacagatatgtgttcctaagttgtttctctttcaaattttggaataaatgccttaagctaaacatattacccatgatatcacaaagaaaaattaggctggacacggtggcttatgcttgtaattccagcactttgggaggctgaggtgggcagatcacttgaggtcaggagttcgagaccagcccagccagcgtggcgaaaccccgtctctactaaaaataaaaaaattagctgggcatggtggtgcatgcctgtagtcctagctacttgagaggctgaggcaagtgaatcacttgaacctaggaggcggaggttgcaatgagccaagatcatgccactgcactccagcctgggtgacagagcgagactccgtctcaaaaagaaaagaaaaattagaggccaatatagattactctttaaaaagtgtttttgtttgttttttaaatttttctgtagcatatcagatagggaaattactgactatgcattgttttagcatttcgacgctactttgattttaggtctgccatgaaggtgtagaccagaactttgccatccagtacagtagccattagctacatgtggctatttaaattcaagttagttaaaattaaatacattttaaaattgagtcccttagtcatattatctgtgtttgaagtgtctattgggctagcatggttagaaatagaacattaccatcattgcagaaagttgtactggacagcactggactagattatctccatatagatcttaggaagagaacttgacatctacctgaggagattgagctctactgcagaactgagtcagttgttcttagattttttttgagacagggtctagctctgtcatccaggctggaatgcagtgacgtgatctcagctcactgcaacctctgcctcccaggttctagcaattctcatgcctcagcctcccaagtagctgggattacaggcatgcgacaccatgcccagctactcagatcttatatattggatgcccgtctttagaattttccctgaaatagaatctaaatctcatggtgattttaggccatgaggtttatattctgtttgactagtaatgttgtatgagacacgttagacctggttcagacccattcattcctcagcaaatccaaagccattgtgcaccataggctttggaagctgggtgtcaggtaagatatctactattcgttgtaaattatttctgaaaattggagtctcttgcgacctgtctgtccataactctgtggataatgtaaaataattctctttaccactttgtagatctgttttttatctgtaccaaggagttcagccagaaagtctggactgtatgctttgagtgtattttgtcattaatttctttgctgcttattttagtgaataccacaaattccacctatctcctatcatcttccctgttgtgtttgattatgggccagatgaaaatatgattgattttcacttttgtttaaatgaagcagcactccacaacactgtttgcacctctccccagcttttcccaccagtaagaaacctagagttaacgtgctttaccttgagactaaatatgaactaaattcctttattccttggatagtctttaactctcactattatatacatataaaaatgtgtatctttaatattcagaattggaattaatgaattatagagttgtaaacagtgatgataattataggatggtgccctccctttgatactctagaacagaggttcttttttttttccttttttcttttttttttttgagacaaagtttcattcttgttggccaggctggagtgcaatggcgcgatctcagctcaccgcaacctccgcctcccaggttcaagtgattctcctacctcagcctccctagtagctgggattacagccatgcgccaccacacctggctaattttgtatttttactagagatggggtttctccatgttggtcaggctgatcttgagctcccgacctcaggtgatccgcctgccttggcctcccaaagtgctaggattacaggtgtaagtcactatgccggccctgagcagaagttcttatcctcaggtccgtggttttcagggagttggtagtgaatcctttatattgtgtgcagactcattcatgaatgtgcttttatcacatcctcaaaggtgtgctggtcctgaaaaaatgttaagaacctctggcagagttgaaataaagtattgaataagaggaaaatagagctgttcattttcacctgttagtaaagtaattcagctcctcttcccttctaagccaactcactcttgccctggctatatctcccaacttgtggttgttgttttccggccatctcctgctgtttctctctttataattaacattagctcacttctcattgtagaaaatcaaatgcatcatccagcacaagttaacatttaaaaattgttgctttcattttatatttttctttattaagtgagagtctgagaaaactgtgcgtcttcaagaaaattgagaggcattccattcactggccctgccgactgaccattggctccaatttgtctataaggattgcagcctataaatcggtaagtggcaggtacacatttttaacagaaatgttaccaggcagataaatatgtgtatataaggaacagacaattcatgtgtgtgttactcggaaccataattactgcttttctagttgttctccctgctcatttaatctctgtttagctttttgtgtaaaaggcaggctaggagaggaagtttaaagaattgtctataatagagtttgatttcctcctcttttactttctctccattggtaattgattgttaatcataagttctaggcctgtctcttttttttaaaagaaagaaaatgaaatgcattaagctgtgttattgtagtatcatagcagaaatgtagataatgcaccaaagttaagttcagttttggagctcagtgacacctaattcaattatgaatgatctgatagtaacaacatctgtgaaatgtaaaaaaatgttttgttactgtaaaattgcattttataatatatgtacatttatatacaatagcacactttaaaaaatgagttgcttttggtgattatttgatgaaattctagtttgagtaggaatctgatgcgtgccttcatataagcctccttgcctttttcctttaagtgttcaaaataaataggaacattttagacatataaaataaatatacaaaaacatgtttttatgtatttagtttttttctttgtatattaaagaacttaattccaaaatacatgatatatctgtgagaaccttggggcagttctttatttatttcagcttccatcaaagcctagaatagtgtccctaggaatgtgaatatagtctccctcctcttttattttggcctgcttttcaaatttctttgttgatttctgacacagatatattgcttcttttttttttttctattggaaactatgataaaatgtatagtcctctttttattaaacagtctggctgggtgcagtgactcatgcctgtaattccagcactttcagaggctgaggtgagcagatcactttaggccaggagttcgaaaccagcctggtcaacctgtctctactaaaaacacaaaaatagccaggcatggtgatgtgcgtctgtagtcccagctacttgggtgtctgaggcatgagtatcacttaatcccgggaggcggaggttgcagtgagccaggattgcaccactgcactccaacctgagcgatagagcaagactctgtctcaaaaaataaaaataaataaataaaaatattagacagtctgaggttttgtatagaaagtgtgaatgtaaatatttgtggattacttttgggagaaaatgaaatgtagagaaggttatccagtatattttgttatgaaataaactaaaattttcataataggcatgagcaaacaaaataatggagctagagtaattgttctggatttttgtctgtgccagagagtgtattaggttttcatcttctatcaattggaatcctaactttccttgttttccctttgtgttttggaatgtaagattctacaggagagagttaaaaagacttggacagttgtggatgcaaaaaccctaaaaaaagaagatatacaaaaagaaacagtttattgcttaaatgatgatgatgaaactgaagttttaaaagaggatattattcaaggtatgtcagtaagagttttcactgttgcctaaaagacattttcttcaacatgatgtgatgcaggctggggtttgtattattctttgtttaaagttatttctttgagttatagaaatataacagtttgaaaggataatgagaccctaggtcctttagctcatttgttgggtcttaggcaggttgcttctcaggagtacacttgggtgttccatctctgtgagttttaaatgtcttaagtgatagtactcaatacttggctttattttaaagtttgaaactcactagctaggagcatgtttaatatggttgaactaaggtttttttgtttgttttatttttgactttcatggtgattattcttctaagggccaacttcaggttttatgtcctaccagatatgcttccttaatttaggggctgaaaattatttgtatttattatattgcttcatattaaataggattttttaaaagttgtactcctatgttatacccatttggattgaatagtgtgtctagatggcatctttatccagaggacttagaaactagctgaggatatctgtatgttcaagacctaaaattattaagataccaaatgatggttaagatagaaacaagagtccttagataaatgttttgccaggctattcactacccagtatagttttgatttgcaagtcttgaaaagaattcttttcctctgtgacactgtatttcatcttacagtgtatatatttgtgtgtgttggaggagggggttgtttaaaggtggtggtggttatgattccttcctttctcctgatggattatatgtagaatataattaataccctacaatttctaccagttcttgaattcaattctgtagcatagaacatgaattttggaatcaaacctgggttagaatcatggttccatcattggttaatcatttgatcctagtataatgactggctcatagtaggaagaatagcatgattaaagccacaagacctggaaagtagggggacttctcagagatactaagtagtccacttgggttggtgtattgagcatatacaggttagtacttgagggtaacatctaatggacagcctgcattttctcttttaatcatcagcgaccatcttataaagcaggcactctttgttatttccattttatagataagggaactgaggctgaaagacactcgttcacatattcaaagccccacagttctcaactagcaggacttggatctaggcctgtactgcttcagagtctgtgcctgcattctattctgaatttggactgagtaatgaagggctttggataataggctaagagtttatgcataaccttgaaaacaacgtggagccacttacagttttgaggaagagaatgtcactggggctatattttaagaagattaatatgacaactggttgtaggatggattggaaggagaaggatctagtgataaggatggatgccagttcttttggttgtcagcaaggaaggcatccctggttatcttaggcaaaaaggaaatttattgctggggcaatggagagggaagagttaaaaactgcttgggttcaaagagcgtagaagtgcatcttttctcctgtcctccagtttccagcccctaatcagctagaggtttttgctttttgttttttgttttttcttgaactaagggaccagtatacacatgtgggcaaaggaatctggttaaatgttgtagtctattgtaagtatacaatgtacaaaagttggagttatatgccatttcagtagatgaaccagaaaacatgaaacagttttagttagaatgttcattacaagttacacaattcacacgattcaagtaagatgatgactgatgacagagattaagacaaacatttggtttaggtaccagtcttaatcatgtgccatacatttccctgttaattttttgttggaaagtttggttttgtcactagctttttaaaaaagacatacatggaaataaaaatgtgtttctattttgagacggagtcttgctctgtcgcccagactggagtacagtggtgtgatctcagctcactgcaacctccacctcccaggttcaagtgattctcctgcctcagcctcctgagtagctgggactacaggcgcgtgccaccatgcctggctaatttttttttgtatttttagtagagacagagtttcactgtgttagccaggatggtctcaatctcctgaccttgtgatccacctgcctcggcctccccaagtgctaggattacaggtgtgagccactgtgcctggcctaaaagtgtgtttctttttaataaaataaatgtcatcaacagactaacaggaacaaataaacactagatcacagaatctgtccctggatatgaaagttttattgtgtcttggggtaaagatgcatgtgcttttcctttgcatttgtccaaggccagaatccttggattttgatgctccttcttcccacaaaacatagaagatactgtgtattgaaagggtgtgatttttcatagaatataggctacagaacagggctggactttttttttttttttttaagaagccgagagcctatgtttatataaatatcctatgtaattaaaaagaaaaatacagttaaatcccagaaataaaagaaatttaaatatagaaaaatatataacttatcaattgaatgtttccaaacagaagagttttagcttctgtcaggcattgcatatctccagcatacgtttttgagaacattttgttctgaaaatttcctgttggcatttttctctgtgggtctctaggtttctgaataatgtgttcttatgtttacaaatcatgctgtactttagtcaaccatggtttatctttggaggataactagtacgttaacatttgccagattttttcttttaggctgggtaatcattgagctaactagattgcaaaatatgctactttaaaaaatgtaattagattttaatcatctctatattgtatgtgtggtttgtgtatctgctgctgctttttcaccattgatcacaaggggcagtcatctgattccagggaatagaagatggaggcttgctctggcgtgtgcgtgtgttgttaatgtatgcatggaactaatttcagcttgtagaaaatgaggccccatatgcttaacagatgctcttctctttttctccagggttccgctatggaagtgatatagttcctttctctaaagtggatgaggaacaaatgaaatataaatcggaggggaagtgcttctctgttttgggattttgtaaatcttctcaggtatgattgtgaacaaactaaatgagctttttcctagctgttatttgaaatggtatgcttttgattggtcattttatttataaggtatatttatttcacttttaatttttctaaaatgtagtctgggggttaatgttgccatggtatgtattttatacattgggaaactgaggttcagagccgttaagtaaatctatatgagcatagcaaactaaaaatacaggatggtttttgaatggggaatggaagcggagatgaggggtatttgaattatgtgggcctaaccctcatccctttgaggttcagtcttcttgagctggtattatggtgaaagtgctcataatgtctcaactctagaggtgggagggcataaaaatgcatgagaaacattgcccaatacagcacattgcatgttcttgaaaataaaccgcaggctccagatttcatagatcagacaaagttgatcttggtagataagtgcaggtggttatgattttcagaactcttcaatactcattttctaatctggtattagtagagctgtcttgacccctcttgatactgtgctagataagttaattgaatttaagggggtggggggagagacatgcagtacttatttttgatttaatttctctttctttcaacccttcccctctaagtcttcactcaagcctctactgttcatcagtgcctcagtgttactcttaggaggaaatgcaaaccacttagctttgtttttaggagacttcatcatctgatctttgttaatctctgtaatctaatttttcacctttcctctcacacagtggcactgtactactccaagagcagttctccaaatgtaccatgcttttacagcactccagacttctattgatactgttttctctgcctggaacgcttgtgcccagacttttctcttagttcctatttgtccttttaagtctcgacttaggtgtcaccgtttgcagaaaccttccctgatccctcatgaccaggcttggtgccctccttatgtgctcttaaagcaccatgtaaccctggaccataatactacactgcagttaatttcatatttatctattgaagctcctcaagggcaagattatgttttgttcactgttgtgtttacagtgctcagataatcttgaacgcatgctgggtgctcagatatttgttgtgttgtattgaattaaacttcaggtaataaggtgtttttagtatctgaatgtttttcagtaagaggattttgaatggaatttcttggcaatgtgtgtcatggttatacatgttacttattttggatcaaaagcaattcttttcctctcttgtaggttcagagaagattcttcatgggaaatcaagttctaaaggtctttgcagcaagagatgatgaggtgagttggcagcaggtctttgaggtagtgctacagaattgaattgtaagtctatgaaagcaagttgtttggggcttttatagtttaaaatgacatgaattcttgcaataggagtggggaaatccactgatgtttaactgaaaatggagatgtggtaaatggatttgtgttagcatgagcacaagacccgaggacatggagaccaaggaagtattaaaaacattttgaaccactgcatttaggaatgggaatttcacagtcaaatgttaaggagggttggggtcaggttgacattttgtgttgtcataagcatcctggatgtgcacttcagtgactcactagactgcttttgtcattgaggaaatgtgtcttttctctattcctctctcttggtactcttcctgcctccccaagatactctgttttcaggctggtttttctctagctaacagcctatgactgctgcattctatactcacatctgccctttctgtaaatatttactgtttgatctccaagttagaactaactttgttggagatactgattttaactggaagattgcaatctactatctgtttaaggcagctcaagcaggtttccaagttcctgaagtatttgcatttgtaattaataaactggatgtagaaggcttgtttggggtgggggtagggtggtggtataactagtatagttctctttttctcctcacttctggaaggtagctggttgctgatatagtggatgggtatgccattattatctcagaacagttaagggaagaaaatgtttggcttctaccctgttctgaatgaattattagagcacaatattagcatacatgaatcttcaaatttgagaatcctacttcatggatttctcttgaatcaaatcctgttgggaatcatggaagtctagtatatactgtcaaaccacaacttagctgaagttttattttgttttgtttttttaagagacaagatctcatatgtttcccaggctggcctggaacctctgggctcaagcgattctcctacctctgtttcccagatagctgggactataggtgtgcgccaccattccttgcttctgctgaagttttaacttccacttactgtctctttatgcaaagaacattctgatcacttcatgagacttgctgggtatgcagtgaggaatcacaaagttgtgttgagacacacatgttgggtaatgatgtaggcttgctagctaagggcagccttgtggattgtgtaattcaaatctggccttatacaacactaatttctgtatatcataggatcactttgagataactcaagaaaaacagatttatctcctaatggcaaagggatactctctagtgtcagtttttgaggtagtcaaaaaatgataatatctaattggagcttctgagataagcaagggagtaaggaaacaatgtcatatgaggacttccagtaaaacaaaacaaaagaatgcctggagaagacttgtgtaggtaggcaggggtgtaggagggatggcagacataatagcactcttcatgcatttggagaattatcttgtagaatagaaattaaactctgcttcgtatcagaggggtgaactggaaacagcaggtggtgctttttgttcaagatgaagaattattttgtcaacaaggattactgtccccactggattgttttcttgtaagatgatcagatccccatttctgtaagtttacaataaaagtctttatcaccactagtcagatgtacatgtggattgttaaactagatgaatactgttgttttttagctcaaatattctgattctttggataattccctctttaaaaagttttctctggtcattagcatataattttttgtattgagaatctatactttcatgtgctgatttgcactgtgtgtagaaaacaaggagggaaaagaaaggaaggaaatggagctttagttaagttatacacagctgtagtactgtttcaccatgtagcagtcattcacagccccatccttccttcttgtttttttttttgttttttttttttgagacggagtttggctttttgtagcccatgctggagtacagtggtacgttctcggttcactgtaacccctgcctcccgggttcaagtgattctcctgtctcagcctcccgagtagctgggattacagatgcctgccacaacgcccggctaatttttgtattttttgtagagaagggggtttcacgatgttggctaggctggtcttgaactcctgacctcaggtgatccacccccccccctcctcggcctcccaaagtgttgggattacagttgtgagccaccgtgcccagccccttccttcttttaaacatcctaattggtcctgtcaaagacatataaataaaaacttcaaacaaattggaagtaatctcttcctcagattctcattgtgcttatctagccctttcttatgggacttaactattagaacatacatgtttcatatttgctacatatctcatttctgctaataaagaatgtattaggtaagtgaggtcaaggacttggctttgttttttcacagggctcaagacagtgcctggcaaagaacaggcactgagtaaagtagcctttgaattgaactgaaaaagtaatgattctgttatgaaatctgtacaggattctaatggccaggtcttggggtcatagtttttttgtttgtttgtttgtttgttttgtttttacaacagcatggctgggaggtcataggtttttaactttgataaggttaaccgtgatagtgagagaagtacatagtgtttggggagtttctgcagagagagagagagagctgactaaggtaaatctggaatggagagggtatcaatttactaagcctagagaaaaggttagaagctggagagccagagattagtaaaggggcattctagctaggaggtaatggtatgagcaaaggccaagtatgagacctgcccccagtcagtgatcagctcagtgatgccagaatagaggaacgactggaagggagtgacgtgatgagctctgggaacagaggtggctgtcagggaagagatggatttgagagacagtatagaggtagaattggtagtttcgtgaacacttaaaaggtgagggatgaggcccagcactttgagaggccaaggtaggtggatcacttgaggtcaggagttcgagaccagtctgggcaacatggcaaaaccccatctctactaaaaatacaaaaagttagctgggcatggtggcgcgtgcctataattccagctactcgggaggctgaggcacaaacattgcttgaacgggggacacagaagctgcagtgagccgagattgtgccactgcactccagcctgggggacagagtgagactctgtctcaaaaaaaaaaaagtgaaggatgagaatggtgcggtggcattatcaaagaccggggtttccagtgtggttgattaggcaatgatgttaatggaaatagggaatccaggaggagaatgagggggaaagatagtaagtttaggttttagtcttgtcgtggtgaatgtgaacagttcatactgaacagtttgagataactgaagatgccatgtcagatatccaccagctagcaggcagtctaagtctagatcttaggagagttttaaaaatgaatgtacaggcctggtgcggtggctcacgcctgtaatcccagcactttgggaggccgaggcaggcggatcacctgaagttgggagtttgagaccagcctgaccaacatggagaaacctcgtctctactaaaaatacaaaattagccgggcgtggtggcacatacttgtaatcccagctacttgggaggctgaggcaggaagatcgcttgaacctgggaggtggaggttgcggtgagctgagatcacgccattgcattccagcctgggcaacaagagcgaaactgtgtctcaaaaaaaaaaaaaaagaaataaaagaatgtacagatttttgattcatcaactcatgggactggatgaaataatccccaagtagaattttagagtgagaggaggagggaaaggtctaaagtagaatttacaaattggtggagaaaagagaataatcaggggagaatgttgtttttgaagccatgaaggagaaagtatatagagacagtggaatggtgagatgctactgtcaaacaaaaaaatcgagaaccaaggagttggcaattagaaggtgatgggtgacttcagaggataatttcattaaggaagtgggggcagtagctggactagactgaagaataataatgcactaagcagtggaaacagcatgcctattattttaagaaattcagaggtaaagacaggaaagatactgatagcaatttgtggagagggaaggacaaacaaaagatttgtttaggagggctgacatgagtttatttttagggtaaagataaaaatttagagaaggaaggttgaagcagtaagacggatttagttaatgaggttaagtcccagaagagctacagtaaatgtaatcaaaagcaaatgtgtgcacttcgtccttcaagtcagggggcaccctaaaaaatgtaaaatagaaagaaagtgataacagtcttaaagtattgagttctgttgtgaaaactctcacatgttgaatatgtgttaatacatccatctttcttaccaggcagctgcagttgcactttcctccctgattcatgctttggatgacttagacatggtggccatagttcgatatgcttatgacaaaagagctaatcctcaagtcggcgtggcttttcctcatatcaagcataactatgaggtaaaacccaaagtcttaatgttattttttttcttcagttcctttattctaagcagtgtttctcagctgttaatgttcatgacaattacttggggatcttgttaaaatgcagatcctcattgtgtagttctggggcagggcccagattctctgtttctctcgagaaatgctgatactggtctgtgaaccacactttcggttggaggaaaaagtatacgttataaaaataatataagaatcttttaattataaagtatcataagaatctttttattaagtattatgaaaatcgttttagattaaaagaataatcaataaaggttcaccatggccttttcttggttctcatccttcttgacttattggaaccaaatagagaaattacctccatttttacaaatgagaactatgaataaaggctgaggatatgattttgttgtgatctttgtgaaacggtttatttagggctctcttgtgtaaaatacagttctaaattccttatcatttcctctgtctcagagaacttactgtggccgaactggaaagagaaggcacatatcttgacttccaggtcaaccttctggtcaccctagtcttctcatttgttgtattggtcatgcatttgatagcagtcctttagtattcttttatacatttctcttatgcttaatattctttatactgtttgcagttgtgaacagccagtagcagaagtcaaaacacttcacttttcatatgccagagttgggctgtccgatttttgaaatatttctgttatgctactttcacagaatttgggatcagttttatattttttcattaatttcatcgtttctgcttttaccccctttctttctcattagtgtttagtgtatgtgcagctgcctttcatggaagacttgcggcaatacatgttttcatccttgaaaaacagtaagaaatatgctcccaccggtgagtttgttttcatttagatcactcattgactacacacactgttcttgggaaatcacctgtctgctagttgttggttggggctaggtatttatagggtgcaattagttggatttccaatcatacacttagacacagtaatgatgaaggtggtttacttggtgtttttccagtagtagggataggtttgccttaaactcacccaacactgtctagtttttgccttggagcatgtacctaggggaaagcttgatggtaatggatgtccatctctagttgtgagcagagtttgcccctgccgaagtgaatctgagcagtatcaaacctgtgactttagtgttctgtgtaaagtctgatgtagctttgaaatgaaaagtgacagtgctgaagattaacttttctctttgccctgtttttgtagtttgcaccaacagtccaagtctcattgttacttatttctggcttttaggagttacttcaggcttgatgtgaaagctcctgattgagcatctggctgcaaatgtcagggtcctatatagaattattcttagagccacaggtccagtcttccagagagcctgtcatttaaaacaattgtaataaaatataatagggggcagaagtagaaaacataccaaaaagaacaacaaatgatgagtagatgttttaggttacaagtttatatataatgtctgtgtctgtgttaagattagggaattgtgaggtgagtctcggaactcaattctttctgttattttggctagaccctttggaagtagtgtgctatagaaaggccaagaatcagatgggtccctagggcctgtatctttatcttccttctagaaatgagtctgtctgcatcacggtggaggcaggcatggacctgattatatggaagttgccactgtattacagtattactctgtctctatttcctgataattccaaaatttaaatgagtagaatatttaattatttatttatttgagacagggtctcactctgtcacctggctggagtgcagcggcgtgatcatagcttactggagcctcaaactccctgtgtattagttcattttcatactgctgataaagacatacccgagactgggaagaaaaagaggtttaattggacttacagttccacatggctggggaagcctcagaatcttggtgggaggcgaaaggcacttacatggtggcagcaagagaaaatgaggaagaagcaaaagtagaaacccctgataaacccatcagatctggagtgaataaatctatagacttattcactatcatgagaatagcacaagaaagaccagcccctctgattcatttacctccccctgggtctctcccacaacatgtgggaattctgggagatacaattcaagttgagatttgggtggggacacagccaattctggctcaagcaatcctcttgcctcggcctcctaagtagttgggactacaggtacgcgccaccgtggctggctcatttttaaaattgtttgtagagatggaatctcactatgttgttgtggctggtcttaaactcctgggttcaaacaatcctcacatctcagcctcccaaactgttggaattatgggtgtaagccatcacgtccagcccagaatatttttaaaaacccagtttattgataatttattttgtcgacataaatcactcaggatctgaaacattaaatatcttctgttatctattttctgtgagttaacatttgtttacattttctccattggaaaaatggaacattaaagttatttcatgtatttcccagtagatgtctatgtaggaatgcaatgccaggatgatctggcctcctgctaccttgtagtagtaggtgaaaatcactgaatgttcacatgtacaagtactgccccctacctgttgctgggagggccttgaattagcaagttcaagatggtgttggctgtgccattgcctgaaacctccatggtttcaccatgaaaagtccataaatgggtaaaaaagaaatatctgatgataaatatctgtatgctcttttattttgttgtagctgtacaaaagggatatttgaaaaggtgcagaatagaagtataatgtactttttaggaactacttactcttttccaccttttgcctggtgactgtgaatgttccagaaatagtgcctcaggttcaacagctgaactgctgtatgaatcagtaaaatgaaagttacacacagtagtttaggcagaagtatttttgggagaattgcctttcgtccatattgctttgggctgtaccatttttattgactgagtagatttttattgaggagcacttgttttttattagtattaggagagacctaaggaaagaggatgtcgtatttctgctctcatggaacttgagagtttgaatggagtagggcaagacatgtacgcaggtgtgagtagtgtcatggaggcattaagagaggagagagcttattcagcctcagtagattgtgaaggaatcagctcaccctgatccaatggtgtcttcctgttaaggtgctgtactctgataaaagttatattaaagtcattaaaatgcttatgcttcattaccagagaggttttttctttttaatgtttttcttctttagctaattactagtttttaaaatattagctcaatggatactaaatattttgttccagtctccttatagggattggtttttatatggctgtattcctctgaaacaaactttcttgcttttgatctgatactccattgtcagaggctcactgaatggtagaactggaacctaatcagtcagtcactctaaatcgatcttttcatggataagaaaaccaagacttgggttaaatacgtgcatagctagagaatactttggcagggccaggactgtataacctgccaatattgccgtggatatctctacgtagaaagcatttgttttagtggagaataatggaaataatcatttttctttcggcttctctgtttaagaggcacagttgaatgctgttgatgctttgattgactccatgagcttggcaaagaaagatgagaagacagacacccttgaagacttgtttccaaccaccaaaatcccaaatcctcgatttcagagattatttcaggtaagagaagaaggatgaacaagtcatatttcttttaaatgaaagagagctaagtgcaaagttgcggtaattggccagtcctaaataaatgtcttttttctctgaaggccccatttgctctatttaatggaagaataacatcttcctctcctacttcagaaggtaaaaatattctgagctcttaaaaagaaaaataaagttggaatgctttctttcttttcttttttttttttttttttttttttttcctggaagaagcttactttaacaaaaaaaatacaggaaggccagttgcctatgctggagtgcagtgttgtgatcatagctcactatagcctcaaactcctgtgctcaagcactcttcccgcctcagtctcctgaacagctgggattgcaggcacatgccaccatgcctggctcatttgtaaaaatttttgtgaagacaagtcttggccacgtgcggtggttcatgcctgtaatcccagcactttgggaggctgaggcaggtgcatcacttgaggtcaggagttcaagaccagcctggctaacatggtgaaaccctgtctctaccaaaaaataaaaaaattagccgggcatggtagcacgtgcctgtaatccgagcttctcaggaggctgaagtgggagaattgcttgaacctgggagatggagagtggagttagccgagatcacgaccctgtactccagcctgggcggcagaatgagaccgagtctttaaaaaaaaagaaaaaaaaaggttcctaggctggtctttaactcctaggctcaagcattctgagtagatgggactccaggtgtataccattgcccccagccagatgcctcttttatattttttcaggcttttctcctgtattgtatgtaaataacacttttctttgttttctatatcaaaatagtaggagagcttatatgaactctataataatataacattgttagagaagaagtgttctaatgtcacatttctcaaaaatttcataattaaagggagcataggggtcagataaaaaggttatattgtgaaattattaaagaataattaaaatacagaaaatataaaaaatcttctgaatctgagtccaaaggaattggaaggcagagattggattaaggtaaattggggaagttgacaagagagctgacttatgctgaggaaggggagggctagaccaaggttgaaggagaaaggaatattccagtcctggattcagttgatgacagcaggacataggcttctctgacccccacaaaactgaaaaaaaaattatataagcagctttttaaggcaagctgttgctcacagaggagtagagggcccttttctgcaggttgggggtaacagggcatgtgctgcagagaccacagattctcccttatgactcacttcatgaaacatctgtaactaacttaagtccatattggggcttgtgatttgagggatcctctacttgaaagaaactgcctgtttttttgatgcttgtaattcttttaagtagtgaaaaaaatcttttgttctaaaattagagatgtgaagcttaacatgtgaagacttgactctgaatactcatgcccctcagtttatgatggggatacacgcctataaacccatctaagttgagaatataagttgaaaatgcatttactacacctaacctaccaatcatcatagcttagcctcacctactttaaatgtgctcaaaacacttcacattagcctacagttgggcagaatcatctgacaatatcatgcactgtaaaggttgtctacccttgggagctgcagcttgatatcactgcccagcattgtaagtgtcctactgagttctactgaatgagtatcgctttcacactgttgtaaagtggaaaaattgtaaattgaaccatcataaaccagggaccatctgtactctagcatgctaagtgtaatgaagtataaattacagatataaaaatcctttggtgtttttttggcaaatgtacttgaagacctaaagccttgtgccatttgtaggaaaggtaggagcagaccagttcaaagcttaccaaaatggttcactgtggagaaaaagagaaacttctattaatactattttgcacacttatctacagtaggttgtatttatctttaataaatgcttattggaataacaaacagatacaagccataaatgcaggcatttttatattccaaagctgctgcaagcacgggctttgatttttattagtttgttttgtgggggagagtttttaatgtggcttatctatataaagaagtatcttcactaggatacataaacttaaaaaaaacttatttattgagtactaacaatgaaccacgtgcgaaagatactataagctgctttttttttttttatttttattttgagacggagtctcactctgtcacccaggctggagtgcagtggcgtgatcttggctcactgtgagctctgtctcctggttcacaccattctcctgcctcagcctcccgagtagctgggactacagatgcccgccaccacgcccggctaattttttttttttttgtatttttagtagagacggggtttcgctgtgttagccaggatagtctcgatctcctgaccttgtgatccgcccgcctcggcctccccaaagtgctgggattgcaggcgtgagccactgcacccggccaagcttacttcttttatggacccctctagaagaatgagaaaagtagagagagaaaaaaccagttgttaaaacagtggtgggaaaacaccatgagaataagaagaaaaagatttttgcaagtgggtgacttagggaaggctttgctgaggaattagcatttggacagagttctaaaagaacaaaggcggtgcatgtggtaaggagggcatgccatgcaaaataaataacatggaaaagcatgaaaatatgaagagccaggatgtggatccctttggctgcagaataagttctgtatggggaaatgatggaaaacgtgacagagaaggtaagtagtaagtaggttgtgaataccttgtatgccatactcagtcatttggattttacagcagtgggtaattaaagaattttcagtggcccacttgaaggcttaagagttaaagcagtgatggagagagtggagacgagaatcaattcttaaggcatttagaaggtatagatagaacttgagtgattgatggaaaataaagaggacttgaagataacaggatcctagcttgggtgactgaaaagatgatgtcaccattcaatatgataaggaatacagaatgagcaggtggaaaagataattcatttattttcacaagtgttaaatttgagaaaatctattggatatcctggtacagacactcattgggaagttacaaacagggttgcagagcctagaagacaagtcaggtctaaacacagatttgagagtcctcctcattgaggcagaaagacaagtgagtaagattgtctgggagagcacactgggtgagtaggagagagaacaaagtagagaactgcaacacgtgagtgaacaattagacatataaaaaagggttgttacaaaaccaaaccaaatgctcctacctccataccccaataaaaatcagcgaggtagaaaactaggagaaatgcatcttggaaggcacaggaagagacgagttggaaaggaaggaatcgcaagtcagatgcacaatggggagtagaggtgagcttagcaaagggtctttaggaatttgtagtccagtttgaggactttggggacacagaatcagttgagtaatggtgtgcaagccaggttacaatgcctagatgagaaagactttctgatgaagggagagagaaagagaggacacagtaatctataggaggttgtgggatccaggaaggccacttttttctttttgaaatacctacagttaagggtaaatgagcttggagaaggagagagagattaataattaatttgttatcaagaggttaatttaattctagttttggaaagaaatgctgaaaatatatcttgtcaagtatacagttaaaaccactttttaaataattgatacaatggtgctaaaatcagtatattggtaacttttgagctattgtggtctgtaggtttttcctctaatctttttcaaattgtaaaaatcacatccagtaacagttgcttaaaagagaaataaataggtgatctcagcttcccatctactcagaaatgtcactttctcataatcccatttttttagtgcattgggaatttttacctgaatgaattttgtaagtatctcgcttagcttaatttgcctaaaatgtgacctttcagaaaatatgagagggaggttggtacctcagaacatctcttgtagatcctttattattgacttaacggatgatgacactgaaaagattgcctggggtttatgctgaaaatctggaatgttttacagtaggaaggttgggtaggatacttgtccattggttgttctagcccttttccaagaaatgtcaattggatatcacagatagaatcttcaggagtttatgagaggtagtctgctatgttgggtgtttgattactgctttacatctttaggactttctaagctgttcaggtattttaatgaaccaagggagagcactgtgaataaaggattatgcataataagaaggtggtgagggggtagattcacagagtttgggatcttttggatttgcttaaacagtttggggattaccttgctttacattgaataggcctgatgttactgatgctcaagggaaagtcaagtaattaggaaagaagaaagcaggcatcaaactcagacaaacaaatgaatatactatggagaaggaatagttgtggttggtggttgaaatggggaagggagcagggagaagcgcatggaatttctggaggaaattggtacttaattcctacttcagggttttcgaaacttacaggacattgactcttggatgatactattaaacctaagcatcttttatttttttagaatagaaactttcagcttacattttcttcagtgtaggaaaggagtccaggggaccaggggatagtataaatcacatgctttgtgataggagcagtattttgaaattacaggagctcttcagctccctggtgttttgtttgttttttttagaattaccaatttataagttgtttaaaagtgggaatagttataccttaattttggaattaatcttcatcgaaggaaggaaaacatcaataaactgatagtttcatttctttctttgttttttaatgacatctaatcttactgctttctatactccttttagagcatttccttttctgggcaggccaaggcctggcccagtagacttgaggcaggataggtggttgaatgaggtggcatgctgtgtagaacttcactcacatgggcagtggagaatttgccctggccttgatcttggcgcccctcccccttggtgttgcttcttgacaccgctgtcaacaactagagccctggaaaagagcactttattccttcagctgttatcggccaggtgcttattatgtgccaggtagtatttttggtgcttagaattcattcagcagtaaagaagagaagagccctacttgtaaggaggagggttagataataaacaagtaaactaaaaaattgataattttagataatgatggagcctataaaaaatataaaataagggaagtgacagaaaatgactggggtggtagaatggggtggaggggctacttcatatagagtgtcagggaaggcctctctgcggagatagtatttcagcaaagactaaaatgatttttaaaaaaagggcaagggtggagctgactcttgaggtttagggaaagacagaggaggcagaggtagtgttaagcccaggccccaaagttaggatgagcttggtgtatgagcgaagcaggagcccagcctattggggttgtgagtgaggagaacaagtggctggtgatgcgatcgaggaggcaagcagggctgcatcataggaccctagggtatggtgagcagttcattctcggaccacttccagtcagacagtggaaagagaagctgggaaaccagttagaaggtgactggtaggccagggatgaggtgatagggcttgggcaagaatggtagcagtggggagagagaaaggtggatggacttgtgctgaaaagtgcaaactcagcactcagggacaactcagtattctcatctcttttgcagacctctctctgggactcactgagcatgggcagcttccctgtagccacctgtttcatccaccacatggcattctctgagattaagtgagggagaaagcacagcatgattaagagagataaaaggattataacaagaaagttataatcccagattatcaggtcttagaatcaggtattttagggaatcttgtatattccccaagtagtaaaaacaacagctttgatttataaggtgaggctcctttccaggaggtccagagcagaagatactgttgctaggcttggatctatttttacaattggttttaggtattgaccaatatcctgccaacaaaggtggttctaggtgaatcctcttgattgttttttacatgtggtatgaatcacttagccctcccacactaaagatggaggatccctgatcagaaaatataaagaagccatatatgtctccatctgtgttttaaaatccttactttttccaacagtgtctgctgcacagagctttacatccccgggagcctctacccccaattcagcagcatatttggaatatgctgaatcctcccgctgaggtgacaacaaaaagtcagattcctctctctaaaataaagaccctttttcctctgattgaagccaagaaaaaggatcaagtgactgctcaggaaattttccaagacaagtaagtacttggtatagttgcatttaacattggggtacataagagttgtggtcattttagagtggctctggaagtgtcacataggggtctatggaatttaaaaggtgagaggaagaagccttttgctatttggcccttatattgaaatattgatttcttatatctgtctgctgtgatcatattttatccttgctgttcactttggatttagagctaccttctgggctgatgactttttgatcagcatcagattcttggtgaattatatataatgtataattcagataagtttctgaatatctaaggctaaatgtcaccctttttaaagtaaagtactgagaatgagtgtgttgaagatcataggttttttgggttgggaggagattagatgttggggatgtcaatgagatttttggaggaaaagtgggaacaagagtgaaaaactatcaattcttcagccgttctattagtgtatcagtgatgtatttggttgtgctattggggaggtgtttgtagttttaagtattgcaaaatgcttttcatatacacttaaatcaagcttacaactggctattaagttttttccctcttctgttcacaatctgtgtcagcttccattcaaaacaaaacaaaaataaaacaagaagaaattgttgttgcttatccagaattatttgagtatgtaaaattgatttttaccaggtttaggtcaaccagttattggtgacttttttttctcaagctggaataatctatacatttcttttggctgtattttgaaatctgattttaaaccatgaatcttttccccttttttatttgatttttctctccacaactatctttattgacaaagcttcttatttataaataccccagtggagaagtattgagtaatttccggaagtcttcacaggtttctataaatcattgatttagagaattactgtctaaattgaatagaaagttgtgcacattctgtgactttctaaaggttaacatccaagctttgtcagaattgaaaaaaaaaatcatgtacttggttccgccgcaccaactgcccgccccccataagaccatctctcaaggaaattgatagattgtttcttgatagattttatgatgtgcatttcttacacatcctggagaggttttcatttctgtttagtctatcgttctacacaagaagactgtccctaaaaattcactttccccctgctatccttatctaccttctggatttgtattttaaaacagttcaataaaagtctgcagccttttctttctatgacaccttgctgaagtctcactgcaatcacagggctattctctctctgtgtgttaaatctccagtccgtgatcttgattaccttctggtgttgtgggaaagaaatgggccattttctgctcttccctttgattaaaatgtaaattagctagttaaaaaagcacaccacccagacccagaaggatgcagttctgtcgtttgatccctgctatgatcacacctttggctctggtcctgctgggcactcttctggaagcttgggtgtgctgagcttcttgttctttgctcccataatggctcgcagcatagctaagttaatcttgcaggggcctgagaagtatcttactcacacacgcttgctcacgctcctattctctctctcttctgagaaagcttagtttttaagaattgtggaaatgattcatttagcaaatattgagtaccacctgtattcaagaagaatggttcagtcctttctacaaggttctaaaacccctcaattttgatgataaagctccagtcagttctagaggtagtttttccaaggaaagaaaaaattgccaacaattcgcaatgtttttgtatatattcatcatctctggatccagggtacatatttctagtggaggggagaggggctaagatcaggagtggacaaatgtctgttcaggaagtttaatcatcttaagagctgggaatcattccagttttttcacttgatatgattttggtgaaataattttacctttatgagattttcttcacctaaagaaaaatctcaagagatactataacaatgaacaaagatattaaagcactttgagcaactgacatccttcacttaacgacagggatacattctgagaaccgtgtcattaggcaatttcgttgtgcgaatgtcacagagtgtacttacacgagcccacatggtagaatctactacacatctaggctatgtggtatggccttttgtcctcaaggtacaaacccgtgcagtgtgttactatactgaatactgtaggcatttgtaacaaagaggtatttgcatatataaacgtatctaatgatagatgcctagggaggctgaggtgggcagataaccgaggtcaggagttcgagacagtctggccaacatttttagtagagaatccccatctctactaaaaatacaaaaatgaactgggcgtggtggtgtgtgcctatagtcccagctacttgtgaggctgagacaggagaatctcttgaacctgggaggcagaggttgcagtgagctgagatcatgccactgcactccagcctgggcaacagagcgagactccatcttaattaaaaaagaaaaataaaagaaaacgtaatgctttgcgctatgatgtcatgacagccctgatgtcacaaggcgataagaatttttcagtttcattataatcttatgagaccaccattgtatatgtggctcatcattgaccaaaacgtcattccgtggcccaggaatgtatttggagggaaggcaatagtcaaaacctaaagcaataatagtatcattatctataaaaacattgaacctttgagaagatctgatatttgtcttggacttgttgaatacctagtgttagaagtgatttcatttcaagaggataagagcaccatttgacactgtagacccaaaatatactaaatattaccctcatcatataaaagcattgcttccatttatgttgctgtacacccttgaaatgaaaatgtcatctcttggacggggaacttgcatgagaattcggacatctcaggtctaatcctgcttgtgcagctgatgtatacgtgatcttgatttctgtttatgcaggtggtctaaagctttctgctcttttcaggtccacgaagactccttctcacttactctcagcagacatcctcacttggttaatggttaagacttcagactccagagtcagccaatatgagtcagaccccttgctctgcagtgtggccttaggcataggttacatatcctctcaaagcctcagtttcctcatgggtaaaatagggataataggaatatctgtcttatagagttgtcatgggggttaatgcgagcagtgtatgctgttcactcttgtatccctaggacctggcaaagtgcctagcaaatagtaagaacacagtgtttggagtaaatgattttaaaaatcctagtaatatgcctggcatgttagtagtgacaatgacagtagaggccaataggtggtgtattagcatcactcatgctgctataaagaaatacccaagactgggtaatttctaaaggaaagaggtttgattgactcacagttccacatggctggggaggccttgggaaacttacaatcatggcagaaggcgagggagaagcaaaggtgcatcttatgtggcagcaggcaagatcgagtgtatatcagcacagaagaaactaccttatataaaaccatcagatctcatgagaattcactcactatcacaagattagcatgagggaaccgcccccataatccattcacttcccacccgctctctccctaaacacctggggattacaattcaaaatgagatttggggctcggctcagtggctcatgcctgtaatcccagcactttgggaggccaaggcaggtggattacttgaggtcaggagttccagaccagcctggccaacatggtgaaaccctgtctccacacaaaaaaaatacaaaaattggttggctgtggtggcacaagcctgtaatccagccactcgggaggctgaggcacgaaaattgcttgaacctaggaggcggaggtttgcagtgggctgagatcacaccattacactccagcctaggcaacagagtgagactgtcttaaaaaaaaaagagagaaaaaaatttgggtgggaacacaaagcgtaaccgtatcaggtgagaactccgcagttttgtggcccatcttatctcaaaacatacctgtttttgcatgtacctcccttcttttcctgtctcagtgaaatagggtatttatttcatcctgcctaaagtgaattcctttacctgtgccctggatccttttttttcttgtttttttttttttaattttagtttttgagacagggtgtctctctgtcacccaggctggagtgcagtggcagggtcacagctcactgcagcctagacctcctgggctcaagtgatctcccaacttgaggatcctcagtagcctcctgagtaactcacgccggctaagttttttatattttgtcgagatagagtcttactttgttccctaggatggattcctttttctgcttcatctggtaccttaggccactaataatttcttctctctttctgtatttttagcttctccctcgctaccactaactcctttcttctctcatgttaaatttctttcatttaacacaaaatagtccccctagcttcttccctctaattactacctgttactaattactaatctaattattatctttccttccagaagccaggctcttggaagaatagtctattctgcaacctttctcagctctcattctcaccagcttttgcccccaccacatccttgaaactcatctttcaaaagacactaactgctaaattcacttcggctttgtggttctttgctttcttgacctctttgaagcacttgacactgtcagttattcctgctttcttgagactcatgtatctgtcttaacttcagcttctccaaatttttctttttcaatctttggcagctccctctcagattcctgtgggggctgcttttgtgtgtttttgtgttgatattctgtagaatttgtcctcagaaacagcaaacatttattgaaccttatgctgaagataatgggaagccattaaagcaagggtttttaatcagggttccaaagattgatatcaaggaatctgtgaactacctgaaattacattcagacttcaaaacttaatatgttaagtgctttacatgatgctaagtgctttacacacattatctgtttggacccacgttgccatcctatgaagtagattcttctgttgacccccaacttaaagctcaggagactcaggattagagaagatgagaaacttgcccaagattgtagttggtaggtgttggagtaaggatttaagtgtaggcagtctgactccagagcttgtacttcaaactgtaatgccactttgccttagcaatgcatgtcccaagacctcttttttatttcagagcctcaaaaactactaaatacctatcttcagctcggatttctatcccatcaactaaatagcttaggtgcctgtaggcccctccagttcagtaagccagaaatggctttgttatctgctttcttcttcctgctcctttccaacccctcttcatgctattattctctatttcagtgaatgacacctaatttcttgggagtcttccttttcttttacattctatatgtaattggtttaccaagttgtattatatttacctcaaatctaacgctttcacttaaggttagtctggtggctaatggcattgattttggggtcgaatttggagctaaactcaagcatttccccttaaaagcagttgaaattggcaagttgctcagtgtcaagtggcaataacaaatgcctgccttccaggaggttggttaggagaatgggtgagtacaggattagttctttccctttactgtgtgctttaaacaagggatcaaactttcttcaggcttagtttgctcatctgtaaaaggatgctgataatagctaactcatagggttgttgcaaaatttaactgagataatttaaatgtgtgtaacatagtgactagcacatggtaagcattaaaaagaaacgtaagctcttaatagcatcgcccactgccactgcttttatgtaggccttctcattttagcctgcctcactgacataagctcttcactaatttccctaatttgtcttacccctttccaattcatgctgctacctgagtgagtttaaaaaacaaacctgatcccatcactgtcttgcttaaaattcttaaaagtagtgattcttaatcatgtgtgaaagacagagagtgcagtgaactcacttgatacaaaatctatgaactgtcttcccagaaaaatgctttaacatactaagttttgaagtttggatataatttctggtagttcacagattccttgatgtcatctttggacccccaattaaaaaacgcttgctctaatggcctcccattatccccagcataaggtcaaactcttttacacagataagagaatccagataagcagaaagaaaagaggcatctattcataatccaactatctagagaaaaccattttctttttttaaagtaaataaaaatgaacttattaaaaaaaaccatttatcatttcacaacacatcaataaccaagtagaaaataaaaaaatatataaaagcctgggcaacatagtgagacctcatctctacaaaaaatataaaaattagctaggcatgatggcacacacctgtagtcccagctactctggaggctgaggcaggaggatcatttgagcccagggttcaaggtggcagtgagccattattacacctgtgaatagccactgcactccagcttgggcaacatagtgagactcccatctcaaaaaaaaaaaaaaaaaaagacaaggaactaataattaggatatacaaggacctcttggcaaatcaaaaaataatttttcaatttttccatggaaaaatggtcaaagattataaaaaagcaaatcacaggagcagaaactcagctggcttacaagtgtatgaagagatcttcaatctcaattagtaatcagaaatgtaaatcaaagcaaaaaaaaacattggcaaatatttttaaacattagatgataccagttgttggtgagaatatgggagaaacaggaacttctgtgtactgctaagggggaatgtaaactgttacagtaggacattagaagcaaccagtgtactcgtcactaggggaaaatggtctgtaaacatggtagatccatatcatggattatgctgcaagtaacagccacatggacagatctctaaggtcaccactgaaggaaaattaagaaaaagaataagatctataatagcctatatcatcttgtacttaaaaagcacatacataaagcagtactgtgtaacttaataaaaatatatacacatctaagatgtatctgatatatcggtgggtacaagagggtaagtggggtgcagagggagtgggaaaataactatgaaggggaaaggtactaaaatacaacgagaagggcctggcacagcccatatttgataatgtgctaagaagtcattagaaattttgaatgactgaattccctatacctgaggtccccctttaaaaagctcacccttcttatagacgaagaagcgaagacactaagttacaatgatataaattaagctaccaatgacaaagtgctcagtcaaccttctgccttgtgttgataacactaatctgccctagttatatctaaagaaaaatatactttcatacagatttcacagcttttcaacatccatatatctggaaagataagaacatttgtatatccttccatatgagtccttgtgattcgttgaggccataggttaagtttcctttcagtcattccaaggagaatcagcatgaccaagcaaagcaggttccaaaggcaggaagcagaagcaatatgatgctgtggaggtacctttctgaaacagtctcttctgctgttgtggggtctttgggcaacccttcaatttaagtgcttggcaacaagtctgctgagataggctgaccttgtagcttttgtagtctctatcgtacagcactggtcagatctacataagcctcatcgatgctgacgcattcaatcacagcaaaacaagacttcctccatcacttcaacactggcttcccggtacttggtgaggttagctttcccatggtactcacgaacttgtgccagtagaagacctggacttaacttctttgcatcatctgcctacatatagtgaccccaaatgcaagagcttcataactcactgcaattattctaccaccttccatgatttgtactacacagctgcacaagatttattcctcaaatgaggattttgccgctgctccattggaacaaagtctatgtccatgagagtaaccacacaatcctgtccagtagccatttttcaaggtaacagacacctggccagactgccagcagtgggtgccgcaaatgctgggctcggtgcccactggaaggaaaatggaagaagggcttttgaatatcttttcgcctttctggggagagtttcgagagatttattccccgtgatgacagaggaacagagaaggggtcgtgaaggatcctgcccaggcgaccgtccccacagttcagcagggatcagccgagagcagtgtgcccagcaacaaagccaccagactgaggacagacagcacgcacgctgcctagagaaaaccattttctttcctcacgttttttaatgctcctaattaatgtgttttctagctccttctctcactacgtcccagcttttgcaccttatgctttaacccaatacaactattttcttttttttttgttttttttttgttgttgttttttgagacggagtgtcactctgtcacccaggctggagtgcagtggcgccattgtggctcactgcaagctctgcctcccgggttcacgccattctcctgcctcagcctttcgagtagctgggactacaggtgcccgccaccatgcccggctaatgttttgtacttttaatagaggtggggtttcaccgtgttagccaggatgatctcgatctcctgacctcgtgatccgcctgcctcagcctcccgaagtgctgggattacaggcatgagccaccacgcccggccaatacaactattttctatcctctgaaagagataggcctatcacagtattttgttaattgtctatatgtatacttcaatttttatttggctgaaggtgttgatggtatattaatttttgtatattgagagtttagagtctagcttagtggctgatatatagtacatattcagtaaatattaggctaaataagtgaattgcaaaattcatacatgtttgtgaaagaaaataagaaaggagaaagaacaaattacccatggtctcatcatccagatgcaccaactgctgacatttatatgtctactgtgatcttgtgtgtataaatttctactttctagagcttagcgccttcatagataatttagggaagagagtcattaccctttcccacttcacatagagattatgaatttagtgtatgcaaaattcctaataatgctgttaaatgatttggcctggagaatattaaccatactaaattttactgtgttgtgcatatgactggggctacttttacttgcctggtacgggaaaattgtgtatgtgtctgtttacccttctttccctagaacctcattttggagggttgaagaaattcttcatgtgattcaacttcatattcccccacaacttagctttttatgtgtaatccttcttaatactactatataagctaatctgtatttgtggaagagaatagttgatatactgatggtagttttcatcatagtgctttcctaaggagcagactgaagctcagagaggtttgtagcttactagactctaaactctagatagataaaaattagtacacagtgaacgccatcaagaaggtgtaagatttcagggctagtcagtggcaaaatcgagactagaatccaggtcttttgactccaactcttcagtagtttaatgttgttggcttgtctcttgggaagaactggcaaaggttaattgaaatgactggctctgacctttttttttaaaacagactcaacttctaatggaatttcattctaccttggatttctcctttttttctttcatttttccacgaaggctgtgtgtttattttttattctacttgcaagaaaagagttctgggtgacttaccccttgtaatgtttcctggttcccacccttctgtcttctactttgctcttgtctacttctcaaagggaaaacatttagtggtgaatgggaaagatgccaaatagtgaaaattttaattcatggatgtatggctgtgatgattactttagttcttttacctacctctaagaggaaattcattattgaaattgaggaagcccatatatgttttattttctcttggcttcattttatttttaaaatttatttttgcttcatttttaaaataacttcattttcaagcctcattgtctgaaggttgaggctttgagcaaaaaaacaacacatttagaaattctagtcctgaaaattgctgagaaattttaactgttctcataataaaataagtaaatgaaataatgcatatgataattagcttaatttagctatttcacaataaatgcatattttaaaacattttgtacatgataatatatacaatttttatgttaaaataaatgaatttttaaaatttctagatcttggttactaattctcttatcatttagccatttctgatggctgcttttgccctagattgcatttctctctgggagaaaaaaatcttaatttctttatgttcagcagcttaagggagattacaggcagagtctttggatttgattttcttctcttttgcaattaacttgacctcctcttgactttaagacaggctgttaaagccagcatgttgcttgaggcaagatgtttgatatacttttccttagcacacagatgctactggactgttagcatattgcacaaaacagaattaggtttataaaagaacaaattaaaaagttttcggggaagttttttttttatagtttacgacttctttaagagggaaagctcttgcatagttaattaaggattgtctagtaagttttgacagttgtaaacagaggcttataaagctctaacatacatgatagagaaaacgggttgttagacacaaaggtcttctgtgtacatggaaagctaatagctgtcaattctgagacaggaactagaaaataatatctgaagagtaaatggatttcttacttaaatgttaaatttccattatctgtgcttgcagtttcatcttttccaaggaccttatgatgtgattgcttaattctgattctcatactgctgtgaaacaaagccagggctgcctcaagttaggcccttaggagcccggtggctaggaaagggaggcagcttgtttgtagaaggactacatgtagctattgtttttcttttctttttcttcttcattatttttcttttcttcttcttcttttttcttttttttttttggtgcttggaaaataagtttcacaatagcaatctggttttgtattgtttgttctaagagaaattttttttttcttttctagccatgaagatggacctacagctaaaaaattaaagactgagcaagggggagcccacttcagcgtctccagtctggctgaaggcagtgtcacctctgtaagctaagcttttcaagtgcgcttccccctttgcaggaaggttggggcttgagggagagtgcatcaatttttgttagtccgttcttaccactttcaagttaagatcatgatcactttctctggtccttgctctatagaagccaaaaagacccattccatacttctttaagtaattattatcatgaattgcctacagaattatctatatgatataaggtatatagagctctttatagaacgtggaacatctcagtgttgagattttgctgttggcattattttgcagcttttcaactagtcaaaatgataggataagtgggggttagtgatacgagccttaatcttcaagtacacacaatttaagttagtataactttcctattttctaacatgcaactttagaacaggattcacaagtttaggatttccccaagaatgtatcctttgatacatgagatttttattgaatgagaaattttttggaacttgaaaatactaccttaattaattaattaattaattaattaatttttatatcttggtcagccaggaggaagaatattttatttaattttagagataggttgtcactgtcacccacgccggagtacagtagtgtgattttagctcactgcagccttgaaatcctgagctcaagtggtcctcctgcctcagcctcctgtgtagctaggactaagggtacatgccaccatacccggctatttttcatagaggtggggtctcagtatgttactcctgggctcaagcaatcctcccgcttcagcctcccgaagcactgggattatagtcatgagtcactgcacccagccaaatagtgccttgttctaagcagcattagtgtgaatcaacaaatcttaaaaattggccgataactttttaacacaatgtactaggaaggatagtcagggaataaagggcatgcctttattctcacctcaaacagaaactcagaaaaattgaatgtgtgaaaaatgatttagatttcatttagatgttttatatataatagtaaaggaaaaagtcatgatcttgttctgagagcttttctgcttcctatatccaagcaaactggaagctttagtatattttggaaccccattgttttctttcttatgagctgagtggttcttaggccctgtgagggttggggccagcagattaaaaacataggtataatcagaaagttccatataatatggcagtttcgtctttcaaacttcctcacccagcactgcagtacatctttgtacataatctgcttttactttctgaggacatgttcaacctgggtatgctttgtatattctaccaaaacttcagtgccaaagggtcagcagcagtcccactaatgggcacttcggtgaatcaggcattaagctgtatttctcatgttatcttagtggggcaaatctattcgaaaccgaccccacactgcagaatcctcggctttctaattggttgggtgacaggatatacaggcagtctgtgctacacaaagccttccagctgggctggctggtggcttgagttgtaatacttttttgacccttctggaaagaaatcagctttcataaagcaaggtgagtgaaagcacagagggcagctcttggaccactgaaatctgccggcctttcacagagccctagaaatgaaaatgaatagaaaagcccttctctttgtctttggttttattttataagagcacacttattacattaagccatcttgtattgcctggggtgctgctaaaaagagaaataacctgtaggtttatcatctgttggtatattttaggttggaagtgtgaatcctgctgaaaacttccgtgttctagtgaaacagaagaaggccagctttgaggaaggtgagtggttgactttgcatttaggagaagctgtttagttaagctaactaatttaaagtctagattaagaactgtagccttttgttgtaacactttagcatttttctttactggcggatctttgtggttttcccttgttagggagctcactgaggcaacattatgagcacatgaaagtgaactcagcacagattttctcaaaaggaactaatttgtaggtctccctacagaaaaactttgggccaacaccttggcgcttatagctccacttcattgaagttttttaggattttgtcgtgagctataaataaaacacttttatgtcacatcttcctattttattttcttccttttttttctttttttttttgagatggagtttctctcttgttgcccaggctggagtgcaatggcatgatttcagcacaccacaacctctgcctcccgagttgaagcgattctcctacctcagcctcccgagtagctgggattacaggcgtgcaccaccatgcccagctaattttgtttagacggggtttctccatgttggtcaggctggtcttgaactcctgacctcaggtgatctgccagcctcagcctcccaaagtgctgggataacaggtgtgagccatcgtgcccggccacatcttcctattttcagagacacataattcttgttccagtcctaagagtttgtggcccatttatagtagacctagaaagaccttgatgctgcccctaaatttaatccttctcaaaatggctgcatggtcacttttccttatcaggtagtacctagaatctcatttaggctgtggctaacataaaaatagctttcagggatgcacagagggcctggaactaacattcattcacttgattgcattcaggtttctgttcatttaccctttaaatggtggcaactggcagttgttaatcctgcaggtttatatataaactattatattcattattgctggtccaagtctggcctgtctgcgagctgacttctacgtatgtgagtgtttatgtttgttcatgtgtgtatagaactttctcttccaacatcctgcagggagcaggggaatcacttttttttttttagtgacagggtctcgctgtgtcacccaggctggagtgcagtggcaggatcatagctcactataacgttggacctctgggctcaagtgatcctcccacttcggcctcccaaagctctgagattacatgtgtaagtcaccatgcctggccaaaaattactttttttctttttcttttttttggggggacagaatcttgctctgttgcccaggctggagtgcagtggtgagatctcagcttactgcagccttcaccctggcctcctgagtagctggaactacagttgcatacccccacgcccggctaatttttgtatttttagcacagacggggtttcgttatgttggccaggctggtcttgaactcttgacctcaagtgatctgcccaccttggtctcccaaagtgctgggattactgtgagccacggtggcatgagccaccgtgcccggcccaaaaatgagagttaaatgcctagaagcactactgcctgcagtaggtctaatgcatcttactacttgcagtctaggaatcctggcaagatccccagatctactgtgctgttgtccagaggcaagcatgagcagctgagcctcagagagagcttacagtctaccaggcttaaatcctgtcagcaggaatgccaaaggccaaaccatgagaatctccagaggaagaacagcttcgttatcacagtaatctgcagtctcttaagtggggtgtatatgtttttggttttgagatggaagaagagctttttgtcctgctaaaagttgccatataggagaaaaactttgagttttaacacaaaacaaaacctcatgtaaatagaaggagatctgaagttctaagtgacagttttctaggattggtgaaaacagtacttcagaatttctctctttaatgtattggagtgatcaagacactttcacagtattatacctgttgtctgttcagctgtatattgttacagggtgctcggaaagtggcggagatgctgctgtgacaagtcaatgaactcttgtctatcaagactattgtgtttttgaaggaaaattgagactttcctagctttcaattgtatgtcgtcaattacctcagccagtcaaagtccaaggtcccccgtttggaagtgattggactctgtggttggtgtaggcatggtcttttcagggactgaatctagctgtcatcaccattatatggtagccactagcggtttcatatttactatgttcaaggcattgtgctagcacttttatgttattttaattaccctgcattagcagttctgcaaaatcttgtgaagaaatgaagaaaatgttagagctttaacagcttttgccagaattttctgagaggattgctttacttgggaaaataactttgataagtgcttagggtagagaatgagtctccatccccagacttggttggctagtccagaggcttcggaggaaaggaagctcctcagcatcatagaagtagaaaaactggagctggtttaggagaggaggggcttagaagaagaggggagaggcagggagacaaagtgggtgaatttacgcacagtcacggccttctacaatacgtttcaaactcatgaccacaaattactcagtgtcagtacaactctggaaatgccaggtttaagtgctgtatttggggaaactggcagtttggtatctggcattatttcatgcagagcagagaaagcacctgagcacacaggaggccagagtctgaaaagaccaggagagagtcagttactgagaatctactcacatcttaggaaaatatgtcttacccctggccatgggattggggattcagagcagtcttgtgaaaatagcaagggcaagcggaccctagatagcatgtaagttaacaattagtattattatctccattttactgatggataaactgtaaaattggaggagatgcattttcccaaagatcacataggaattcaaacacatgtctctttcaaatactggattttttacgtagccatattgtttcttttgattcctaatgacttcctttcctacgctttttaaaacaacattttaaggtcgtgtatctgaaaccttgtacctactgataggacttttgatgaatagattgttcttttatattgaatttgactttgagacccagcatgttgctagtatttcgacaaaagatgtccctctgacctccgtctaagacttggtgaatcagagccctctagtgatgtcacaaaaccagactctccacagagctgtcggaaaatggattgcttattagcaactagttctcgtgattttaacttggcttccgttttatcccttctgccgttcttggtgccagctccagaattgatgtcctgttctttgttttgggcatcttgtttgtttgtttttccgctagggcatctttttactaacgccctttataagccaagactcacttctcttgcaggcccaaagagttctccctccctagtagtggtcttcttttagagagatttctgtccagagtcgggagacaggaatcccttccccttttctccagtaaatttattttttaaaattcagttgtcaaaagggcgatcagcgatagatagttggtaagattgtttgacccttaggtagaactcggctgttttacctatcattataaattaaaatatgggtgtagttactttttctcaggcctgatagtagcataatcaaactgagagtcttgtgattctgtccccgacatcagcagtctatatatagtaggcagctacacattttcttaacttctggttttcagtgtgagggatgtatcttgttctaagcttactggcagagaggagataaccaatgccctgaaccccaggaagcatgttctttctggctgcccttttcccagtccctttcctccattctccctacccatcaccattctatcaccacagagttagaatagaaaacaattttttttctcttttccttttttgtgaaggggtctcagtctgtcgcccagactggagtgcagtagcatgatcacagctcactgcagcctctacctcctgggctcaagtgattctaccacctccaccccgccaagtacctggagctacaggcacacactaccacaccaggctaatttttgtagtttttgtagagatgaggtttcgccatgttatccaggctggtcctgaactcctgagttcaagcgatctgcctgccttggcctcccaaagtgctgggattacaggtgtgagccaccaagtccagctcagaaaaaattttgaccacagctgtatatataataatcatctatcagttatgaaagtagggttgtttccctacatacactattcataagcacatcattgccatcatctgggatttgttacctgtcgttgtgggtttcagagtctccagaggctctttacattgagtttatccacttgtttggatatcttccacccagctaatcaacagagttgctaaggaggaatgccatgattttcagctccttgcgctttcccaacttaggaagaatgctaaaataaaataaaataataaaatgtcaaaagatagacagcaggttcaagaaggaaaagccacattacttctttcctccggacaattcctgcgcgattatgtctgaatttataaattcccactgagtatgggagataatgtaaaatagcttgaatgttcttggtgtgtcaaaaacaggttttgtgaggatcttaagagccagaaaggatggatatatggggacagataaaaggatggaatgtaacttaactttataatgagacgattctctttcagggaccttgtttttgccactgagattgtagtttctgtattaggcttgtgtgtagtgacagggtggcagagctccatgttaccaaattgaattcacttgagcctgactggtttaaaaaaagtctgtcaagagaagacctaagtagaaataatacagaccccaaacagccttaacatttgactcatgtacaagagagcagtaatatgtacttgtccatttgattagaaggtgatcacttcatttttttcccctttcactttgtttggattacgtctcatcctagagtctttttgcctttgttcttcaaccttctttaatctcacttactagaaacatcctttcatttttaaaagatatttcctaaaattcactttttccaagcaatttcagcactagatagaatatggtacaattagtaataatatgatattcatcaaagccaaatagttttcagtgttggttttgtatggtatagcactatcccatttgcatagctgtttacttacatacattatgtgattttctgccaggagtcaagccctaaacagtgaaccttcgagaattgtgatctagcagaaatctctctcgtgtgtgtgtgtgggtttgtgtgtgtgtgtgtgtgtgtgtgtgtgtgtgtgtgtgtgtgtgattttttttaattgatcctgattcatgtaatcttgggtatgaattatataatgaattatactctgcccagatagataagaagataaaaatatggcgtttttctacacagcgctggtaaatttaagaaaaataagctctttcaaataccttgagcatcttaaagatgctaaatacaaacagtcactaaaattttaaacatctttagccctataaaagtttttttcttaaagaatttgacatacttttttagtcctttctccaaatagcattgatacatctaatcatgagaaaattcatgattaaggattccagaggtttagtctgtactttgtatttttattaaatatctcacttgtttttcactggttttctttttgactcattttaaattattaaacctcagaacctgacaatccaggcttattttatgcctcatttatcaggacaagtggtctcattgtaacacaaaaatcagtgtgtttggaattgtagagaatacttgctgaaagggtgtgttatctgacatcgtaattatgcaccattggcctttaaggtgttgttcatctttcatgtgggcggactgaggcccagagtagttaggatgacttttcacagataattgcaaatatgtgaaagactctggatcaaattccagagagccaattcttggcctctgtggcttaaacctttttactggttgtgtatatttcattggatggcacagcaccaccctgaagtttacatcttaatataatgaaactcagcagccaaataatttagatgaaatcattgaaatagagatgaaaagaaaaaataaaaagcacatgacgtagaaactaaagaccattatgcacacataatcattttaagtattttcatttttcagcgactcttcctaaaaggctttcatctattcttacccagcctttaaaatccttttaagttcctgtcaatctgtatcagaatatccctaattacaggatatagctcttgtaaaatgtagcctggctatccattaagaaagagaaatgtgtggtagcataaaaatgaaagcatgtttgctgtagttacattctgttaactgaaaaaaatcacaagatctataaatttagaaaaagagagctttatttcttataaagggttacagcttgcaaggtggaaatagcaaggccaagtggaccctagatcgcatataagttacagtaagtattattatccccattctactgatagataaactaaaattggaggagatacattttccccaaagatcacataggaattcaaacgcatgtctctttcaaatactggattttttacttagccatactgtttcttttgattcctaatgccttcttttcctacactttttaaaacaacattatagggtcacatatctgaaaccttgtgcctgttgataggacttttgatgaaagcctgggaaaggctattcctagtctattcaaaggctgggaaacatggcctccagccaaagcccagagacaggcactatgaaggagggtttggggtaagagcattattgctgacctgattgactaaacatacatattcagcaggttacaggaggagctatgaatattcatgaaggtggtcctgatgcatgagtattaaacatgcatgttacgtaatacccatgttcaccttgcagggaagacttgacatttaaatattacagttagaccctgtacatcaaaaggtcttttcaggacacagcatgcaaatgtgccatctttgtaaaacccactagaaccagtccgtggttggtggtcttcttatcaggagaaagttaccgaaatcactctcttgtccaatcaaagctgtagttatggctggtggaacaagagttcagtaagtcagcatctggtagagctgcaaattgttttaaaaacaatattgcttatcccaaggccagtgcttttttagctgcttaagaaaaagaaaaaccttttggcagttagaacatagtttattctttaagtttaaggggtgcgacttaacccttgcctggcatggccttaggtcctgtttactacagtttgttctctcagtcttatgatacctattttaaaattaatgctggaaggttgtgtctaaattgcaaaaaggaggggtataatgaaatgcacctggccgggcgcagtggctcatggctataatcccagcactttgggaggctgaggtgggcagatcaggaggtcaagagattgagaccatcctgggcaacatggtgaaactaaaaaaaaaaaaaacaaacttaggtgggcatggtggtgcgcacctgtagtctcagctacttgggaggctgaggcaggaaaattgcttgaacccgggaggcggaggttgcagtgagctgaaatcgtgccactgcactccagcctggcgacagagcaagactgtgtctcaaaaaaaaaaaaaaaaaaaaaaaaaaaaaaaaagatgcacttgaccccttgtcgtgtcatgaccaaaaactcagttaaggttttctgggatcccctttgtcaagagggggtccatttcatcagtggggagcttaggatttctagtttacatttctcagtgagcacctgaatttcttcctgagagctttttaaaaagtccttatgaaatatatgacagtgttcctgttttctcccagtgttttgttttctcatgctacataggaaagttgcttcccttaaatgtgctgagtaatttttctctttttatattaaaaatggaaagaataatttcccatctggctgaaaatggaattcatgaaggctttctcagcatcataactagatgagcccagagtccattcaagcctttacttaatatactaaatcactcctgataccagtcttctatgaaggagagagagagagagagagacacttttaaaccatgagatatcaaaagaactcactgtcacaagaacagcaaaggggaagtcctctgccgtgattcattcacctcctaccaggctcctcctctaatttgatatgagatttgggcgggacacaaatccaaaccatatcatttcagcttgcatcaatgacttgggccatcagtgcaacaaggcaggtgctcacaattggttccgatggaaatgcagaactcttgggtgcttaggagaaagggcctgcagcttgctcttagaattcacccttgcagtaagtgctaatgagtatgatttgtgagacagagagcagttcaaggatttactcatggcaatttggttctttctttccacctcctgttaaattctgcagttcttccttccatggtaggtcattgtcatgtcatgtagggtattgtacttggttctccttgaattgggctgtcttcaagattgctccttaagcccagctggttgaaaaaggaaaccggtttcagattgtgctgatgtgcaaactgctttaatcaatgacttgaagtgactgctggtggcaaacaacagacgctcttaaccaattaagatatttaggaaaggatgttaggcttttgttaaaatagtcactaatgaactgaaatgtgttaagaggagccaagaaacagctaggagttccacttaaatgcaataaaagtgtttgggtcctcccctttcaaattgcatgcccaaggcaaaaaatatgctgacacagaaagaagtggcaagtgtaatttggtacagttagcctgtcagatccatgcgtgtctacataaaacctagaaaaatgtcgtgcttgcttctttggccagaaaagggaagggagtttaattcctttatagaacagtttcagcagggctggagaatattaccagcttagatgtctttggaaatgggagaaaatttaacttgtttttagaggttccttatgttttagaggttggagaaaaatcttcagttaatagtcataattaaaggcccgtttttattttcctctgtcagattaaactactgaaatctgtagttatctgttcatgtctctcagtggtaatgaggctcagccataacactcaggataatatggtatttcattggtagccatttgaagtcaggagccattgctcatataagaactacttttttacaattcccttgctcttggaatccaataatgttttcttggggcattgagagtaagatacactgtctaagttttcatacttattctgtgatagaaacatctagtttctctcttctgtctgtggtaaatctctacaagtctcttagataaattgcacttattaattctactttttaaaatagctttattgaagtaaaatcttctactataaaatatactggtaagtataatttgatgatcttttgtaaattatagagttgtgaaattatcaccacagttcaaagaacatttctctcacacccaaaaattcctgggacctgttcatagtcagtttgggtctggagtgcacacaggtggtgggaggttgcaaggtgatgctggcctacatgacttgttctgataatcctgagttattgcaccatctgttgaatgggctggcgccatcttgggcctgacgagttgtaaattagctgcagccttcaagtaataacccggtggtggaacattctatagatacctggattgtctctggaacttctaagcaaacataattagacaagctagcaatgcagtggagtgtctggtggaaaggaggagagtaaaggttgttatttcataactaaaaagttaatacaaagggcctcagaaggaaaagtttaagaaaaaaagactaaaaaatagaatactcggatacactccaactttgttcttttctaaaaatgttttaactactctatgtcatttgcgtttccatggaaactttagcatcagcttttcttttctttttttttttttttttgagacaaagtctcactctgtcacccaggctggagcacagtggtgcgatcctagctcactgtagcctccacctcccgggttcaagtgattctcgtgcctcagcctcctgagtagctgggattacaggcatgaggtactacgcctggctcatgtttgtatttttttaatagagacagggtttcgccatgttgaccaggctggttgaactcctgacctgaggtgatcaacctgccttggcctccaagttttgggattacatgcgtgagctgccgtgcctggcccagcttttcaatttatatgaaaaacccactggtattttgatagggattttattgagtctatagaagagttaagggaaaattgccattttaataatactgagttatccatgaacatggaatagttactcatttatttagatcttattttttctccataatgttttatagtttttagtgtacaagctatacagctcttttattaaatttattgccaagtattctttttgatgatgttgtgagtggaattgttttttaattttatttttggattatttgttgctggtatatagaaatgaaattatttatttattatatcttgcaaccttattaaacttattagttcttgtggttttttaaatatacttcttaggattctctacatacaggatcatattgtctgcaaataaagaaagctttacttcttcttttataacttgtaagtttttctttctttttttttaattattgtactggctggaacttctggcacagtgttgaatagaaataagagtgaacatccttgccctgttcctgatcttaaggaaaaacctttgtctttcactattagtatgatgttagttgtaagttttacccagatttcctttgtcagcttgagaaagtttccttctatttctaattggttgaaagtttttattatgaatggatgttgagttttgttagatgcattttctgcctctattgagatgactgtgatttttattcttctgctaatatattaattgacttatagttgttaaatcaaccttgcattccaagtataaaatccagtcgttctataaaatcctttttatatgtactgaattcatttagctaatgctacagtttgaataatgtcacccaaagtttatgtgttggaaacttaatccccattctaacggtgttgagaggtgggacctttaagaagtaattaggtcatggaggcatcattctcatgaaaggattcaggccattatcacttgagtgggttagttataaaaaggatgagttcggcctgatttcttctctgtctctggcttgcttctgccttctgatgtggggtggtctcctccagctgccggtgtcatgctcttagacttcccagcctccagaactgtgagctaaataaatatctgttctttataaattacccagtcttgggtattctgttatagcagcacaaaatacactaagacagctaatattttgttgggaaattgtttgtagttttcttgttttgtgtgatgtctttggttttggtaacaggaaaatactggactcatagaatgagttaggaagtttccttctcttcaagatttctattatttattctttacatatttcatataatttaccagtgaagccatctgagttctttgtggggagcttttgttttgttttgttttttgaattttgagattgtttcatttgaaggtcaccttaatgctcttaaattcaaaaatatgctaatttaaataccaaatcctattaatctaaaacacacattgcaaacatacaaatatctcttctcttcacatgtcagtgcccattcatgtcatggtttggaaatggggacagtagattccccttgagctgcaagtcagcatatgtttctttatagttaactttagcaaaatttatacaaaatagtaattaacaataatcttctttatttgttaactcaaaagaaaataccttcaaaactgcattttaagtttctgtactaaaatacagaaaaactacacaaatattgaaaagttgaaagttctttaatttttttattcctgttatcactaccacaatttacagggcaatatacttgatgtaatgaaaaagaaacagacaaagctacaacagataaaagagctcaggaatgtacgtctaatcgacactatattgcattcattaatagctgcacttttgcaaactgtggctatgatagtcctgcacaagaagggttttctgtttaagctgcaataacttttctgaccatggatcaccattccttctgtggcagatttttacagttcctctaatgcatttgggatgactatctcaaataacctgcaacttttgtgacaactccttgttctttctcctgctaagaattgtagcccctctctgctgtttttagaaccttctgctaccatatccgtcacgtctaccgccagatccgtaaccaccaccaccacaggaactccccgagcttcttccaccaaaactgcaccctttaatgggttcataatttgattgtttttgtctgctaaaatttccagaatcattatagttcccaccaccaccatagttaccactgccaaaatttcctccttcattgtaaccatcatatccttcaccactatccccatacccgccattgtggttttcatatcctggttcaccatctccatagcccccactactgctgtaggcaggcccaccaccattgttgcccaccgtcacctccacatccattatatccaccattacaccctccataaccacctctgctgccaccacctctacttctaccaccagagcctcctcttccaccaaagtttccaccacagccaaaattacttgcaccacttccagagtttcctccacaacccataaagttgtcagatccacctccatcacctctgtgatcctgcagactgcatctcttgtttagaaagggcctttttcactttacagttgtgcttgttaatagtgtggtgtttctaaacaacagttttatcaattgtatcatgatcatcaaaagttaaaagtgcacattctctctttttccactctgtcatccataacttgtatggtttcagtcttgctatagttttcagagtaatttctgaaactgtatctactttaataccaccagcaaaaatgttcttcactgttaggtgggcaccaggctttacagaatcctctctagaaacaactgtctttggttccactccacacccatcaaccttgtgtggtcaagcacacattgctgtgtccacctcttcaacacaagagaaagccataaaaccaaagcccctggaatgtttgcttggggttctgtcattaccacacaatctgtgagtgtgccccctttctcaaaatgttctcttaacccatcatctgtagttttaaagctcagaccaccaataaacaattttctcagccgcgctggattcctttggatcatggccttcctcctcttggcggcagtggcaatgacaacggccagagtcagcctaggggcaaccgggtagtggttttacctccattttaagactagacttgcctcctccaactcaagttcaacatggaactgtgaggaagaggctgtgggaagctttttaatactaattcaatttttttcttttttttggatacggggtctcactctgttgcccaggctggagtgtagtggtgtgatcttgactcactgcaacctctgtctcccgggttcaagccattctcctgcctcagcctcccaagcagctgggatgacaggcgcccgccaccacacccggcaaacttttgtatttttagtggagacgggatttcaccatattggctaggttggtctcgaactcctgacctcaagtgatccacccaccttggcctcccaaagtgctgggattacaggcgtgagccactgcaccgggcccaatttttaagctaataaatctggtcagttttaaaatttcttattgaatcagttttagtaatatgtctttataagaatttgttccttttgtctaattttttagtataacattgattattattcccttataataatatttttgagatctgttctttatttctgatttggggattttgtatcttccctttttcttggtcagtctaggtaaaggcttatggattttatctttttaagatcccagcttttagttagttttattgattttctccattattctcatttaattaatttctgctctgatctttattattccattccttcttcttactttggctgtaattcacttttcattttcttgtttcttaaggtggaagcttagatgattgatttgaaacctcttttctaatataggcatttaaagctatacatttcctgctaagcagttttttagcttcacaccataaattgcgatgtgttatgattttgttttcatttagtttaaatatattctaatgtctttcatgattgtttctttgactcttgggttatttaaatgtgttcttaaattccaaatattgaagatttcccaatttcttcctgttgttgatttttaattctgttatgattggagatcatactttgagtggcttcagtccgtctgaatttattcagacttgttcttatgtggtctcacatatagtctgttctgccagttgttctctatggccttaaaaagtacatgtattcacctgttactaggacaagtgtgctggaaatgtcagggcaatttggttgatagtttgttcaaatctgtcttttgactttctatctagttgttttccgtgacgttttgagtattgaaagttattcaccttgagaccttgtgtgctagtgagacctttatgattttggtctcacctagctaaaccagcttgggtcatgagatcctagtgaatttttacagggtgacactaaagaaaacactgtcaattcaggtaatagagtatatgttaaataaaagtcttcaggtattggcattttaggaaaaataaacttagctatgtgtgctgcaagactgtatgtgtttctgaatcctctgcttcgagggaaaaatcatattagtagaggataagtttactcagtactggaaaaattgtgtagattttaggaacttgttggagcagaaaggcgattaattgtgagaaatgaaagtcaattttagtggcagcaggtatatcaagtacatcaagtcttagttcaatgtttatagattttgaaaatttataggttcattattcctttcatttgtttcttcttttgtcccatttttgtcaagcatgtatttattttgtttgaatccttttttgtctcatggactgagaagaaaatataactaaggttggattatcccacaatttgctctgtgtctaattattctgaggtggattgtaatgaagccagcaagacttatacattggaattttaaatgtatgggattgtaaggagggtagaagctacaaaccaaagataagatatgcctgcagatctgcttcagatttcctgagggcagtagatgaaattatttctaagggcctttttcaccactgctctttaagtatatgagtaataaacaaaaagaacaaagtatgtggttcagaaggaataaaacaaaaaagaaagaaaaggatcaatgaaatagaagtattgtgtcaccccatgaaaattgtcttcctgttgagagctcactagaaatagaaacaattgttttttatctccttgtatgacaatctcttaactgtttcgagatgatttacttgcttcttaggcttccattaaaaataagcacatgcttatatgggggaaaatgcaaatagtaatataatagcatataaagttaaaaagtggacatctccttctttattgtctccctccctttgaaactctgcccatacccacattctgtgtcttcataggaataaccctgttcatccctactgatgccctgtattgtgatcaagatggttaattgttttagggtataataaattggggatatagtcagagacagtacattttgggagaaccctccattcccagtggcatcaagcagcttgatcaaagaaaagaaaaaggtgtacaccaagatgagatgaggcatacttagtaagcaataataaaacgtcaagatgtcttcatgcatataatcatgacaatgttggatgtgatatctcatccctgtacatctgcatatatatcttatatagcatgttattctttctgcatttcccccttcaatagagctttattgtaaccatttccatctctgtaaaattaagggagggaggggataaaagagagttctagactgtctactcccctaagtggcagccagtgctaaatacacagcttatgggtttaaactgaacgaacaacaaaaagacatgttcattccttaggcttttagaggaataaaccagtgaggcctacaccatttattcatccattcaacaattatttgttgaatgcctactgtgtgccagtcataccaagatacagacagtaaacaaataagaaaatatatgtcaaatggtgataagcatttgtgttagtgtcctagtgctgcagtaatggagttccacaaactgagtgccttaaagcagtggaagtttatccttgcagttctggagactaaagtccaaaatcacaggactgcttccttctgagaggtatgggggagaatctgttcaatgctctcttgtagcctttggtgacagctggcaattcttgcatcccttgacttatagatccattactgtaatctctccttctctcttaacaggggagttcttgtatgtctgtatccaagtttgcctcttcttataaggatgtcagtcctattggattagggcctttcctagtgacctcatcttaatttgatcacacatctgcaaggactctctttccaagtaaggtcacgttgtgaggttttggtaaggacaggaatgtgggggcggggtggggatactattcagcccatgacagcactatagagaaaagttaaagcaggatagtgggatagggaatgctgggttgagatgggcttataattttatgtagaggatcagggaagtcctcactgttgaactgagaattgaggatagtgagagagagaacctagtggatatctgggaggagagctttgcagacagagggagcagcatgttcttgagaagctcaagatgactatgcttggctagaagcatcagggaggtccgtgtgactggagcaaagaaagtaggagctgagaagtcagagagctggctggggtacatatcacataaggcctcctagaccttttgcttttctctgagtgaaatgtgaaaccattgaagagtttgaagtagcgaatgatctggttttatatttcataccatgttgaggaaaagggcaaggttgaggtaggcagatgagttagaaggcttcggcgttaatccacgtgaccggaggtagtaagaagaggtccgatttttgatctgttttgaaagtagaattgtcaagttttgctgatcatttgaatgtagagtgtgtgagagagaaaaagtttaaaaataactcccaagatttttagtctgagcaactggacgaattgccatttgctgagaaggagaagatggtcatgcaggtctggacttcaggaaaaaggtctgagttgtatgtataaatcgtggagaaggagccatagagactttaagacatgagactggaagagatccttgagtaacggagaggcatgggatctagggcacaggtggaaggggtaacttagataacacacagacagttcagcaaaggcaataggatggaaggcagactatatgggtgcagatgcaggtaggtgactactttgaagaataattcgtggaggggccgggtacagtggttcacgcctgtaatcccagcactttgggaggccaaggcgggtggatcacttgaagccaggaattcaagaccagcctagccaacatggcaaaaccccatctctactaaaaatacaaaaatcagtcgtgcatgatggcttgggcctgtagtcccagctactcaggaggctgaggcacaagaattgcttgaacctgggaggcgggaggttgcagtgagctgtgatcatgccagtgcactccagcctgggcaacagagcaagactctgtcttaaaaagaattcctggaggaggttggcataacctggtccattatggtaaaggtggataggagagggcccaaagaagggcattctaaggaaggcaaccacctaagtgatggcgtgtcctgatgttattaatgggactttctccagaaataagcagtgttgttaactgttgttttgccccttgagtatctttttttttttttttccgagatggagtttcgctgtcgttgcccgggctggagtgcaatggcgcgatctcggctcactgcaacctctacttcccaggttcaaacaattctcctgtctcagccttcctgagtagctgggattacaggcatgcaccaccacacccagctaattttgtatttttagtagagacggggtttctctgtattggtcaggctggtctcgaactcccgacctcagatcatccacccgcctcggcctcccaaagtgctgggaatacaggcacgaaccactgcgcccggccttgagtttcttcattggcatttctgacaactttgtatccatttctcttctgctttctaatcatcttctaatttacttctcaggtctgtcttttcctttccatcttatcactatccgaattcaggctttcattattttatcattggacagttccagcatccttcattaataaccttcaaagttctccttcattcctgcccatatgtttgtacagatttaagttcttatagcacagattttattctgggtcagcccttattaattactcccattcagtcccccattcaaggcttgccacaatctggtcccattctgccactcccgacccattcttatacagattccctctgtgaaccttgtattcaaaccatgttcctgctaatgcccttgcagcatcggctttctaaagctgattaactcttttaaaaaaatggccattcttatctttacccccaaatcctactctaaagagatgcttgtgatttgagaaccggtatatctttggatcccaatgccgcccgtagttttattgtagtatgactcattagatactgctgctgctttaccatcagtgagacaaaatgacctccatctggcttttttggttttcattgcgactttaataaaacagtgcttgggagtaataagaatttgaatttttgaattgtagcagatttacttctctggttctttggatcaattcctaagtcttagccccatcaaagaagaagtgcagaatctaacgtgtctgtattttgacctctagaatactgtaaaactttcttcataaaattagaaaggatagaggggggaaaatgaaaagaaaaagaagaatctgagaggtccctaaggaaaaataccgtataaaccaaggcattatttatcagtttttagaaggagttatcacatagaatgtggtctttctaaaatttctggtacctaatatttcctttcaaaaaagactcaaattcttgaggcatcctagaagacttgtgtgctgcctcccccttgtccaccctccccaaaagcacattcaacaatggctgcctgtttctctccttggtgaggagtctgactcatcattcactctgtcttttcaactgatacctgcgtttcagttccattcaattaccaacttttaattggatcccattgccagattgattttgtgttcctgttccctcttggctgcactgttactatgactacttggtatcttctacttacttcctatattagtttgatgacatctagtcaggtatgaagctagatagatactataaaattgctacagtaccaatcactattatcttacatttttcctttcccctactgctcatttggaatggaatcaagcatggtgataaggttcttaattcttctctatcaattttagtaagcattggcaagttttagaattctaggaccttggaaaattgtggagaccctcttcctctgccctccctagtcttcaccccccaccacaacacattctttcaggcatatggcatatatatttcctaaaaagctgaaagatatcatttcctcatttaattagaaagtcttcctttagtttctttcttatgttagcataatgtctcaatattctactttaagtgtactccgttgtagaattggggaaaattagttacactaggcagtgcatgttctttggtctttagttaactgctgtatgccctataaatattaattgatgaccttcaggctttatgggatatgtttagtggttttttaatggttaaactgaatatttttaataaaaaattacaagaccatagaatgccacagaaccattccacttaccaggaaacttaaaatttgccagctgacctgggaacagatctggtcatatacccaagctatttaagaagaggaatattattcatcagaataaaaatgttatatcataatgctctcttacataaaatgagcttacagccagtgggctaactggatatcatttttctggtttcttgttagctcccactaccatatttgttacacagagtgaactaaggccaagagaccttccatatcattcttcctgtggctacaaactaggattcacagctagctcaaataaaaacagaaataaaaggagagagatctcatagtctgcaggaatggattctgacaataaagaccttgcatttactctgttccttgtgcctggggtttttaatttaacacatcaatgaaaaggcaccatttaaaaaaggggggaaacacccagcaggacttacttttattagtgcaatttgtaagaaattactgcacttaatgagaaaatcattaagcatgaaaaaatgggctctgactgaacttgtggaacttaaatggtgaggttttaattgagttttttagttattggtaagaataataataataatttaaaaatacaggactgcatctgtgtgttgaggtggtcagcactttgcatatcttagtccaatttcctgtgccactggtcatgcataatattatggctgtggtgttctctctgtcgtatctactgatttttctgttctgaaagggaagcagggaacttcttttttgttagattgaggaagtttggggcaaagagctagcagaacagtttctagaaggtggaagaactgtaggctaaggcaaagagcagagctatgtctgcttctcagtccagctgcttaaaaaagatgacaaatttcaatgtcattttcaggttactcaagcttatgcttttttcctagttctctgtttcttttgttgccatccagtgatttatttttcctcaataagaatatttcattaaagaccatgcaactagaaaacaagaataccaagagcaaagagcactcttcagtccgaactcttttagaagtggaagcagaaagaagggtgtttaagaaataagtcagcactgtgtgtgtgtgtgtgtgtgtgtgtgtgtgtgtgtgtgtgtgatttagagaaaaaatatttaagataccttctttttgtacttaaaatttcataagtacgtttgacttctgagaggaccagaatgccatgggaagtgctcagttgcatccagtacctgttgtttattgtcatggtccacacggttgcatgtcacaaccgtgttagaactgaaggaaaggaaatgtatgtaactctaaagacgtttcaagtagaagtgaaaacaatatttttttacataatttgttttttatagaaatacagcttttatcaaatgtctgggagaagctttaaatatgcttttgaacttcttcagtaacttttaattgaatttcattgtatcctacctcactagaaagaaagaaacctgcaaattttagcttcccttataatttaaatgatgccttgctaatttctgtgtttttgagatggagtctcaccctgtcacccaggctggagtgcagtggtgagatcttggcccactgcaacttctgcctcccaggctcagatgattctcctgcctccgcctcagcctcctgagtagctgggattacaggcatatgctaccacacccagctaacttttgtatttttagtagacggggtttcgccatattggccaggctggtcttgaactcctgacctcaggtgatccgcccgtctcggcctcccaaagtgctgtgattacaggcttgagccgctgggcccagcctgatgccttgcatttctgtctcctggaaatacccaattcttaaaagaggccatccccttgtgagttcataacacactgtgcccttagatcccctcctcaccctcccttcttctgtatgccctgcatctgagggaggtgtgggcagagctggctcttgtaggttgcatttcccaggctcctgtgtctaaagacttcctactgggttcggcatgagagatactggtgggaagtagggagggagaaaccggtgtatctcttcttccctttctatgttgggtagcatctttggtcctcagtgtcttcagctcccataggacagatccctgaactctatttatacccttttctttttcctgagtaccaagggatgctaagggtttcttgctgttaccaatcccggggttacagcaccattctcagttggctttaacacacttcgtaacctgcaaaacaatttcctgtcttaagtctcctgtgttaaatatttggagtggtttatattccttgtgttggtccctgactgatacacacaccgcctctacccacaatggccaatttatatccgatagtaaagaggcataaagaaagcccgcttttgatacgtttcttaaattgcctctgttaaaacagactttcttatcaggcaaatatcttttataagtttctggcttaaacaatgattataatttacaggtggatttaatttatggtagactggactgcttgcctagacttttatttgctgatgggcattactcctttttattctcttaataatgaattacctgaccttatacttattttgatttaagtgcttgatttttattgtcacttttaattttgtgttataaagatgcaattgtcattggctacataaatttgtttttttcttttctttttcttttttttttttgagatggaatctcactctgttgcccaggttggagtgcagtggcatgatctcggctcactgcaccctccacctcctgggttcaagtggtttctggctaatttttgtatttttagtagagacagggtttcacaatgttggccaggctggtctcgaactcctgacctcaagtgatccgtcctccttggcctcccaaggtgctagggttacaggcgtgagccattgcgactggccataaatttgttcttaacatttaaaatttatttaactgctgacatttgcaaaatgtacagcatttcaataagtaacatttacatgaggcattgagaaagtgagaagaattaaattgggaaatatcctaaatgatggctgagttcagccaaatcatttgaggtgtcttcacagtcttttatatataatgtgtgacagatgagggaacctactgctttttgggctctgtcagatggaggagaaaatcccacaataaatgacttcctttcactttgttggaaacatctttgcaaagaacagaggtagtgagtaaatgtaaagtcagaggcagacatgcacatggccctgggtgttttgaccttggtgactgtgcaatgagaggggaggtgtagtccattttataggactttgggtggtgttgaatgtattcagtagagaagcagaatgtgtatttcagattaaacaagaaaacttcgccattttcctcttctgtaacatttctaaatctggataacattttgaatatgatactgaagtattgtattgagattaattttgggtgtcaacatctgtactcatttaagatactgggttagtatatgatgcccatatctaaaggttttgcattttctaaaacctcaaaatccaaaacagacatttgaagtaatcctggaaataaatgacagccatttgcctgacttagtatcctaagatggatggcccttccaatggccattttttattttagctactaatgagtattattgagtcactaactaatttcgaaaagcattttggtgaattataattggggctgtgatttactgagtttgaagactgataagccattcctcagccctgtaattaatgtagaagcagagaaaagcaccctgatgatcagcatttcctttatgtggggcaggggagtcaaaagcatattccagccaaatattatagaatattattttttcagccatttctgcattttacttttattaaaaatggcagggaaatgtgaagtgccacaaaactttggaaaggaagtctcttgtttacatcccttttgatactcagtatattcaagcgtcatccatcacagctattccctggtgttaaatggttcgttatagtcagtgaaccacaaaagtagtctgggtagagggacagaatttagaatcatggaccagatttacaagccacgtaactgagtattcctagaaggccaaaatctggttgtttgtattctttgggtttattggaagtttggatatgtttatccatctgtgtttctgaaccctctggaggaaagagcacaacagtctaacatgtaaataagaaaaactaaatccacataggcccacagatacattaggacttcatttttttttttacaaagaaactgggtattgagactcctgctacttccttttacaaagaatttatggtagactggactgccttctttcctgtatcgttgcaaatggattgttggcttgggtatttatttttgtttcttttgaatatttttctctgtaagatagcaactgtgtgtgtgtgtgtgtgtgtgtgtgtgtgtgtgtgtgtgtgtgtgtgtgtgtgttctatcatatttcaggataaaatgagtcaggaagctggttgttttggttttttgttttgctttgttttttcgcaaagcaatttagtacctgtgtagttgtttcatgggctcccagctcttaggattccctacgtttctatccttaattgcctatgctctttttactcttttccgtgtagtctttatgcagtagtttggacacagcagacaactctttcctttaaataatctcttctcttagtatctgtgatgccatgaactcctgacacacacacacacacacacacacacacacacacactctctctctctctctctctctctctctctctctctctctccccgtctccctgtctctccctctctctctctctgactaatccttcttagcctccttcttcagctccctttccactatccaaccgctaaaatttcttctttcttctacactttctaaggagccacgctgtacccctacctcaggactctcacacacactttctcttcttggaactccctttcctccagccatttgctgtctaatcctcactcttttttcttcccctatttctgtccatgtatgaggccatttgcttttctccaaacacagcttgtgctttcttcttcatacttaggctaattgtgtttcctgctgtgtaattgccaaattctgtttttcattgcctagctaaaaagccatgttgatttgtgaagctttctgtaatcaccaaagattttttaaaaattcaaaccaattaatatatttccttaaaactcatagccctcttcacattatttcccagtgttaattttatgtatatgcattatattccctattcaactgcaaactcctcaaaggcaagggccttgtcttcaacttaattctgtctcccacagaacataacatagtatcttctacatagtagttgcacaataagtatatactatcaaacaaagagaaacatttatattatagcttcctaagatttcctattctcatttcaaaagaaatggagaatttagagtctctaggattattgcccttggcctgtaaaggtttttatttgtgcccaaatatgtaacctcgagtgaactttgtatcagatgatctgggaaagtacaccgctttctgttatcaaacatttctgttactttgcttttcaagctgaaaaggggagataacttctgtttgctttgagcttttgttgatggttttctgctctgcctactaatcagggttgtattatttaccttgtttaaaaaggttcatctgaacattctctctctattttgaattgtaattggatattaattcactgctgcgggatacgttggtaaagatttttgaaattgcagggaaatgtttctttaatccctcaagtttgttaagtgctttcttataatggagatcataatctccgagttggtagaagggatgaaacggttactggggatatttttcccttgttagaaaattgctgtattaaaaaatacttcatccagttttttaatcctttccacatgctgtatggtccttaggaaataagtagattcttagcaccgatttcatgtttttaataaggaaggcattgagtaatgttcaggtcactgtgattcacagagttagtggcctggggcctttattggtaaagcttgaaagtagttttctttagcattgtgcatacacaggtagctgctagaatgctcacaggaggctgtgatttggggaaacaggcagtcatagaatatcttgaacattcagcataaattgccaaacagccacagctagtgaatggtttcaggggacaagggagaggagcctttaggcatgattacccacatctccctgatttgttcttccacacacagatcttaagggtcagttttgatctgcacagcattaagtttcctcatgacttttagatttcctttttcctctgctttttattcatactgaagaattttttgtttctttgtaaggtgtaatctactttggaaatgataacactatgaatgcattttctctttctgtagcatttatgacattgcttgctgacagttactgtttattaagtatttgtggcttttggagtagtgagcaatagggagaatattcaggtccagctaagggcataaggtagatagcaatgatttctcattcgaaagggatattttgttaagactagggctgatcttttctaatttaaccttggattggtagaagatggggtgtccctggctcattatttttcactgcccagcactgttcgacaattatcctgagtagaattaggggagggactagaggatctgttttctgtgaatacaataggaaaggcagttttgaattatccaaatggcccctaaattctgggggaaaataaaataacaacaacagcagttttaaaaataactacaacctaggttctgacatcccaaaaaggaatatttcaactataattctcagcattttagaaattaatttcttgacaaatatcaataggtatcattcagactttgcaaatacagagttttgaaatcagaattttgcatctcatctctcccctaaaagaagtatggcaattgtgcttgctgaccatgaggcttgtgaactataatacatacttataggcacaaacacagaagcataccctctctcaggcatcactcaaatctaagaaaatttgttgtcttatgttttagcgagtaaccagctcataaatcacatcgaacagtttttggatactaatgaaacaccgtattttatgaagagcatagactgcatccgagccttccgggaagaagccattaaggtaatgctatcctagcatctcttttcttcctaaacagttggcgactatcacagggaaagaggcatacagcatcctggaaatgagtctgggccgtggaaattatcattctcaatatgaatagcagtgtatgccagtggagctaaaaatgacttaaattcatgttactatcactgtcatttctgagatgggataaagatgagtaggtagggtgttttatccctgaaagttggctttttattgtactgaagacctggcctttgctttctgttcctatttagggaaccaaggaaatttccattataacctctggtggcccactcactattgtaaaggatgggctattttagggaaatggatgggaaatatatattggtataattattgagaaagattttatgaagacaggagtagggatctaaatgtcagaaaaaaaagaacactgacaataagttcctcccatgccttttgtgtgggttttgtctgtttgattgttttattaggaattcttagaaaatatttctaaaacttttccaaattatgtataggcttttatatctctaggtaagaagtgagcaagtttaaattagaaagcatattttttaagtgggcacagttgtagtatatgttcttgtgtgggtgcttattaaatacttggcgaacgtatgaatgaattaatgcttaaataatttaggtgcttacaaagagtgacaagaaaatggaaaaatcattaaaattagattcaataacagattcagaagtagataacctgaatactcttagataaaagacaaattttagaaaagtagagtcaggacaagactgcagatgattcagttggatggagaaagatttggttcaatggaaagagatagtaaaagtgtattgcttttttaaagcactacccaggctaggtggagtgtcttataacacctctgtgcatggttgccacccagtgtccttaaaaatactaggtcacattatatctcttaaaaaaaataaaagagagacaagagaagcagaagagacttcagtgacatatcattcagtcttaatggagagattattattttttcttttccttttttttttttcttgagacggactttcactcttgtcgcccaggctggagtgcagtggcggatctcggctcactgcaacctctgcctcccaggctcaagcgattctcctgcctcagcctcccgagtagctggcattacaggcgcatgccaccacgcccagctaatttttgtatttttagtaaagatggggtttcaccatgttggccaggctggtctcgaactcctgaccacaggttattcgcccaccttggcctcccagagtgctgggattacaggggtgagccactgcgcccggccaagggatattttttgaactgtaaaaagattaagttttatggaacaattaggaaaatgagaatactggctagttatttggttctattaagaagttactaattttttatgtggtgttaatggcatgtgagtgtttgttttaaaagactatattttctatatttcatacaagaatattcataaatgaaataatttgactgaaatttgcttcaatataattggagggttatgggagaagaaggtcatagtatagaggaagcaaaattggtttggttgataattatttctttattttattttttatctttgagaaggagttttactcttgtttcccaggctggagtgcagtggcatgatctcggctcactgcaacctccgcctcccgggttcaagcaattctcctgcctcagccttccaagtagctgggaatacatgcgcctgccaccgcatccagctaatttttgtatttttagtagagatggacccatgttggccaggctgatctcgaactcctgacctcaggtgatctgcccagctcagcctcccaaagtgctgggattacaggcatgagtcaacatgctcggcctgagttgataattattgaagctgggttatgagtgtgcgagcactcactaaattgttctctgtttttgtttgggattttctacattaaatgttaaaaacaaagggctaggccaccgcagaaaaactgactctgggaagctctgtgccttccacagatggaaggatttctggtccccagtgaacacacctcagtttggaatgccagcttcccatgtaccaaagaagaacattttatttttttgtaataaataaggtgattcagaccaaactttgtttggtctggggtgaatttgtttttgtgtttgctctgacttgctgcctcctctaccccaacttgctaccacagttttcagaagagcagcgctttaacaacttcctgaaagcccttcaagagaaagtggaaattaaacaattaaatcatttctgggaaattgttgtccagggtaagttgtcatttgcctttttttttaaaaagtatttttaaaatacttatgctattttattctaaatatacatataaattctaaatataaactgtattgtataatgagttatgtgggaaacatgatgactttctacatggctttgggaaatgctcagtgttcggtgaactcaaactctcccttaataagcataaatacagagtgataaataataaataaacatgtaagttccatcttagactctttacgcagcatgacctatttcatggctgtgcctttctgtttgttgaatggagcagctgtgtgggcgaacattgtcccctttctcagatccttaggccatttcagtcctgctggttccacagccctttggttgacctcacccaggttttatctccctgctacttttcatttaccatgttcttggactttccgtttcaacagaccagcatcttcatgtaccaaaaccattcagttcttcacttgcacagcaaccaatgcaagttaaacccagaaagaagacagcacacattctttcagtgttaggcttgatctttgctttttttcatgccctttgccccaccttttttaaaacatgacctgattttcttttagaacccaagtataagatattacttgtttaaaatacatattatgaaaatgattatgtttatgagataaacttttcacttatactagagatgcaaaatttgtttcaatctctttctgtgtgaattctatataaaaagaattgcatacctatctatccgccttctaatgggcaactcttcatcacacaggtaactgttttcctgacagttaatttttcagccctttaacttctgcactggagaacaaaaggaattggaatgggtagtgaagggggcttactcaaatcacttttgtgtctctgctgttgaccccgtaaatgaaggagattggttttggtatttattgaatgcctatagcgtattatttgctgaaaagaaacttacaggtcatatgcaaaatccatattttctgatagcttatatgccactgagagaatacagatgaccaaggccattcataggtacacatgggtgttaaatacatgtgctttttgaacagtttatcaggtatcagccatttgatgtaggaaaataggaagaagagcaaactaaagagtagattttctacccttgatttgctcttactgagctaaaattgattaactgtcctaaatgatagacatgccccttggtgaagaccatgttttcttcctccctagtcctctggccactctatcaatagccagtaacatggccacaagacaaaatgcatggcgtagttccatattgggcaccggatgtcttggacaaaagcatacagtcatttaattatcatttatttattgagcttctgctatgttctacagtaagtcctctcttaacgtccataggttcttgaaaattgtgactttaagcaaaatgacacataatgaaaccatttttttctcatcagtgttataatgaaacaatattatttaagtacctacttttgtttcacttaaagtcacagtttccaacaacctattgatgatagttaagtaaggacatactgtacattgaggggaatataaagacttataagacttagtgtctgcccttgagaaaatatattcttaggagagagaacatgtgtacaaatagttacataaaatacgacaagagccatttcaaaggaataaacaaagtgatctgagatttctaaagaaggggagacttatctagagttgatcaaggaaggcttcatggaacacgtggcatttgacatgcggcctttattgcttattacacaggcaaaaactggagaaaagataatttaagatggtcattgttaattggttgcctttatagttttatattttttgtagaacagagcacctttatagttttaaaaatctccagctcaggctgggcacagtggcgcatgcttgtaatcccagcactttgggaggccgagacgggaggatcacttgagcccaggagtctgagaccagcctgggcaacatagtgggaccctgtctctatttaaaaaaaagaaatcttcagctcaaaggtgggaggaggtgtgatggaaacgaaaatgggattggggttgattctttgtgttttgattttactctctgaattactttttagatggaattactctgatcaccaaagaggaagcctctggaagttctgtcacagctgaggaagccaaaaaggtattgaggggtaaacctttgtctttagttgaattattatagtggactttattttcttgataccctcgaagaagttaaattttatgggtaactaaattagtgtactcattttgtattcaatatgtaaattgcttcaaccacagcatccccatgggagaaattataatcttactcagtttcctgtaggctgtggttatatttctggaactcacctgtaatcccagcttcagtacccctagagcatgctgttgaaccccatagtgcgcaaacttagcctcggccctggtaaaggctatgaaatccacagtgattcccaccctggccacacattagttacttggtgagcttgtttttcttttttttcttttcttttcttttcttttcttttcttttcttttcttttctctttcttttctctctctctctgtttctttctttcttttttttttttgttaatactgattaaaaatcagaattaccctagagattctgttagtctgagatgggtcctgggcacagttggtttgtttgcattttaaaacccctcaggtgattgtattgtatagtgaatagagaaacactagtattctagcataagggacatccaagtattttcagtaaaagaccccatgcagtccccatgagcttcttattcacacacattgttaggcctaggcctccttgtttggtgtgtattgaatctgattcagccatgagtcagatacatgtggttatttagttcagtagtccttcattgtacctcaaggttgtgatgaaattttaatgaattaagttgaatagctcaaaagtatatacttcgtaacactcagtttcagttacagtcactgactgatgtagttctgctggcacctgacagctctcagttactaagcttctgcgatatgctaggcactgtgctggatgataagacagcacccctgccctctagaagctcgggcagttaaaatggagcagagggaagcaacggagactcagaaaataactatacacactaagggagagcttggtctggggctggtgaataggaatctgttagggaagtgacagatgcaaagctggaaatgttaatcagatggctaaattcaggccaaaatttaaatatcttcaattttcaactcaagaaaggcatttggcagaaaccatgtttggaaaagaaattaaaatttacaagaatttttattaagcactttgcctagcaaaagatttttgttaaaaaaaaaaaaaaaacttgtcatccctactttcagggagtagaatcctggaatttttgaagcatactgtaagatggtgattatatctcagaaggggttccgtggtgtctgtaccctctctgccacaggcaatactgagcaccataggcttgagtatgccatttaactgtttggttttgtttctgtttgtcactttatacaatgtttgataatatctcctcattgaactgggctatttcagtcaaggttctccagagaaacagaaccaagagaacgtacatgtgtgcgtgtgtctgtgtgtgtgtatgcacatacacacacacatatatatagagagagagatttattggctgaatttcagaaattggcttgtgtgattgtagggcttggcaagtctgaaatttgtaggacaggctagcaggctggaaactcaggcaggatttctgtgttacagtcctgaagcagaaacctcagcttttgctcttaaggtcttcacttgattggatgagatctacgaatattactaagattaatctttacttaaaatcaggtaattttagatgttaatcacatctacaaaataccctcacagcaacatctagagtagtgtttgatggaacaactggggaccatagcccagccaagttgacacataatattcattgtcacatggtgtgaagacctatcaatcaatttttgttaaacaagtaaatcaggaaaaatattttttgtcattattacattaagaaaatttattatccaggtgacagtacatactagagtttttggaagaagtgaggagccatgacctaaaaaagcttgtgtttcctgccagcagcacatcttaaccaaagatgttccagctaagttaacccagaatattagacaggaaagaaatctgaaaacagatgatgcacttgcaaattgtgcaaggcttgttctgtaatgcaaataggatgtcttctttgaaatgtaaaggcactgagcctaagcatgaggaattttaatgtctaatgatgaagctatagagagaaatttcagttaatgaccaggtaggtataagatggtgtccttagataattctgatatcagaactgatgttagttgtagtttaagacaactctcctgagacaggagaaccgcttgaacccgggaggcagaggttggggtgagccgagatcgcgccattgcactccagcctggacaacgaaagcgaaactctgtcccaggaaaaaaaaaaaaaaaaaaaagacaactctcaaaacttcaccatctttgaatagagagaacatcataaaaaacaagtggagagaatctcttctacttcagccacgggttgcctggctctgactggcatcttcttccttttagagcatagtgtttccatagtcaaggcacagagagtgtgcttccagtactaccagcaaaactgaacttcactgtcatggcagataagaagttaggaaattcaacataaaatgtattgagtaccaccagctctatgccaggcactttgatatatattatctcatagcctccaaaaaaagtacattgcacattcacctagcagactctttcacatctagaaaatgccatttcctttttttccccacatttatcagtgctttagccaatgtagtatgtataccagatatttagataacactttgactgctaaagaaccattcacattgtatggtgtttgtctacaacactatatacatcatatctagataatggtagaaaataagagtagtagaattttacttgtatccaactcccgaaccaaagagcccagtattatctctgtaatcttcacaatgatctgctaagaattggcaagagcaggaactaccatccctgttaccactgggaagccaatccccagaaaggtaaagtggggttacactttgagctcaccgaggtagcaagaggattaaaatgcacgttcctttgcaccacaccagaccttcgttttcaagtggattaagttttgtgaatggaatcttggaccaatcatttctaaaatacagtactccctgtctgcttcatctcaacaaatgactttctggcctagagccaggtggtggttagaataacctggaagtcatagagtagaccctgtaattttgactcaccttcagtgtacgctgtgttatatctgtcagttctcattagtatagtggtgagtacccccacctgtcactgtatcatgcctgactgtgagattatgcttttgtgtctgctttaatatcacatgaaccctttattttgttttccagagtgaaaacttgatcctttgtatgaaaaatgcttttatttatttatttatttatttatttatttatttatttagagacagagtctccctctgttgcccaagctggagtgtagtggcacggtctcagctcactgcaacctctgcctcccaggttcaagcagttgtgcctcagcctcccgagtagctgggattacaagtgcgcaccaccccacccagctaatttttgtatttttagtagagatggggttttaccatgttggcaaggctgttctcaaactcctgacctcaagtggtccgcccaccttggcttcccaaagtgctgggattgcaggcgtgtaatcccagccatgcctggcctgaaaatgcttttaaatggcatctgttgatttttggagagaagtgtagaagggagagtgtacatgtaaatgataatggggagaattgcagaggaagattctggctcaaggaagctgatttcttttggttttaatagaagagacatgctttagctatttctcttagccaagtgagagaagtattatcacttttgaccatgcactgaaatattcatttatattgccttcaaatgttcaatttggtcacttcccaaataatcatttaaggaaacttgactataatcactgaggttaaagaacaatcctcacagtctatttaaattcttttgaggtgtttcccataagttatttaaagttagcaagctgtcaaattcttgctattaaatgttgacatttgaaaggaaataattatccagggatgttcattttaaatgaaaattataactttacatttgtataacatcttaagagctattaccctccagtttttctagaaatatgtggattgtatgattctttgagaaatagaaggaagtcagctctgctacagaaatagaaagtttttgcatggcgtgagtttagacagtcactttcttttaagtttcctggtacctctcatttcattttgaaacctaggcataaatcattctttaatgttcatttttattatcattataacctgtcagttcttccactttttctgtttctagtttatatgattagatatgccattagcatttgatgtttggtagaatctttgtatagcctttgtgtgctcttcatctgtcagttctcctggctctgtagtgggtggaagaggtaaagtgatgtgtctgagagctcacagtaagtcaccggccaggaatctagttctagcactgccctagtccttcattctcctttagtattgagaaagcagtgaagaaagaggatttatccccatggcattgggatcttttttttttttttttttttttttaccagattccaagaggctgagctatatctaaataatcatttgatgtaagctctgtgaaaaaaaaatcattattttagcacttatttttcttgtaactgcctaatttatccttctttattgttgttgacatttatggattttccaccttagtatcacagacattcatagatagcaattggccattttaccaattggtgttggccattttaccaacacccctgtctagagaggtaaagttttctgtgcctcacagcaagctagtggccagcagaattgactggaatccagacccccagatgcccgctgtagtcgccttatcaccacaccatggcaccagctcttcacgccttcaccttataatgccgccaaccacatctacctagagaaaggatgctcatgctccctttttcaagagtacatctggttctgtgtgtgagagtgcacaggaattctccaaagcttagtgaaggattgaagacaaaggttaagaatcatttcttgagagcagttttgtcaaactgctggcccctgttggaacctgtgacatttttctttgcttttttctgctttcattttctgccttaattctctggtgtagtttgctagtacaagaaaagtaataatgaaaatatcacagtgttacccaatatttatttaaggcttgatacatttaagatatgatattaaattttttattgaggtagaacatgtgtacagtaaatgcacagatcttaactgtgcaacttgatgaattcttacacattcatgtacctgggtgctcaccacccagatcaaaataatagaacatttccatcaccacataagcctccctggtaccttcctagtcagaagcccccatcccttgaggtaaccactattctgacttctgtcacttgagagtcatctggcctgtttttgaccttcatataattggaatcatgcctttttttcatcaattatgtgattatagctatgtagtaatcccttttatgattttaccacaatttattcatccattctcctaatgatggacatttgcttgtttgtcctttggcagttatgaataaagatgctgtggatattcttgtacataccacttggtggacatatgttaagtgtattcctaggaattagaacatgaaacttacaataccataatgaattttttcatactttagtttatctgagactcaacaacccctaagataggtatggtaagtagtagtattcacattttgtttttgagcgaaattagttatgaaaaggtcaggtggcttgcgtaaggttcctgagaaactgacagggttatagttgtgttctccacactaggctgcaggatttccctcttgcaccatgttagtgtttatagcatccattaagctacaagtggcattaatgaaacccaaatatatgtcattttaggcaaagtacatgcaaactgacttttattctttttgatgcttttttacacatctagattgtcagtaatcctttggaatcacctgatggtgttggaaacaacccagtggaagtcatgtgtttttactttgggggtcagtaagggtctgagcacaagatgatagtcttttagtcttatggtggtataggactggcagtttctatatagaggttattgatttcattactctgcttgtggccaggattatatttcagtgtacttgaaaagtagtaggttatccatttcataaagttctccaggtaaggaggcacttttatggtaaccccaggtaagtgatggtggtttgaggaagaaggaatatgtcactcacacacatgccctttctatctgttctctactttctcagcatattgcagagggaaagaacacatgagaaaagatgagaattgactcctacccctttctgcagaagagattcggagaatctcttgcttttattgagaaagcaggccagtcattgagttctctgctctatcttgcttccctgtcactgcatgggctagaattacttgcagttacaaacattaatgatgaggagtgatatgtggaagagatcagccttgcctggggcattgggaaggataatggatggcagcccagcttttaaacataatttgcttacacagaaatgtgaagcagatctgtcaggaaaatcagttgcagacgatacttagcacttaatgaaaatgtaggatttttgttgctgctcatttcttcctaggaatttggcctagtctcagagatgtgccatttgtgcttaagtatatataccatggtcatactgtgccaacaataagtccttatctaaggggtcatacaagatgtagtggactacagaaccattaagcctatggagtttttcagatgtttggaagataccagtcatttgtggccctacagagatttatggcaggatgcagctctactgtttattctcttgccccaactggataagtcttatcctgtagccatatagtcctgatatcacgaaaatcatgcaggggttaatgacaatgagtaggagaggagaggtacaacataaaaagtatgataataacccggaaaaccccaaataaaaacccatttgagaatctaggatagagtagtttatttaacctttacagataaatcatatgctagtaaatgtatagattttttattcatttatctgtatttggctgtcagatatctttattcataatcacccagaataaacagaatgaatgaaacagaagcttcatcacaattctgttacagactgtctgcctccattgctgggatttcctctctcttataccattgattctcagtcttgcacatggcccagtttagggtcaacaaagagctatggaaagatccataaatgtccttaaaagaagataaattccttattcgctcagtcataaaagaagttaatgaatagtgaggtggtcttaactgagggaaaaaaagtccaagagagtggttgagtcaacaaacaattatgtccatggtgctgacaaaggcactgcaccttaaggcagacacagcctccactgttatcactttgttacctgtgtgtgtttttgtatatgaggactagaagaacaggcagagctttcttgcttcctgaaacttgccacatgcagcctcatatttcatggttgactttggtttgactttttaaagagacatattttagtttatttataggtcttaggtttcagaggtcatgattgtgtccattgtaccataaaagtaacaggaatgtagagaatggcagctcttaccattttttcatgttgagagtgaggaaagtataattatactttttcctcttgggtggaagcaactacaggagagcataagtgggctggaaggctctctcaccgcgtgcctgctccatgcactctcagcctgaagaatgccagaatgcctctaggggccagtcagttgtggtaccataactgattctctatttactgtttctggcccccaaaggaaaagtagaagtgccccactttccactgccctctctaaaacactcactcctacaggcaggcatgctaccagaaaatcaccttctcgtgttaggatagataggcattgctagatagatatgcattgctagaacccagctcttagaggcagctgccacatgccttgaaggaaaaggctccccactgctatcccttggagggacaggatggaaaaagagtgttcagataattttcaagggcactcacctcactacccttttaaaatctgagtgtcattcctagatcctcacagacttcacttcctggactttgctgtattactatgtatctgcctttcagaagctccagatctagaacagtgatgctgaatggttttctcatccatttctcatctgcctgttttcaaacaatttctaacacaaattgaaagatttccataaaaggaatcaaacaaccttccaagctcactcatttttgcatttcacgtttcttatgagaagtcccccttttactgcttttgtccacagtggaatttaagagtagattattctaagctttttttttttttttttcctgattcttcatcattcaacttgagattattctaatcttgatttgattctcatgctcctttcaaaagagcatactagtttggggtggttggttattttcttaaccttagcaagccagcttatttcctatggaagcagaactggaaacagcagatgtccaccatgcttatacaggacactacacactgtctcgacaagccatgttctttcctccctcttcgtgagcactttctctggtgatgagttagtatggactacttgaacctcaaaactgggcctctcacccaaagccaaatgaagtagcgtatgccaggatgatgtttcttttgggccgttggcagtgagactgctaagcaggctgccttaggttttgctgtggcaatgctagcagattgttccctctttcaaaggggcaaaaatatcattttggtatgataactgactttctatttacagtttctggcccccaaagacaaaccaagtggagacacagcagctgtatttgaagaaggtggtgatgtggacgatttagtaagtacttttaatatgcacctggtgttctatgattgaagtcacctgagctgtaaatacagccacaaaggctgattatcttacacttgttgcttatttgtgttttaatttccaatacaccagaagcttcctacaccattatatattgccattataaattcaatcagataggtaatttcataatagaaattcctgtgtttcatggtgtcggctatattgttcattcagattaatcctctcccttgaagggctgaaaaagagctagggaggctattccattagtagcaaaatgttgtaattcactgaaattgctgttaaccaaaaataagtaatacaacatgcagtttgtgtgggttgacaaatgaaacagcccttaaaagggctacttcttaaatgttctcaattaacttaatgtaaacaaaatagaccgataggcatttgaggatttctggaccccattacaccatgttgttgatgtctgggaagctgtgtagtaaatgtcttttgtatctatccttaatgtttggaaacttcccgcctttaagcttcatatgacaactgaccaacaaacactacgtactatgatgtcaatcttttttagagacattctcattactaaaatgagtggatacttgaatgtttaactcctaaaataatgagcggtgaataaatgagcaagtacatgcatgccttccaatgtagagtcattttcattaaaccctctctcaccagagaagcagtggtatgaaattggcctgattcctttctaagtgtgttgttcttgttcacagttggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactc

SEQ ID NO: 37017 - DNA, 30992 bp, Homo sapiens
atggccagtggtccctagtgttacagatgccaaatagtaagatgatgaaaagtatggttcagctgggtgtggtgcctcatgcctgtaatctcagcactttggggagccaaggcgggtggatcacctgaggtcaggagtttgagaccagcctggccaacatggcaaaaccccatctctactaaaaatacaaaaattagccaggtgtggtggtgtgcacctgtaattccggctactcaggaggctgaggcaggagaatcgcttgaacctgggaggcagaggttacagtgagccaagatcacgctactgcactccagcctgggagacagagccagactctctctcaaaaaaaaaaaaaaaaaaaaagggataggttgttaaccatggtagaaagaggtttaataatgcaagggggtgaagttggccccagctggcctgtaagatgaattagaaaaacgcttctccccaagtctggtggacacaactcccaagcatagttcggtgagcaaatggtgtctttttgagaaaggggaaaaaaaccaaaacaaaaacctttcctccatccctagcacccatggaaggattttaggccctagttcctccacttctcagccaggtaccctgcactttttgcagtagcctccttgcctggagcctaaggctaatttgctgatctgccaaccactgtctattctttctcctggtgtatctataagattctattagataaagacattagtacattgatttacgctattaaaaattatttctagccaggcactgtggcatgtccctatagtcccagctacttgggaggcagaggtgggaggatcacttgaggatagcaagactccgtctctacaaaaataaaaaaattagccaggcatggtcccagctatgtagaggctgaggtggatcacttgagcccaggagttagaggctgtagtgcacaatgaatgcacctgtgaatagccactgcactccagcctgggcaacatagatcctctctcttttaaaaagaaaaattatcttatccctcccttttccttgaaatcagagtccattccacactaactcaatgattctttttttttttcctttaattttttgtagaggtgggggtcttgctgtcttgcctaggctggtcttgaactcctggcctcaagccatcctcctgcctcgacctcctcaagtgttgggattgcaggtgtgagccattgcacccagccctgattcttttttaaaaaagctttattgaaatgcaatttaccataaaatttacccatgtaaggtgtaagatttaatggtttttgtgtatttacagaattgtacaaccatcaccagaatcaattttagaacattttcaccaaccccaaaagaaaatctactgtttagatatcaccctccaatcctccccaacccctggctagcactaatctgctgtttctctatatatttgcccattttggatatttcacagaaatgggatcataataatatgtggtcttttgtgactggcatcttccacttagtataatgttttccggtttcatctatatagcagcacacagcagtacttcattctttttcttttttaaaattgaagtaaaattcatataaaattcaccattttaaagtgtataatttagtggccgttagtacattcacaacgttgtacaattatcatcattatcaattccagaatgttttcattaccccaaaaagaaaccctgtacccttaagcagtcattccttctcttctcccccttaactcctggtaccactaatttgttttctgtctctatagatttgcctgttctggacatttcatataaatgggctcatacagtagtgcctttttctgtcttatcttcctttactcagcctaatgttttcagagttcatctatgttgtagcatgtattggtacttcattcctctttatggccaaataatactctattgcatggatataccacattttgtttatccattcatccattgatagccatttggatttacacattttggttattatgtaatgctgctataaacatttgtgtataagtttttgtttggacatatgttttaatttctcttgagtgtatacctagctgtacactgagcaactgctgggtcataaggtaactctgtttaatcttttaaggaactgccagtttgttttccaaagttgctgtatcgttttacagtcttaccagaagtatatatgggtaacgatttctccacatccatgtcaacacttgttgtcatctgtctttgattctaaccatcctagtgggtgtgaagtaatatctcattgtggttttggtgtgcatttccttaatgattaatgatgctgagctgagcatcttttcttgtgcttactggagaaatgtcccttcagattctttgactatttttaattggattattgttattattattatttttggaccagggtcttgctctgtcacccaggctataatgcagtggcgtgatcatggctcactgaagccacagcttcctgggttcaagcagtcctcctgtctcagcttcctgagtaactgggactacaggtgtgcaccaccatggccgactaattttttattttattgtagagacagggccccactatgttgcctaggctggtcttgaactcctgggctcaggcaatcctcctgcttcagcctcccaaagtgctgggattacaggtgtaagccactgtgcctggctagcattctttttacatgctagatacaggtccctgaacagatatatgatatgatatgatatatgatttacaaatgatatatgacttacaaatattttctccactctgtgggttgtcttttcattttcttgataatatcctttaatgcacaaacattcttttttttttttttttttttgagacggagtcttgctctgtcgccaggctggagtacagtggcactatctcggctcactgcaacctccgcctcctgggttcaagtgattctcctgcctcagcctcctgagtagctgggactacaggcgtgcatcaccacgcccagctaatttttgtatttttagtagagacggggtttcaccatgttggacaggatggtctcaatctcttgaccttatgatccgcccgccttggcctcccaaagtgctgggattacaggcatgagccaccgcgcctggcctacacaaaaattcttaattttgagaaagtccagttcatcctgtttttttctttcattgcttatgcttttggtgtcatatgaaataaattattgcaaaatgccacaacttaattttagaacatttctatcatccccccaaaattccctacattgactccctaatcctaccccaggccaatgatctgttttcggtcttttatttatttatttatttatttatttatttatttatttatttatttagagatggagtttcactctgttgcccaggccggagtgcagtggcgtgatctctgctcactgcagcctctgcctcctgggttcaagtggttctcctgcctcagcctcccaagtagctgggactataggcatgtgccaccacgtccggcgagatggggtttcactatgttagccaggctggtctcctgccctctggtgatccgcccacctcagtcccccaaagtgctgggattacaggcatgagcctggcctgttttcaatcttttttttttttttttttttttttttgagacagtcttgctctgtcgcccaggctggagtgcagtggcgcgatctcggctcactgcaacctcagcctcctgggttcaagggattctactgcctcggcctcccgagtagctgggattacaggtgtgcaccacgacgcctggctaatttttgtatttttagtagagacggggtttcaccatgttggccaggatggtctcaatctcttgacctcgtgatccgcccaccttggcctcccaaagagctaggattacaggcatgagccactgtacccagcctgttttcaatctttataagtttgtaatcctagcactttggaaggccgaggccagtggattgcctgagctcaggagttcgagaccagcctgggcaacatggtgaaaccccgtctctactaaaatacaaaaaagttagctgggcgtggtggtgtgcacctgtaatcccagttactcgggaggctgaggtaggagaattgcttgaacccaggaggcggaggttgcagtgagccgagattgcgccactgcactccagcccgggcaacagagcgagactccgtctcaaaaaaaaaaaagtttgttggtgcactcttttgccccttttcattgctaaatcattggctttgaccaactgatggacattttgattgttttcagtttttagctattatgaacatttttagctactatgagtatttgcaacaaatctcagtgtggacgtatgttttcatttctcttgggagtattctttggagtggaattgctgagtcttatggtaaatttgtgattgacttttttttctttttttttttttgagatggagtcttgctctgtcacccaggctggagtgcagtggcggggtcttggctcactgcaagctccacttcctgggttcacgccattctcctgcctcagcctcttgagtagctgggactacaggtgcccgccaccacgcctggctaattttttgtatttttagtagagacggggtttcactgtgttagccaggatggtctcgatctactgacatcgtgattcacctgccttggcctcccaaagtgctgggattacaggaataagccactgcgcccggcctatgattaactttttaagaaactgccaaacttttctgaagtgagtgtactattttatattcccaccagcagtgtatgagggttcctcatacacatcctcaccaacacttggtataatctgtttttattgtagtcattttatgtatgtatgtgtatagtgtttttatttttatttatttatttttgagacagagtctcactctgtcacccaggctggagtgcagtggcatggtctcagctcactgcaacctccgtttcccaggttcaagtgattgtcatgcctcagcctcctgagtagctgggattacaggtgtctgccaccatgcccagctaatttttgtatttgcagtagagacagggttttgccctgttggcttggctggtctcaaactcctggcctcaagtgatccacctgcctcagcctcccaaagtgctgggattaaaggtgtgagccaccacgcccggctgtgtgaagcgtttttttattttttgagacgaagtctcgctgtgtcacctaggctagagttcagtggcaggatctcggctcactgcaacctccaccttccgggttcaagccattctcccacctcagcttcccaggtagctgggattacaggcatgcaccaccatgcctgcctaatttttgtatttttagtagagacgaggtttcaccaagttggccatgctggtcttgaactcctgacctcaagtgatccatccacctcagcctcccaaagtgctgggattacaggcataacatggcccggccctggccatgtttttaactgtgtttctctaatagctaataatgccgagcatctttttatgtgtttcttagccattagtagatcttttttggtaaaatgtctttttttttttttttggtccatcttaaaattgttttttgttttgttttgagacagggtctcactttgttgcccacgctggagtgcagtggctcaatcatggctcactgcagcttcgacatccctgagctcaggtgatcctcccacctaagtttcccgagtagatgggactacaggtgtgtgccaccatgcccagctaatttttgtattttttttgtagaggtggggttttgctatgttgcccaggcaggtcttaaacttctgaggctcaaatgatcctcccacctcagcctcccaaagtgctgggataacaggcatgaaccaccacacccagctaagattgtttttaaaaatctttttcttgagttttgggagtttttatgtgttagggataccagtcccttatgaggtatataattagcaagtagtttctcccactctgtgactgtgacctttctttttttgaggcagggtctcactctgttactcaggctggagggcagtggtgtgatcatggctcactgcaacctggaactcctaggctcaagggctcctcccacctcagcctcccaagtagctgggtctacaggtgtgttattgtgccagggttaatgttttaaattttttgtagagataatgtctctacaaaagacaccatctttgttgcctaggctggtcttgaactcctggcttcagggaatcctccagcctcagcctcccaaagtgctgggattacagcatgagccacatccagcctatgatttttcttcttttcttttcttttcttttcttttttttttgagatggagtctcgctgttgcgcaggctggagtgcagtggggcgatctcggctcactgcaggctctggcccgcggggttcacgcctttctcctgcctcagcctcccgagtagctgggactacaggcgcccgccacatcgcccggctaattttttgtatttttagtagagacggggtttcaccgtgttagccatgatggtctcgatctcctgacctcgtgatccgcccgcctcggtctcccaaagtgctgggatcacaggcgtgagccacggcgcccggccccagcgtatgacttcttaatgatgtctttgtagtacaagagtttttaattttaataaagttaacttttttttaaattgtacaagcttttagtgctgtgtctaacaacttgttgccaaacccaaggtcataaagctgttctcttacgttttcttttttttttttttttgagacggagtctcactctgtcacccaggctggagtgcaatggcacgatgtcggctcactgcaacctccgccacccgggttcaagcgattcttccgcctcagcctccggggtagctgggattacaggcgcacgacaccacgccctgctaatttttgtatttttgtagagaaggtttcaccatgttagttaggctgctttacgttttcttttagaagttttatatttttggctcttatatttagtttgtgatccattgagttgattttatgtacgtatgtatggtcgcgttcttttctttcctgtctttttttttttttttttttgcatatggatattcaattctcctagctccatttaatttgaaatgattgggcaggtacttttgagcagtgcaagtacagagcggcactgccagcagactacacgcggtagaaagccgaccttggtgagcgtgttggtgctcgacagtgagcagagaaaggatggacgattacggagcgccctcgtctccagttaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtaacacggttgctggcaccctcggtttgcagcctcaagatccctgaaagcgggtttgcagtggatttaccccaaccgatggggagggactgagcttgaccaaagagccagaaatgactggagaatgcatcccttgccactgctgcaaggggagaaaaaaggattgatcctcagtgacaacccctccctcatgtggcaggtggctcagaactccggtctgactctgaggcgacagcagttggctcaggatgcactggaagggctcagagggctcctccatagtctgcaaggtaggcgggtcctccccaggatggtcagttcccctcttccatagccagagaaacatccgctcctgcgtttttgggatcgatataattactcggggcagggagtcctgtttaaggcacagaggagactggagtggaatcatctttgtacaggcaaatccctctcttccttacacactcacagagtggcatttgaaaaatggtttccaagatggtctgatctggataacttttttgccctttccagactctctgtccaaaggttgggttctttttttaaatccttagctaattggctggagggtgggttctttattgtagctgttttggttggagtggggtgatctctgagttgggattttatttggaggatcttccatgggggagcagtctgtaagaccaacattgttgctccagggctccctgcagctgttcctgttcttcccttggagctgactgtcacctgcaacttcattatcctgagggcaagcttggcccagggtttcacagaggatcaggcccaggatatccagcggagcctagagagaggtgagggccagagattgtccctgattcccctgccatcttcagtctgggtttaagttattgcagggagatgggaggataaacaacatctgtcacctccatggagagaggtgcccttctctgtgctcttcagaccaggttgaggtattattattgtgacctttggggtcctgcaggagaggaaagccagagtgtgtggggagatggaggatgaggtgctacttcagctgtgtgtgtgtctatgtgtgtgtgtatactctacagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccaggtaatagggaaagtgacctgaagctgagggtctcctccttccttcctcctcctttctctccagctgcagtagcatcatcatgtactggacaggcggctgggttggtggtcggaaaacctggattctctctgggactcttgggtgaccttgccctggttggtctctcattgtggggattctcttaggagtgttttttaaaaattggacaggcatggtggctcatacctgtaatctcagcactttgggaggctgaggtaggaggatcacttgaacccaagaggtggaggcaacagtgagttgtgagctatgatcacgccactgcactccagccctgcagcctgggtgacagagggagaccctgtctcaaaaaaaaaaaaaatttttttttggatagggatagggctcttgtgatcttgctcaagtcagctctcagccttagtctccttattagtaactcaaatatggtccttgccctgagtgaggaggcacgctggaatagatcatcactgccccaggtttttcttccttttttttaattcttgcctcatagctatctatctcttagaattgggggaaactacaggcattatgcatagcttcttgctttgtaagggtagctgaggcctgtgtcctcaaggatcaagaggacccttgagctcaaggtctagccaggatagatggagataggagaagacgaggaggttgtaggcttggagcttctggttgtccttctttccccagagtggagcctctaaggatctgctgttacttctgaaaacttggagtcccccagctgaggaattagatgctccattgaccctgcaggatgcccagggattgaaggatgtcctcctgacagcatttgcctaccgccaaggtcagctagcaacctgactcatctcttctacctttaagtggtcctccagactcatgccctctctcttgtcccattcagttccatgggcttcttagacccttgttccccatcatgacccctgctctatagccctctccaagctcacaccctgactgtcctcaggtctccaggagctgatcacagggaacccagacaaggcactaagcagccttcatgaagcggcctcaggcctgtgtccacggcctgtgttggtccaggtgtacacagcactggggtcctgtcaccgtaagatggtaaagacagtcctagggtggattggggaaaccacaagcattatgtatagctttttgctttgtaagggtagctgaggcccgtgtcctcctatccctttagggaaatccacagagagcactgttgtacttggttgcagccctgaaagagggatcagcctggggtcctccacttctggaggcctctaggctctatcagcaactgggggacacaacagcagagctggagagtctggagctgctagttgaggtagggaactgccaggtgaagatgtggggtggaggattcctgaggtgcttgtgatggggtgacttgactagtcaagatccaagtataaggaagtatggctcccaaagattatagatacaatttttttctttctcttttaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggaggtgaggttccccttgctcacctgagcttctcttcccacttctgatgcctcccctggggtgtgactctgcttttgttcttgtgacttgggggatgaatgaggcagtggcaggacataggtcgccactcctcagcctcttaccttgcttctagacctgaactgaggactcttctctaagacattaaccttctctatctttgacactctgaagtctcttccccagtccattctgtaactggggtagatccatactgagccaaaattggagccctaagaccttccctccctttctcctcctcagggcccatgaacatccatctgttagctaagagagaacattctcaggacccttgcaggttccctgctagggcctagggtgaggcttatgggcttttactcctcagggcaggagacgctgcagagcattacttggacctgctggccctgttgctggatagctcggagccaagggtgggtgtgtcttcaagcttctctgcaatggggtagacgggttggtgtcccctttgaaatacagcaagactgcaattttttgttttttcctctattctgtctgtccagtctgggggcccaggactctgcatggtaccagagcctggtgaagaggttggggatggtggctcatgcctttcaagacactgcttcttcttcccactccagttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgagcccggggtcctagagggggtgtggagggatgattttctgattgggacctgagttggtgagctccatgttcacctacttaccctagagtttctgaaattgattcctcttcacccctgttctgtgtcctacttcaggtgcctcgagctgctcttccgggccacacctgaggaaaaagaacaaggtgatctaaactttcagttttcctcttacctcctggaagtggtagtggtggaagtgggttccctttaatgtgtcccagcccaccaggagacttaagagaaagggactgtggacacaagaagaaatagaggaggatttggggttttggtgactgtgaggctgggaagacacttcttgactttgggagtggtccccaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtatgtatacttgcatgacgtcggctatgcatagatgtgcaaggacagagaggcccatgggaaatacttgggcgtaagtgtaagagtggtgttctcagacaggaggggtgattggggttgtgctatatatacctagggatatatccaggtgttcaaatatacacagtgtgtatgcagggctcccaagagttccctggtttccccgatatcctcagacacaaagaccatgactctgctgttgtgggttgcacaggagtagggggcagatgatggacactgggatgggaatggttgtgaatgatctgcccccgcttccatatgtgagtgtaggcaagatacttcctctctctaggcctcagtttccctttttataaaacaatgcctaagactatgtcaagttctaagactctgtactctgggctggggctacaggtaatcgagacacttactttcacctgcttcagactctgaagaggctagatcggagggatgaggccactgcactctggtggaggctggaggcccaaactaaggggtcacatgaagatgctctgtggtgaggctcaggcctgctggcttggggctgaggggcagttggtgtcctagagtccttggacctattgtgggtggtgaacactgaaagcgggggtatggctgcccagctttctgccaatctttcacccttaggcatcatccttctttctctccaggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttatctcgtctgcctactacatatacttgcgtgggaaggcttgtgaccgtctagttgagtgctagttgtctatgatgccctttcctgacatcgtctaccttatgaacttgaagtctgggtatgaggaaagggctacaggaatcctcactttggaggcagtggctttagtccttcacattgcctgaatgcagagccccaaagcccaggacagtgacaatgagtggagttgggtctgaagggtggtctagataggcctctcaggacaagggcaggtacctgttacttagagacaggcaggtttctctcagagtaactcttcactcccttcctaattccaaattctagaaattcgactcgtcttagtcaaatgtgtctgtgtgggtacagggtgaaaggtgaattgagtcagcatatcaccaacagctgcctgttgactactaacagggacccctgttatttggggcccaaggattttcaagtcccagcatatgcagttttcttgctaatttgggttctactgaattggctgtgtgttctgtggttgccctttgacttctctggatttgagtgccttattataaggtattaatattaatgacgggaggaagaaaggcacaagcgctgagaaactgcaaaggctgtgggattggggttaccagagggtgcagtgacaatggggtaggagtggggtgctagtcagaaagttcagagtaggggtggttggaggcagcgttgagaaggagcaagaagtgtcagggtggtgatggcgtcttagaagatctccaggttttgggagaagatgggtgtatgggttaccacaataggactagactaatacaagggttcagtctattgtgccacgttcttccaggaggataaactccggagccaatgaactggagccaagtgggagagtccgcctctaagggattaaagggtctcctttcactaatcgatctcgccctattcctttcgttgattggctgagaattccaatccgtcgaggaagcgtagcgttgcggccaattgacgtggcgttactaggcgtgtcgcatcactgaggcgggagccaggccgcaagcgaatttcctgattggctgtgatctgcgggttgctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgagtgagtgtgcgcgcgccgttcgcttgctgcggcggcgcgcaccgggaccagccgcgcagggtaggcccggcggggcctggccgtgggcgcgtcagagaggtggagaccaggaaagagggaagggaagctagggggcgagtgaggggccgtggacccggcaggcccggctggggccagctgcgcacccgcgcgccccctaggcggggcttgcgttgggtccgggtcggagcctgggccggatcgtgctgtgtcatgcaggccccggcccgcccgattggctcccttagaacggacgtctgggcctggccaggtcttccggcccactccgccggcgcggcgccccggggctttggggcgccagtctgccgtccggcctaccacccgccgaaagcctttggtccccggagagagcaggccccgcgagcccgaggccccagccgggcccggtgggcgtggactttgcgccatgtgaaggcctcaggagctctgccaccgaggcggagcccggggtcggggaaggcccgccgagctcagggaagctcacagccgcctttttggagccgggtcggcggggccggaggtgggcatcctctgtgtgtgacctgagtcgtgaaggactgttagggagagggcgagccctacctttcgcttctggtcttcttactttaggcctgttgttcatactagaaagtttgagccagttttccttaatgttatgactcgtgggtggggagaaaggaatttttctttaacattttaggttcttgctaaagttggaatctcagttcgtgttttgtgcgcctttccagatttccaggtttcgtggtgtgcagtttagagttgcactaactcttcaaaaacacaaacgtgcgcgcactcctttccccaaccagctatattgagaaattacccgggctctggggctttctgaccccacctccatccttaggaaagcgttagataaaacttggctacctcagcccattcaatttagaatagagagcttttagaggcaaaaaaaaaaaaaaaaaaaaaaaaaaaaacacagccagcccaaggaaactctatgcaaattaccttccttccttgaagagattagttttttgaggtgtgttcctttttctcaagtttctgaattcggataaagtattactcagttgcttatttaaaagagtcacttattctgaaagtattcttttggtttatatgcagtcagcctcttattttcaaaagtaaaaatctaaaattcttggaacctggcatcatcagctgtttctaacctcttggtcaccttgatgactcttagctgaaacccttccaagtcccgtggagtcccctgtgcagttctggaaagggattgacttatacagaagacaatggaggattgccccaaagagtgtccagaactgctgttggcccatggtcaggccaaattcagtcttttagagattaccacatctgatctcagtaggtagatggggaattagaggctttaccttaagaaaagggcataccactcatctccagagccagagtccgggatggtaggcagaatggaggttttcctaggatacagctttgagattaaaatacaaactattgaccgggcacagtggctcaggcctgtaatcccagcattttgggaggccgaggcaggcagatcacttgaggtcaggagtttgagaccagcccgggcaacatggagaaaccccatctctattaaaatgcaaaaagtagccaggcatggtgatggtgcacacctgtagtcccagccactctggaggctgagacaggagaatcacttgaacccagggaggcagagattgcagtgagggagatcgcgccactgcactccagcctgggcaacagagggagactccgtttcaaaaaataaaaaactatggtgactagaggcatctggcgttttatttttctccagtcccagttctataagtcaagcaagaagatgggcagtccctggaagagtattttgatgggacaggagtgggagagctcgtgggtttacattgctctcaactgtcacattgagcatgcttggcctctagtgtgttgataagcattggaagagtctgcctactcagcagcattgtgcctggagtggcagacttttggaatgggggaagcaaatttgagcagaggaaactgtcgttagaaactagtttagaggcagtggttaaaaatgcagcctatgtgtgagggttagcagaaggcctaccattttgttagatgaatggggtttgtttttctcttgggtgtatcaggacccaaagatgtaagaaccccatggcttcctagctgagcacagcatttttctttgtctcttgcaaattgtgaggatatttccaatgggaatactattttgtcttgttttgttgacttcagtatccccagcccttagaacaatgcctggtacataatagagactcatgaatttgttgaatgaagaaattcgttttaaaaatttattttctttgcttccttcattgtctggccttcctactttggttaatgcttatgttttcctgagccttactaacacgaggccgctcttaaaaaagagagagcgctgggtgctgtggctcacgcctgtaatcccagtactttgggaggccgaggtgggcagatcacctgaggtcaggagttcgagaccagcctgaccaccatggtgaaaccccatctctagtaaaaatgcaaaattagccaggtgtggtggcgcatgcctgtaatcccagctactcgggaggctgaggcaggagaatcacttgaacccgggaggtggaggttgcagttagctgagatcgcagcattgcattccagcctggacaacaaaagcgaaactccatctcaaaaaaaaaaaaaaaaaaaaaaaaagggagagggagcttgctgagtctagtaagtgacagctggaaacgggctaggtaataagttggtgtcactgtctggtgaatgatcctagcttctaggaaataacactgagtgtagacccagtcgactttgatttgggtgagagggatttggatttgccccatgtctcagcatttcttggttttgattttttgagccaactttatggaattgtgtacttttgcagatattactgtgaagttccttttgaccttgagcctctttctggcggtttgatgtctgttagtgttttttccaaatatgatggtctttatgcttggcattcctttggtactatggaatgccctggcatcagtaggtttagcctataaggagggtagcaccaatgattctgcttcgttgtccccaggcttgcttggtagaacttaaggcctccctgagcctcaagggaggttgtctggcttacttaattccctggaaagttagcttatgctttactctatactgttaatcatggtgaccattaataccatgtgccaggtattatgttaagcattttacattcattatctcccttaagacaataagcctctgagataagtattatattccttcttttatagaggaggacatcaaagttcagaggttaggtaacttgcccaagatcacaattaagcagtggcataattggaattcagacccaatgggtctgactatagagttcctgctcttaaccactcttctgtaagtctaagactatttttatttctctaacaactattcagcctccatttctattatgtcttcttcttaggccattattttctgaccctggggcaggatcactcacttggggccttatagctgggacactgacgctcaaaataccaggagctgctggaatgggtattgtaatatgtatggtagatactgctcctcgtgaccttggctgcctttccttcatctgagctttctggtctagggacagcttcatctattcactgtttctttcctaagtatgagttttagagactggcgaggcgcttggggcaggagtatctactgactccatttcctccttctagttcaaaaggtgatgacctatcaacagccattctcaaacagaagaaccgtcccaatcggttaattgttgatgaagccatcaatgaggacaacagtgtggtgtccttgtcccaggtaagctgtggccacagactagtctttccttactgcacttacttgagggattttcccaggtttcttttctcatttttcttgcagtgactgcagatagagtggggtttactgggaatcccaatctccagggctgctgcttactccccgtcagcccaatgacccaaaggccttaactttctttcctcagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcaggtgtgtgtggggtttttggcttcacagggatgggaggccagagatagcctgcattacaggcaggacccatgtattacaggcaggaccaagttcttggcacctgtcgatgcaggaagcctcctggtcatgggaagacttatgcttcagggttgtctttaggttttggttctgcctccctgggacttcaaaatccatttctgcaggtcccttgagacaaattggcgttcctgtaactttcttgatggctttattttttcctactagaggtgtaatttatcatacttatatcctggcttaggataccactcgagggtgtgtatgtatatgccaaataatctcctcactactctcactagtatgtctaattgatggcttgtgttggggttggaatgaggtgggggtatgggcatggaaggtgagctgctagcaggtcttttaagcccctaagttaacccgggagagaggaatagttggagccagacctgggatagctctcaatgtgagtgattttgcttgttcttgcataattttaggcaagaggttaccccatcttggagtcatctctagccactcctacccaaccaaccatcacctggccaggatcatctcaggcttttgattcttttgaatggagtctaagtttcatgtagctttcttcttgggagtgcttagtcacttcctcaaggtgttctgaccacctggctgagataattttgtttttttcacttctgtttcactgaccctgacaattgttagcttaagaccttcccttgtaatattgggtcaccagtattagctagaaggggatcatccttggatatctccctgaagaccctgcatgtctttgtggggtttctaaatgtgtggctcttgattttggctcactgattaggagtgagtggggctgttccttcgccctcacttccaccctgttctccttcctctcttcgcctaaagccatcctgccttttctttttcacttactatcagctatctgtgccaggcccttttggacacccagtgcttgggcccgaagtgtggttggtaatatggagtctgcttgtcatcctcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggtgagagctaattctgagcttaaggattattgactgtagggaataaaccttggaacatctttatctcattttctttttctttttttttttttaaatcttttatgcttttcccctgtatttatttattcattttttaagagatggggtcagctgggcaccgtggctcacacctataatcccagcaatttgggaggctgaggcgggtggatcacttgaggccaggagtttgagaccagcctggccaacatggcgaaaccccatcgtgggcacctgtaatcccagctacctgggaggctgaggcatgagaattgcttgaacccaagaggtggaggttgcagtgagccaagattgggccacagtactgcagcctgggtgacagagcaagactctgtctcaaaaaaaaaaaaaaagagacagggtctcactatgatgcccaggctggtctcaaactgctgggctcaagtgatccatctgccatggcctcccaaagtgctgggattacaggcatgagccatcaagcctagtctcattttcttttcttttttttttgagacagagtgtcgcgctgtcccccaggctggagcgcagtggtgcaatctcggctcactgcaacctccgcctcctgggttcaagcaattctcctgcctcagcctcccaagtagctgggattacaggcgtctgccaccacgcccggctaatttttgtgtttttagtagagacggggtttcaccatgttggtcaggctcgtctcgaactcttgacctcaggtgagccactgtgcccggccgctagactcattttcatatatttgtatacacacacatgcaaaccctgcacacatattcatatgtcttaccctctttttttcctccatccttcctttgctccatctctccccttctctgttccaggagagtaagctatctttatggatctctgaaggagaaagtggtccattttggctgggtcagggtccagagtgcacagttctaccattggtggttgtagtgaaaacttgggctacctatatggcagaagtcagaacttgatgggcttctgacatgtcaggttttgttcactgacctcttgtcagagggactcttcacagtttacctttctcatcttgcctgctgcttattaagacaggtggggtggagttggggagaggtagggcaatatctaatgaagggcactatctaatgagcttggcattttgaccccagggtctgatgagttctcactttgtcttgtagttgacacctctaactgtgcttgtactgtttgctctcgcaggagacatttttcttgtccgtggtgggatgcgtgctgtggagttcaaagtggtggaaacagatcctagcccttattgcattgttgctccagacacagtgatccactgcgaaggggagcctatcaaacgagaggtgagttttctccctgattccagtatccgattttatgattactcagtgtggcatcatgtggtaactgtcaggactgggtgctcggccggctgcggtggctgacacctgtaatcccagtactttgggagactgagatgggcagatcacttgaggtcaggtgttcaagaccagcctgggcaacatggtgaaatcccatctctactaaaaatacaaaaattagccaggcatggtggtacacatctgtaatcccagctactcaggaggctgaggcaggagaatcggttgaacccaggagtcggaggttgcagtgagctgagattgtgccactgcactccagcctgggtgacagagtgagactctgtctcaaaaaagaaaaagactgggtgttctttggagaactaaccatctttcagggatgagaaacctgccagctattcatttctgggcctaattgtttcttggatttacctaatgccaggaatttcaaaaaactagactgaacccaaaatatataagtgattgaaatcatttttgaagtaaagctgatggtggcttcaggcctctgcccattcccagggtttccagcttcagattttagagaccccttctcagtaagactacgagtaatgtgagaggcaaggactgtgctagaaatctttgccttgggatttttgtagttgttctttgaggccggatccctttagaggagaatcttttttaaatttaatttaatttttaatgagatggagtcttgctgtattgcccaggaactcctggactcaagcattcctcccacctctgcctcccaaagtgctgggattacagatgtgagccaccatgccgggttgagaatcttcttatacggtaggtttttgcacactaggtagtggaatgatttagagaaactcagcttttgctgatataatattcttgccttctcctttctttatctcctccatattcaggatgaggaagagtccttgaatgaagtagggtatgatgacattggtggctgcaggaagcagctagctcagataaaggagatggtggaactgcccctgagacatcctgccctctttaaggcaattggtgtgaaggtgagcatcctgggctctggaatcaagtctaaagtggtgccaatgtctaatcctgtcccaatgtctaatcctgggactgttttcatgcatggctttcattattgccttggattagaggggcaataacgtatcctttagtttacctaaggctctaaattcattagagctgatggtctaaaaccagagtaggctaatcaaattgtctgttgtgtgcgtgtgcgcacaaaacacacacacatatatatatgggtttttctttacaactcttagaatataaaagccattcttgtatcaatggaccctgtaaaaacaaatctcaccatagtttgccagcctgtctagagcaatgtcacccagtagaagtaaggaagttaaggaaattttcagagtgttaaagggttctgagtctaaaacatttgagaactattggtctagagtgtagcttctcaatcttttcctagtgggaaagtgtttccatggaacacactgaagatgaagttactcattttcctagtgggtggcacacaaataatttcattttctatgtggacagtttacatgttctgcttgtggatgaggccatagaaagggtagtgttgaagaagaaaaatgatgattgtaaggaacagcattccagtgtgataaattctggagggcatgattactggagtgagtgatcctctggcaatgaagaaaatagaccctgctctcttaaatggcttagctagtctttggcccttggtctgtctaaaattgagcccttagtgtaatggcctcttgcctttccctagtcatgtatcttcaaacgcatttggactacagtttctctgcccttagtctcctatgcaagttgcaatcataaatgttgcccactttctagcagtattttccctgctagtaatagaaatgagtgtggcctaaagtaattgtcttcttagcatttactgcggagggcttattcttaatattgtcagggttgaagcctgattctcaccctctctggagcgctagtcaagccattttagggtttgggagaaggtgggaacctaatcacactctgcattggtccacagcctcctagaggaatcctgctttacggacctcctggaacaggaaagaccctgattgctcgagctgtagcaaatgagactggagccttcttcttcttgatcaatggtgagatatttggttcatcttatgtctagctagacccaattttgaactgggcttatgagctggagcacttatgaacacatcctttttgcacccatgccctccttcatgtttatagcatatttcttatgctggggtatgttacagacagaagagcaataaagggaagatattttacattggtgctccctgtcctgccccctttgagaaagattgtggacagactgcagagcgggagcaagctagaatgagaaatcaaagggtgaatggttagtgatttgagagggtttggggcaaatgaactttgatcactggctcttggagaatgctgtttagtggtgtgccatctggtgtgccatctctcttgctctagccagaggtcctagagcatttgctgtcacctttacagttcaactgtgagaagagtatagtgagtccctgggcttctctccagccttgcctggtggctgtcctgggataatggctggtagaggatgtgagaagtaggcagaggttaccaccttctcacccaggacctgtctctgggccaaacaagcaagataactgatttttgggaggaattgggaaagactatcattttgttattgtctccattctgtatcctttcaggtcctgagatcatgagcaaattggctggtgagtctgagagcaaccttcgtaaagcctttgaggaggctgagaagaatgctcctgccatcatcttcattgatgagctagatgccatcgctcccaaaagagagaaagtaggagcttacctgaggggatagaggggggttgaaaggccctgacttcacttctgaccagacatcctgttctggcagactcatggcgaggtggagcggcgcattgtatcacagttgttgaccctcatggatggcctaaagcagagggcacatgtgattgttatggcagcaaccaacagacccaacagcattgacccagctctacggcgatttggtaaggactccagatacttttgaccccgtccttgcttaggtcctacttctctccttcatctaagtcacctaatcctcttgaagcccttcacagtgattgggtccaggggtctttttcctttaccctacgtcctgtctagagtgaccaaccaccctggttttcctgagactgaaaggtttcccagagcttgagacttttttagtgctggcattaggacaatcctgtgctggctgagatggttggtcaccctaggcctgtctcttacctctggactagagatgagccctgtttatgtttgtgtactgtcccacaggtcgctttgacagggaggtagatattggaattcctgatgctacaggacgcttagagattcttcagatccataccaagaacatgaagctggcagatgatgtggacctggaacaggtgaagtgatgatgatggctgaccaggcgttacagtgtctctaggcagttgctgggaactggctagagacataaggttaagatgtgaggagatgggttttgatttctggacaggggaaaggaagtaatctgagattgaatccaggaaatgggagttggcatttttcatagttgacgctgcatttagagtaaatcagaattgttggagcagccttatttctaggtcccaagtccagaattaagtacttaaaacccagcccataaaggtattgatagtatatattcaaggaaatgagaggacccagggatagcagtcaggggaaggattctattgtctctgagcctcctgcagcagctgggtctttgaggcagcatagtaagtagatctttctctgcaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccgggtaaggaccacacccgtgcctcaggtacacacatacgtgctttgacccctcccttgataagtctcatccccagttttccctccttttctagtgggccttgagccagagtaacccatcagcactgcgggaaaccgtggtagaggtgccacaggtaacctgggaagacatcgggggcctagaggatgtcaaacgtgagctacaggagctggtccaggtagggcaacttggtccagggtgagtcactgtctcagtacattgtaattgatctgggtgatctcagggtgtcaacacatttgctgcaagagttgtgagagcacgacttaggaacctactgttcttaggtttgaggcactaaggagtcttcttctagagaacctggatctgataccattgggtacaccatgaaataatggaggggatgcttctgtttagttaggtttctttcaaaatgtggaggtagccttgaaccctctttccttttcctcctagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggtgagctacaataggctgaactatgtattgatttgcctgagggcaaggaatagaggctgtttttctttaagagggttgaaatattcttagtgctggctgctcaactgcacagtaagtcacttgattttctttctgaggtctgagagacctagtgttattttttttttctctctctctctcttgagacagggtctggctctgttgcccaggttggagggcagtggtacagtcatggctcactgtaaccttgaaacctgggcttaagcaattctcctacttcagcctcctgagtagctgggactataggcatgcgtcaccacatctggctaattttttattttttgtagagacaaagtctcagtatgttgcccatgctggtttcggatttctggcctcaagtgatcctcccaccttggcctcccaaagtgctgggaatacaggtgtgagccaccacgtttgcctagagacatctagttttgttagtgcttgaatcaatccattcctcctacaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggcaggtgcaagatcatgggctgtgggagacttgcatgagtcctcaggctggtacggagtgctctttagtttctggacaagattccactggggttagggttggtctaaagggaaggtagaatttttgaggatatcaagataatctagaatcaggaataaaatggggtggccaaagaaggggcaaactgtagttgggagtgctcgggtagcccaaagatctgcgtatctcgagaggagaggctaaatgctaaggtacctctgctgctgcttttaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggtgagtctgcatcctttccccagatgtgccaatcatggagagccaggcagcagccaccaccatgccctggagttgagagtagaagctgttggaaagatcatctaactgagaagaattttaatagggcatcaaagataaagaatgctgaggtgaatccattcaatttggaataaggccgagaagagatggtcaggctccattctcagtctgaaccaagctccatgagggaaatcaaagtatgagagtgcagcaaacacagcaaggttttttttgttttttgttttttgttttttttttgagacgaagtctcactctgttgcccagactggagtgcagtggcacgatcttggctcactgcaacttctgcctcccaggttcaagcgattctcctgcctcagcctcccgagtagctgggactacaggcacatgccaccatgtccggctagttttttgtattttttttttagtagaaacgtggtttcaccacgttagccaggatggtctcgatctcctgaccttgtgatgtgcccacctcggcctcccaaagtgctgggattacaggcgtgaaccacagagcaaggttttgagctgagatgagactcatatacttatccctgatggttggggaagggatagggtccacagacctcccaaaatgaaaaggcaaattcatgtgtttgtaagttccataaaggtaagatctctgtcatctcacttgttttccactatgtcttgtgttacccttaattaattcattaagttccaaacatgggacttaatgagcaaataaatggctttctttcccttttgaagggtctgtgacatcccttctctctcccataaaagcttaacaactactgatgaactaatcctaggaggtagtcacataagtcacagaaattggcctctcaatggaagagataggttttgagctgggctgtgaagagagtagaatttgaataaagggaataagcagcccaaataatgtgctctagtagtaggattgcaatcattgggaaaccctgggtagatttaagagtatatatgtcactggaagtgagaccgctaggtaggatgtaatccaaatgtggtaagcactgaaagccattggcatttccttttaaagtattaaggtttattaaggtatgatataaatacaataaaattcactctttctatataccatttccatgctttatgacaagtgtgtgtaagttctataactactaccacagttgagacttaaaatttctactatctcaaaaagtttccttagccacttcagtcaacatctcccctccttaagccccatcactgatgtgatttctgtccctacagttttcccttttccagagtgcattgacaagtttttaagcagagcagtgactcaattttaggaagcatggcctagcatcttacctcaggttggattggaagggcaaggagaccaataaactgcagtaatgggaggcctgggatgaaatccaggctgggctttaactagccctagtgatctgtgtttaccaactataggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcaggtaagttggttgggagcattagacagtgcttaagttactttggggacctacaccaaaagggatgggagtcctaaggaagctagaggggtagttgtggaaatcttacacaggccctgtcctaaccctcttttttggctttgctcttgtacacagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgg

SEQ ID NO: 37018 - DNA, 2093 bp, Homo sapiens
cggttctccaagcacccagcatcctgctagacgcgccgcgcaccgacgtaggggacatgggcagagcaatggtggccaggcttgggctggggctgctgctgctggcactgctcctacccacgcagatttattccagtgaaacaacaactggaacttcaagtaactcctcccagagtacttccaacactgggttggccccaaatccaactaatgccaccaccaaggcggctggtggtgccctgcagtcaacagccagtctcttcgtggtctcactctctcttctgcatctctactcttaagagactcaggccaagaaacgtcttctaaacttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgtgattgtggaatggagattcagttttcatttggttcattaattctataaggccataaaacaggtaatataaaaagcttccatgattctatttatatgtacatgagaaggaacttccaggtgttactgtaattcctcaacgtattgtttcggcagcacttatttaatgccgatatactctagatgaagttttacattgttgagctattgctgttctcttgggaactgaactcactttcctcctgaggctttggatttgacattgcgtttgaccttttatgtagtaattgacatgtgccagggcaatgatgaatgagaatctacccccagatccaagcagcctgagcaactcttgattatccatattgagtcaaatggtaggcatttcctatcacctatttccattcaacaagagcactacattcatttagctaaacggattccaaagagtagaattgcattgaccgcgactaatttcaaaatgctttttattattattattttttagacagtctcactttgtcgcccaggctggagtgcagtggtgtgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacctgcctcggcctcccaaagtgctgggattacaggcttgagcccccgcgcccagccatcaaaatgctttttatttctgcatatgttgaatactttttacaattaaaaaaaaagatctgttttgaaggcaaaattgcaaatcttgaaattaagaaggcaaaaatgtaaaggagtcaaaactacaaatcaagtatttgggaagtgaagactggaagctaatttgcattaaattcacaaacttttatactctttctgtatatacttttttttctttaaaaaacaactatggatcagaatagccacatttggaatactttttgttatcagtcaatatttttagatagttagaacctggtcctaagcctaaaagtgggcttgattctgcagtaaatcttttacaactgcctcgaaacacagaaacctttttaaaaatagacactccccgaagtcttttgttcgcatggtcacacactgatgcttagatgttccagtaatctaatatggccacagtagtcttgatgaccaaagtcctttttttccatctttacaaaactacatgagaacaaacagatcgaaccgttttgaagctactgtgtgtgtgaatgaacactcttttgctttattccagaatgctgtacatctattttggattgtatattgtgtttgtgtatttacgctttgattcatagtaacttcttatggaattgatttgcattgaac

SEQ ID NO: 37019 - DNA, 2093 bp, Homo sapiens; identical to SEQ ID NO: 37018

SEQ ID NO: 37020 - DNA, 15942 bp, Homo sapiens; identical to SEQ ID NO: 36982

SEQ ID NO: 37021 - DNA, 15942 bp, Homo sapiens; identical to SEQ ID NO: 36982

SEQ ID NO: 37022 - DNA, 25587 bp, Homo sapiens
agggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgagggtgagcggcaagcgcgccgcgggtcgggctgtgcttgcgggggctgcagagctgtgcgggggcctgggccctgcgaccccggcgggcgggcttccgcgcggtcagctccagaactagtgatgggcgccgagcccggggtaaacttggcggagttgaaggggcgggggcggtggctgtggcagtggcaggatcgatttggggttcccgggagaggaaggtggccggggtctcttgggctccgacgccctggaagacccctgtcacccgaggctgggagagggctgcagagcgccttttttgcagctgggtccttcgccttaatttacagattttcgtcaggtccaggctaactccaggcgaacgcgcccaggcagtgggaagggagagggagagccactggagagaaggggcgagggcgtgaagaaacaagtgcgagttctttggaacagcaagcattccttttcaaaatgtggtctgtagatttggaaatgattaatccatagattctggagaaagggatggcttggtttgcacctttgagaaactagagataccattccttctgcatttagcatttactgtgtgccagtccctgtactgggttctgggaggaaaagattgtgagtgtggtccctgcccatgaagcgcgtactccagtaggaatagtaacaactacttcatggtccctgcatttttcttcgaagtgagctagctgcagacataagaactctgaagattaggaagtgctaattaaggaaaagttgttattcctagagaataaggcatccaggtactggtctttaccttcttcctctctgcccttacttttaatcactagctttttaaccttctgagtttgttctaatataaatatacactctttgataatgttagtgtgtagggaaatcgtgaactttatactctttcaaacagattgagtaacttctgcgtgggtcactgattcaaaaagagtctttgcccaaatagaaaaggaagtaaaaacccacactcggcgagaaaaacacctgccgaaaggaatccgatagcgggactgcttacaaattgtgtcttgagacctttacccaaatcatgtttgtttaaatagtgtttatttaaatacagatacccaaaatacactgaagcagaatgcaggggtgggccccggaatctgcgttttaagtcagttttcccttgagacatagaattaacttcgggaggcacagtgaaagttgaggaccagtgtgggtggaagatgctttttggaacatagcggaaaagcatatagcactgtcttggttttgatccagtgattctgtttttggggggattcttgagaggcctgggagagtggctttaggagctgttaggaccagcaagtttatccttccggtcagaggtctttaacacagaagagtccctgggaagcagttgctcctagggtgagcctaggaatcccaggggtcatcatggccaagggcaggcctcctgggacttctagctccgtttttttttttttttttcctagataaggttacgcattgttgcccaggcttgagtgcactgtcctgatcatggcttacttaagcctcaaactcctgggctcatgggatcctcctgcctcagcctcccgaggagctgggactgtaggtgcttgccaacacgcctggctgttttttttttctggctctgtcgcccaggctggagtgcagtgacgcgatctcagctcaccacaacctctgcttcccgagttcaagtgattctcctttctccacctccctagtagctgggaccacaggcacgtgccaccacacccagctaattttttgtatttttcagtagagacggggtttcaccgtgttaaccgggatggtctcgatctcctgaccccgtgatccgcctgacttggcctcccaaagtgctgagattacaggagtgagccaccgtgcccagcctggctattttttttctttttttggtagagatggggtctcactatgttgcccaggctggcctcaagcaatcctccatccttaaactcccagtgtttgggattactggcgtgagccacggtgtgggcttaccttgaccctttctcatccctgagggcatccctcggccattcactgtcaaaacctgtcatagattcactgataacttgtccaacagatttatttcaagtctgcactacctcacccctcaagtgtttcaagtctcgaggcttttttttttctttttgcttctgttacattttagatttagacagcacagtggtgtctaggtacttaaatgccctccttcccccaacatggttactaaatacaccctaagctctgatggtttaagcctccggttgcagggctttccgtgtctcagaaggtgcctgcactctacacatccttcatgctaaaacaggaaaggaaaatattctgatcctgtttgttgcctgcttttatgtggtattggtttgtttagatttaaaagtaagtagaaattcacctatttttcgtgctaaggaactgttaaactctcctcctcttttcattcctgagacataattattttcggagccataaaaatgtggaaactctaaatgattccaccaaaaactttgggcgtattgggaagaaaatctaatgtgacaatacagcatagcagttaagtggtcaggaccctccgctaagtagctttgtgatctttggacaggtgactcaagttcctgcatctcagtttcttcatctgtaagatacaatataacgtgtaatacagtctcccttaaggggtgaagtggtgtgtttaagagcccagcacagtgcctggtacatacaataaataccagctatcatggttaccgtagctgataacagttcttgtttctgtgtttaatacaaactcttcagtattggctgaatggtagagtttatgcagctgtttcaggcacttctctgggggagatgagagtgatcagctgaggacggagagtgaggacatcctaaaaggagctgcctgtgtctgagcaggacccagtgttgtcatcaggtgtgccccgtgggagtggacagggattgaggcaacctgctcaggtgagggtcccccacttcaggagaggccttagcatgtgggctgagcaatgtggagatgaacttgggaattcatttgtctcatgctgaggaaggttgcatcttttcagagggtgctgaaaggctctggacatacatatatatatatatatatatattttttttttttttttgagatggagtttcactcttgttgtccaggctggagtgcaatggcgtcatctctcgagtagctgggattacaggcatgtgtcaccacgcccagctaattttgtatttttagtagagatggggtttctccatgttggtcaggctggtctcgaactcccgacctcaggagatccgcttgcctcggcctcccagagtgttggggttacaggcgtgagccatcacacctggccttttttttttttttttttttttttttttaaatgacagtcttgctcggtcgccaggctggagtgcagtggtgcgatctcagctcactgcaacctccacctcctgggttcaagcaattcccctgcctcagcctcccgagtggctgggattacaggtgtgtgccaccatgcctggctaacttttttctgtattttagtagagacagggtttcacgatgttggccaggagggtcttaatctcctgacctcgtgatctgcccgtctcagcctcccagaggagcacgtggattacaggcatgagccaccatgcccggccctggatgtattttctatcctagaatgtccacctttaaaaatgaagcccagtgaaaagtgttcccccactaaaatgtggactgttttgcttgcagggatgtgtgggtttctggtagatagaaggctagagctagcaccttcccaaattgcagaggaatcaatcctggcttgtctgtgagctggggaggaaatggaaaggtaggggccttgagagtccttaattacatagggaatgtcctatcattttgtttattctttaaaaagataatgggattcttttttgttgttgttagtctcgctttgtcacgcaggctggggtgcaatggtgtgatctcggctcactgcatcctctgcttcctgggttcaagcaattctcctgcctcagcctcccaagtagctaagattacaggcatgcaccaacatgcccagctaatttttgtacttttagtaaagacggggttttgccatgttggccaggctggtctcaaactcctgacctcagatgatccaccctctttggcctcccaaagtgctgggattataggcgtgatccaccatgtctcgccaaaattcatttttttaaaagggtcaagaaagaagttgcctcttaggaatgctgtgtcccatggtgactagtcagctcccacttaatcatgagagctctgtcacattgtaatgttgagagcccacttgaggccgaccataggtaagaagacgtctttgttttttgtaaaattcaccctgtaaaggagttgtctatgtggtcatgttttaggcctcttcgctgcaaacgtcagtcttatgctgtgcaccgagccaattagtttcccttcctctcctagctgtgattcctacctggaagagttgattaagttccccagtgcattatttccgaccttcctccaatcttcccatccatctgcttgcaagtaactttgactcctactgggcagagcagctaggtagtgagagtggatatggatggtcccaaagcactacttaactgccagccggggcccctggtggtctccctcagggaccacccaggatttaaaaaaaaatgtcaaaaatctcgattacttttgcaccaaccctaatacttgggcttagtcttaatgacatcagcacaagatgtgtatttcagcctcacacgattcattcaaagacacaggtaaatacagtgggcaagattttctaaatagcacagagcagaggatcttttcttttttctccctcttgggggtctagaatgatctgaaaagggagaccagaaaaccttgggaacactgggtttccctctgctccacagggagatgtcagcctggcccctgcctgtactgtcagacacacgcagtcccgagaccccaggggaggtgggcctgcgcccaggctgtctttctctgtgttctgccctccatgaacttctgacagtgcctagggagttcctggtgtggagggaggggtggcaggcaggaggctcatctcagatgggtgggtttgcttttggcattttagagctctttctccctcctccgacaaaagaggatcctaagccttaagttgaaacaggaatgtgcaagtcaggaaaagctgtgggatgtttaaaaggaagaggactgagtgcgggtgactagtgtgtgccagtgggctttcttgttggcttttttgtaaagtttgcagattggtacatgttgacagtgatgaacaaagctgcccccttctccctgcccggcacagacccaaggagtaggctggaggagcagagggcaggcacagccatgtggggtgggtgcaggctgcctccgtggctaggcagccacagagtccacgcggggttccttcatcagggttggtgagccccaggagttctgggatcccaggggcaggttttcagaccctgacctcatccacagcccaaaacagtaactagcagcgttcatttacctcctggaaaacacatctccagaaaagaataattggccccggaaacattctggcttcagcgttaatgaaattgccgtgcttgctgtgcccagttcagtttactggtgtgacagtagccagagaacctggttaataaaaatggcaattccatgttctttgtatctgtggtttggcaaaaaaaataaaataaaataagttgaaccttgaaaataaaatatacacaatttctcacattctaggaagaaaacttagcttccaagcaaaggtgtgatttttgatacatgttgaccccatcaatttctatatttgttatcctggaaattactcaggggtgcctttataagtaaaatgagatttcccgccctcttccccttcacacttgagccttttcctcaaggattataaaacctgaagggctattttttatgggtatgaggtaaaatgccaccccctttcagaaatggaattagtattccatcctctgcagtgaaaagattgagtacttgtttcctgttggtactcttttggggccaggcagataatttgttgatgggaggtgttactgaaggccctgcctgtggaaagcatacagggtgaggaggaggcggcacatcagtgagcaataacgttgaacacagacaagctagggcgagatcacgaaatgcggtgccctgaaatgcagagtgtgggatgtgggtaggggagcccgagctacaggagcgaggcccgggaagaccgcagagggtggtacaaggaagtagggaggaggtggccaatgcggaggctgtctgggctcagggcagggtttgcagagcaaggcagggggccgcgactctggaagggtagggtagtctgtgctgccctccaacttcccctgggacatttggactttatattctagagctgtggttttcaaatattatttagccatgacctccctctgaatgaaattttaagtagcaaacttagaacagctggcatgagggaggcctgatgtcaccagccaatgacgtggtgggcccccagggaccacccgggacttgacacattctgaagtgtatgaattttaggaaagtttttttttttttttttttttttgagatgaagtgtcactctgtcacccaggctggaatgcaatggcgcgatctcggctcactgtaacctccgcctcccaggttcaagcgattcttctgcctcagcctcccgagtagctgggactacaggcgcgtgccaccatgcccggctaatttttgtatttttagtagagattgggtttcaccatattggccaggctggtcttgaactcctgacctcgtgatccgcccacctcagcctcccaaagtgctgggattacaagtgtgagccaccgcgcccggccaggaaagttttaaggagagtcaccaccagctttgtaaccagtctgggtgttttccactcagattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtaaggaccgcgttctaatttctgcaggtggacaagcgctgtgctccattcgctcagcccttcacccggtcatccagaccttggggggtggggtaggagtgtctgggtgcaggaacttgcactctagctttaagaacgctgggagctcactcgttctaccactgtgcgttgaacggccagtgagccagccctcatggaaggcgatgtcttcttgtctcagtccagtgggttaaagatgaatacgtcctctgatggtcacagctgggggacgggcatttaacaagcggcaatgacacagagccctgtgttggtaacagacacgtccttgttatagattctgctccgacctgtctcaggccaccctgccttcctcttccctcaaaggctgttgctcaggcagctgccccaagtgcaggctgttggcctgtgtggtggattttttactacacacataggccctgcggggggaccagtcaggcatccccacttcttttcctgtctttactcctcctagtgcagaccgttagagctcttgtgtccctctcatcccttctcctctactgttttgaatctcatgacccctgctttgctcttctgtctcatgccctttctgtttcacttctgagaccaaataggatatactcacttttgtccagtgcctgagggtcaagcgtagcacaagtgttttatttaaaacatggaaataggccgggcatggtggctcacacctataatcccagcactttgggaggccaaggcgggcagatcacttgagaccaggagtttgagaccagcctggccaacatggtgaacccccatctctactaaaaatacaaaaattaggcatggtggttggcacgcacctgtagtcccggctattcgggaggctgaggcaggagaattgcttcaacctaggagggggaggctgcaactagctgaaattgtgccactgcactccagcctgggcgacagagcaagactctatgaggttatattattcctctttcataaattatcagatttcatactttttagttcaaagagaccttaacattcttaagaagtgaggacctcagagggctttttatatgggtcatgtttatcaatatttaccatatttgaagttaaaactgagaaattaaaaaaaaatttttttgagacagattttcactcttttgcccaggttggaatgcaatggcatgatctctgatcactgcaacctccaccttctgggttcaagcaattcttgtgcctcagcctcctgagtagctgggattacaggcgcctgccaccaagcccagctaatttttgcattttcagtacagacagcgtttcactatgttggccaggctggtcttgaactcctgatctcaagtgatccgcccaccttggcctcccaaagtattttttgtaaagatggagtttcgccatactgcccaggctggtctcaaactcctgacctcaggtgatacacctgcctcagcctgccaaagtgctgggattacaggtgtgagccactgcacccggccatgtcaagctcttttaaactacattcgtgaaagtgcatttgcctattcatgagggatccacccttaagacctaaacccttcccactaggtcccatctcccaacactgccacactggggatcagatttcaacattttggtgtggacaaaccacatccaaaccaaagtggtatgtattattgttggatttaaatcccataggtacagttaacgttttttgcccttcctaatctaattgttaggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaaggtgagctggtacctgagctcgtagaggaagaactccttcccgcagggaatgggaatttggctaatagaggaagaaaagctgagggtaccagggactgactttctcaggaaccttagccctctggaatgtttatttgctcttggggtgggggtgggggggtaggaggggggagtagtggggtgggcagggtgggttggggcgtggcatctttacatttcagactctgaaactcaaaacatgggcaggagtgttaggaaatgggccagacatggtggctcacacctgtaaccccagcactttgggaggccaaggcagctggatcactttaggtcaggagttcaagaccagcctgaccaacatggtgaaaccccatctctactaaaaatacaacaattagctgggtgtagtggctcatgagtgtaatcccagctacttgggaggctgaggcaggataatcgcttgaacctacgaagcggaggttgcggtgagctgagattgtgccacttcactccagcctgggtgacagaatgagactctgtttcaaaaaataaataaacaggagtgtaaggaaatgacatcagaggtcacgggtcttggtggtggtctagagcactggttcttaatgtttagcaagcgtcagtcatctggagggcttgttcagcttgctgggccccagcgccagagtttctgattcagcacatttcaggccagatacagtacaagtcaggccagataatttgcatttcttttttattttttttttgagacttagtctcactctgttgcccaggctggagtgcagtggcatgatctcagctcactgcaacctccgcctcctgggttcaagcgattcttctgcctcaggctcctgagtagctgggactacaggcgcctgccaccacgtccggctaattttttgtatttttagtagagacggggtttcaccatgttagccaggatggtctcgatctcctgacctcgtgatccgcccgctttggcctcctaaagtgctgggattacaggcgtgaaccaccacgcccgcccaataatttgcatttcttacaagcatgcagggctgctgcatgctcaaaattgctgctggctcaaagccatgtgctgagaaccacaggtgcagagagccacatccagggattctctgaggatgtctgcaatctggcctgatggatccctgcctggctcacattagacactacatgcattttattaaatgaatgaacaaataaattatttgatttttatttaattttatttcgataaaatgtatttaattttattttgataaaatgtattttattttgataaaatgtattttattttgataaaatgtatttaattttattttgataaaatatttaattttattttgataaaatgtatttaatttttgagacggagttttgcttctgtggcccaggctgcagtacgatggcgcaatctcagctcaccgcaacctccacctcccggattcaagtgattctcctgcctcagcctccagagtagctgtgattacagggacacaccaccacgcccggctaatttttgtattttcagtagagacggggtttctccatgttggtcaggctggtctcaaactcccaacctcaggtgatccgcccacctcggcctcccaaagtgctggaattataggcgtgagccactgtgcccggcctcttattttaataaaattatttaattttattgaatgaacatggtatcctttagcaagggcaaatctctctgaatcactggcagaaaaaaaaaaaaagatgcggctgcattttccattcccagtgtggagtagaggaaagagcgttgaataggcttccggtcctcatagacataagataggcctgtgttctggacgagcgccttgcccttgccaggccttggcatctcatctgtggagcatggtgtcagttggatgtaatctgagatcacatctctgaggtggtgtgagaggctctcctctgctcctttaagcaatggcactcactgtggcgtatacaaagagaatggatttgcttccgttgatatttagtgtcacagtttgttgactaggtaatacatttataaacttggtaattcagagaggtagattaatgaatagtctttcttccctgaacctgggtgatccagctcccctctaagaaggtactagtaggctgggcacggtggttcacgcctgtaatcccagcactttgggaggccaaggtcggtggatcacgaggtcaggagatcgagaccatcctggctaacatggttaaaccccatctctactaaaaatataaaaaattagctggatgtggtggcaggtggctggtgtgtggaggaggctgaggcaggagaatggcgtgaacccgggaggcagaggttgcagtgagccgagatcgcgccactgcactccagcctgggcgacagcgagactctgtctcaaaaaaaaaaaaggtactagtgtaacaggtttcttctgtgtttggagatattttgtatgcataaaagcaggtgtgtgtgtgtatctgtctgagagagattttctcatttttacagttattagtatatgtcaaatactatcctgtaccttcatgtttttatttaacagatatgtcttagccatatccatacataaagaacttaatctaaaacaaattgaaagttgagtacttctttattttagatggagtcttcctctgtctcccaggctggagtgtgcagtggtgcaatcttggctcaccgaacagcctccacctccggggttcaagtgggttctcctgcctcagcctcccgagtagctggggttacaagcatgtgccaccacgcccggctaatttttgtatttttagtagagacagggtttcaccatgttggccaggctggtcttgaactcctgaccacccatgatccacccacctcggcctcccaaagttctgggattacaggcaagccaccacccctggcctaaaagttgagtacttctattgttgtgaagtaaacaggcatatgcgtttggaggtctgtggccaacatttgactgcaagagacttggctgttttgcaaactttagagcagtgtatgctatgttttgataaagaggcctcctatgtgttaagtgcctcaggacccctgggtgtggtctggggggcagggcacagacacttcatgctgcgaatgcgcagaggaggtgcttgtgcacgtttcagtttgaagactgcagctttgcaggagtggctgtagatttggctccttggtagattctgcagtggggaaaaagagtgacagtttgcaaccactcgtcctaagaactgcttggcacattttttgtacgaatttattgttccactccagccctggagtccatttctggagaatgaggccacagatgggcattttttaaaagccttctcaggtaatgccactgcaccttgagcaatgggagctactgctcctcttttaaatttttcctttttttttttttttttttgcatacatcttatgacgtatgtaatatagtaacattagatgtgaatgactaaatatgtatatattttgtatgtgttcaggagatgccccacaatgctatccataggcatatgtaatcaaaaccattgggagttggtgagggtttgcgtggagttagtaccatagcctgatggtaaaggaagtctcaaccatcagtaagtcttaggccctctggagaagtctgcaggctgtggaaatgcgatggacaattgttgggaaatagcgaaccttctgactcttggctgtgtccccaaaactgcagagatgcagccaggtttcaggaaatcagacacctcctgttcttgtgggccccgacacttgctttcttccccctcctcatctgcttctggagggaggtgaagtgcctgccagtttgggccttgtgtgctcagtcttgcttggtttctttcagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtaaggtggtgtcaggccctttccatattcagtaccctggtgggcactaggtgcggggtggcaggcccctgcccgtgaggcaggaacagcagaggagcaaggtgggcacgagttgtaggccaggattgaggctccaggtcttctggaagaagcgtggatgtaagagagctgttgggggagtgaatgtggaaggaactgccaagtagtccattcttgggtgggagaagggacccaaaggaaagaagatggcagaaagagaggtggtcggagtgggagcaagtacagtggctggtctgagctgcccagcttggggaactgaggtggctgcttcatggggaggggaggggagggacgcacaaccagttgcgtggataagctggcagcagtcagagtagagagcagagcggaagaagacggctctcaagggagaggggagcctggcttcaggagagaccatctgccttcccaggagacggcccagggtaccatctgtcttggtgattttgtggtgggtcagctgtggttctggttcttgagcagtcctggtatgtctgaccatcaggccaccaagaaccgcctcagatgggtgtgttctgtagggagtctgggagagtcagtaagcagaggaagcttttgggcctagaaccagcaggtggaggccatggctgatgcacaggccggggggtgggtggcaccttctgcactgtggggtcaggtttgggaccaggacacccttgttccaggcaatgcctggataagcccaaacctgaggccacagattctgcagcagaaacctgggagttgctggatgtgcagatgaaaagtgaagtcaggtgggtggttagagaaggaaatgatctgggagagaaggaaggaagcgtctgggacacgtggggcacccttctaacccccttgcgatgctggagagacacagacccttgtttcgctatgcatggggccctggcctgatgggtgggaggtgtgagagggagagtggcagctgcacatctaactggtgggttgctttgtggctcgctcaggagccaggttgagccgactgctgcacagtgcacgctcagcgagtgtagtgcgatttccctgaagtggttgatgatgcctcagaagataattatccatttattcacaaacagttttttggtcttttgatgtgtttttgtgtgtgtggtgggaggttgtttgttttttttgttttgttttcttaggtttcttttgagataaggccttgctttgtcacctgggctggagtacagtggcaccatcatagttcactacgccttgaactcctgggctcaattgtgctgcctcagcctccctagtagctgggaccacaggtgtgtgccaccacgcccagctaatataaaaaatatttttagagatgaggtcttgctatgttgccccggttggtcttgaactcctggcctcaagcgaccctcccgcctcagcttctggaagcactgatattacaggaatgaactactgtgccagccaacaaatggttttgaagttgcaagatgcaccctttaattcatttgggtgtcctaaggactttgacaggatggtgttttatcttaactcaggactgagagcctcctgtgtgccaggccccagctgggtgtgggatgttggttcttttttgagacggagtcctgctctgttgcccaggctggagtgcagtggtgcgatcttggctcactgcaacctccgccccctgggttcaagcgatactcctgtctcagcctcccgagtagctgggattacaggcgcccaccaccatgcccagctagtttctgtatttttagtagagacggggtattgccatgttggccaggctggtctcaaactcctggcctcaggtgatccacctgcctcggcctcccaaagtgctgcgattacaggagtgagccactgcgcccggccagttcttgtgggcaatgggctgtgtgacgcaatactgactccaagggactctccctcatctcctccctgggtggtctgtgtcagtgagggtttgtgacgctcttctgttctccatgcctctgttcttgttacctggacctgccgaccctctcttcgccccacctcccgtgggctcctggctaattcctcgctgtcccttggatcctagctccactgctactcctcctctgaagccatctatgacttacatccttgctggcccccaactctccaaccaagaaagtcctcttgctcaggacagtgtctctcttggcctctccatgttttcccctgtgccgcagttactaatgtcctgtctgtgtcctgtacatgtgtgtacgcatgctccacccccagtgtgtgaatgctgtgggatgaagtttgtgtctgtccagcggtagcgccctcaacagcacctgagggcctgagggtctaggaggcattcggaggcttactgggtgtggccaggttactagggagcacaggatgggtttctgcagctcatttagctagaaagtgagtccacactagaatgagcccctgacaaaccagtttcctcttggcaggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggtatggccactcccttctctcccactacagtggggaagggaaactccctaacaggaagctgccattgaaggtgctgggggctggcaggcatgggccatgggaagtgggcagttcttagtgcccctgctcaggcgtgtgccctgctcccaggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccggtgagttgtggccctctgggctgaacaaaatgtgcgtgccttgggccgtctgcggttgcctggtttttcagaaagctcctgggacatccattagggggtggtttgatgagccatctctgggaataagctttccattctggggttggagttggggctggggctggagatgggtcccctgtggccctcctggcctcggtgcaggggaggggcacagtcagaccggtcccagctccatgtctgccttccagagcccgaggagggcaggtcttcaggccataaggtgccggcctctgaatcaaaccagctttcaaggcctggctcttccagttattatcactgtgaccacaggtggtgactcagttagcctagtggtctcttgcccaaggtggtggtcttttctgagaggttattacactgagataatgtagatgaagagcttagcaatgtacttgataatgctaagtgtattataaatgctagtcttgctagcctgaggagtgaaatgactgtgaacagctgtcagcaatagtgttctgttggggtaggggcaggcagcagttgccccatcctgaaatccatcgtctgccttggtctggctcctgatgcctggggacaggtgtactcagggtcctggccatcctcattgatgtcttctgagtgctaccctctcccactacaccaaaaccagcttggctaagtgctaactgattataatttttcaaatgcacagcttgctacttagtgctaattctgtgctttacaataacaattgtgcataagtcaaatgcagattaatgtataaaaccagtagagctaaattcccttcatctgttaattaggtggccttgttattcacgcctaactagtcaggaagaaacttgcagaaggaaaccccaacccacccagggttatgggcagcaggggattccgtagccccaagtctgactgcaagttacgtgcattgatgtgcatgcaaatccccagggaatttgttaaaatgcaggttccagtgctgtgggtcccaggcaggcctggcaccacattcctaggagtcagtctgtgatttggcttgggcagggttagggctgcagatggggcaagagtcactgggcctgcttatgagagaggggttagccccagggacacaagatgttctacagataggttggcagggccggagcagagagggcggctgggggatgaaagggtctgtggtcctggggtgggcaggaggtgaagttcttgatgcgggtctgtctctgcctgaagccaactgactacaaatccccaggacacctggaggcttaaaacaggcgccatctagatagctgtagccttatttatttattttgagaccggatctcactctgattgcccaggctggactgcagtggtgtgatctcgactcactgcagccttgacctccccaggctcaggtgatttttccacctcagcctcccaagtagctgggactacaggtgagcgccaccacatccagctaattttttttgtggagacaagattttgccatgttgcccagctggtcttgaactcctgggctcaagtgatcctcctgcctcggcctcccacagtgctgggattacagacatgaaccacagcacccagcccgtgtggccttatttagtggattttaatgcctctgttttacagagaagggcctgtggctcggaaggttaataactaacaagtctaaagctacgcagttagtaggtcacaaacctatcatatgaatctaagtccatctgactctgaaagccacaggcttatccaggctgcccccccatcccctgccctcccaaaaacatggtttaccatctcagccacatgtgtcctataacccagctgagagtcacaaacctctagaccaagagcccttcaagggtagggtgacacccaatgtttaaatctcaaaatcagcccaggatgagtttggatgccttgaggaggagaatggagagggactgaaggtgcatttacctgtagaatctagggtaggggttgacactgtggcccacacacccattctggccatagcctgtctttgcatgtgacatctcattggaacacagctttgtccacaccctgtccagctgctttcacactgcagcagcagagttaagcagctgggacagaccacatggtccttagagccttaactactcactctctagtccttctcagaaagtttgcccagccctgtggtagggtgccctcagaccgtggggtttcatcatgcattttcacggatttaagtaaaagtatctttagccaaagaacttcattcggagctccagcccacaaacaggcagcccaccaacttgaggaagggagatttaaacctccacgaagggtgctgggtgtgaaaactccacatagggatataggactgtgtgctgctcatgtgggctccagaacattccccctgccaaagaatcagtgctgcttatagacatcagttgacagcagcttctggcaaattagctgtttttctgtgaacttttccggggtttttttgttgttgttgttatttattttatctttatagaaatggggtctcaccatgttgcccaggctggtcttaaactcttggggttggctgagcacagtggctcatgcctgtaatcccagcacttggggaggccaagacaggcgggtcacttgatgtcaggagttcgagaccagcctggccaacatggtgaaaccctgtctctactaaaattacataacatagccaggcatgatggcatatgcctatagtcccagctacttgggaggctgaggcaggaaggagaattggcttgaacttggaaaacagagactgcagtgagccgaaatcacgccacttcactccagcctgggggacagagcaagaccccgtctcaaataaataataaatgaactaactcctgggcttaagcagtcctcctgcctcagcctcacaaagtgctgagattacaggcgtgagccactgtggccggccaggatttagacgttataccttgtaccaagtttttaaaaacgaacctcctttcaagtgtttaagttataggaattgtccacacaatttttggtggtgactttttttcttttctttttcttttttttttttctttttaaagacagtctcactctgtcgcccaggctgaaagtacacagtggcgtgatctcggctcactacaacgtccacctcacctccccagttcaagcaattcttgcgcctcagcctcccaagtagttgggactacaggcttgcatcaccacacccggctaatgtttgtgtttttagtagagacagggattcaccatgttggccaggctggtctcaaactcctaacctcaagtgatccacctgcctgggcttcccaaagtgtgctgggattacaggcgtgagccaccgcgcccagcctacagtggtcattttcagaacatttgctttggctgatgtgggtaacgaattaaatctcagacatttaggcaattttcaaaattacatcttattctgttaacgtttcagctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccaggtaagcgggcccctctgccatgccagccctggacaccccgcaggcatgaggactctgctttgagccacctctgaggtttcaaacgtggaggtttcgctcttgtctgcagggtctggaactccttttccagcccgttctccccaccccacaggttttctgcaggcggcctgtggtctctctttgccggagggacagggctggggctcccgcacacctggcaggtcctggggctgggcagagctccacttggttttgccagaacagttgctgccaccctttgtccctcctggcaggcaatcaccagtctccctccagtgcctgttccactgtgggtttggcctgggccagcacatggtgctccgttgaggccaagtcgtgtttgttcgggcagctccagctgggggctacagagggacagcatccctgtctgttcaccagagggagctgttgaccttggtgggtggattttgcctttctttccattactgcacccctgcacttcatcctcctagagtgtgacacactcagccctagaggggcagtgggagttcccagcccaaggggaacctggggccagttcagccttctgagtgctttagaaggggccctgcacttcggtgagtagatctcagatttggaaggatcttagatgtcgagtttgaagctttggtttaacagagattgggctgcagagaagtgagctctaccccccaccccagaccccacagctcctggtgggaagcagagctgagattggggtgaaggggcctttccaggtcctactggcccatagtgtcaggaccctggctgtttgggctgtgggctctcatgggacctggagcagggggtgtgacaggacaggaatcccgggggcctgcaccagaacatggcagtaccttggagagaaccaccctgaatctttctggtccccatgtcctctgtttccttcctcagtttttagtcctgtccctctttctcaaggtctgtgtgtccatcccatctgtttctctgccaacttgaagctcagggcaactctcctcttccctggactcatagtggctgctgcgacccctccccccagcttcacttccttccatccagagataagatcctgggcccaaagaggggtcctgatgagcttggggggccattgatcccgagaatcggacacagctctgtgtgtgagtgcatattccaggaaaggggtctgtagctttcagtagacgcttcaagatctatgcagtcttgtctgttgggcacattgctgctgctcccagttcttctggcgtttccctgctgagtgaagtgcacgcagcgccatgtcatggttaaagactccacggcctcctgccacctgggagatagttggattatctgtgccttagcatggcctcccaggccctccttacccaccttttcagcacatcccaccctccagtgctgtcacgccagatcctgtttgtgcctcgtgccctgcctcagtctctgctgcctccctgagtgccttctgctcccttctcaccagcggggccctcttgtccttcagtgccacacaaggacccctccctgagtatcccatccccacggaaacccttgggctcacaggcccacccaccacttgctggctgcgcagccttgggcaggtggctgaccttgctctgcccacccctggagggcgatgtctgtgagggactccagtcgttgtgaagtgtgagccctcaggacctcctgcgtgaagaccgcacaagctgaaggtggaaagttccacacagcccagcccgtgataacccttcctgtctgccaagagccaggcctaccttgagtggtctctttgtggggttagtgagcctacacccccaaggaaagggccaaggtgtttgccttttcccaagaagccacctacggttcactggagggaaaggagccccaaaagacggtagggaatgactgggctgtgcttgagtggggtcgagccctggggtgttttgcctcctaagactgatccccttcaaagtcgccactcccccaaagtccctcaaacattgtactcaagaacaatggtggggagatggtgggccccctcacctgttccctctttgaagcagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctggtgagggacccccaccaagacctgcgggggtggggggtggggggactcgttctttcaggcaaggtggagtgttgaggggaggtgtggctgtatgtacatggctcactcagaaatcccagcctggggcccttgcacgttggtggctcaggtatattttttaattgatggcttccctttttagcaggatgggagcttagattcaggtgcagaaccctcttagagttgacgtagctgagacttggaggagttcagaggctgcagagctgggactagaccagccctggccccaggcaggcgtggccgtgccacctgggcacaggtcttaagggcctgttgggcttgcagctgtggcccccgtgacaagtggggcttttccagaaacatgtttccctccaattgaggtaaatccagggtttgagcattgtcagaatattagcgacaggacctgaagcctgacctcagagtctgagctgggacttgctctgtgtggccgcctggcttatggcccttggtccctttcagcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggtgagcccgtggctggggctggggtctcccatcagctgctgtgctcctcgtgcggaatccagacaggccaggggcgtctggtgctctggccacgggcacgacacccccttaagtcagccagcagtcctctctcacccccgagggactctgacttctcgtccagagaaatgtcgggtgtgaccccaaactccaaggcaccagaatagcttagaagaaggatttgcaagtgttactattttcttcttggcagttctcccagtgtttactttgaaagcaaaagcaagattcggagtccatctcagggcttacctagcatcactcagcggccttagcacatttccagcgctgatgtgctaaaattccagactagggccggggtgtgcagagggggcatctgaagatggagcccagacagggcaaagtctgggtgtgctgaacaccccttgtggcttcagagcctgactcagagcctcttcaccctcggccaccttgctgtacagctttaaacagagcctgttgatcttggctgagcacatggccccaggcccccagcgctggccacattttgtgggcaggccatgctgttccgatgtctgtgggttgtcctggcacctcccccccatggctcccgggccctcagtgccagtgcttacgggaactcctctgcctgggcagtgactcttgtgatggcctctctgacaggacccgatggcccattaggtctgggctggagccacctgcaacctctctggcctttgcaaggacagagagtagagagtagcagctactactttctacagtagtgggctcttcctgtgtgactggcccgtctggtggccacaccaacctcactgcctggtccagagagagcccccagaatctttggcctttgcagcactgacgccccctcccgccttgctttccttggcaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgtt

SEQ ID NO: 37023 - DNA, 129836 bp, Homo sapiens
gtcggctgacgtggagggccggaggtggcggcggcggcggcggcggctgctgctgctgctgcccgcgtccgaggctcgcgggcggcgggcccgggtgagtgcacacccggcgcgctgccgggctcccggatgtgtcaccttgtcccgctgcagccgagatgccgggggagcggggccttccacaccccctccgtgggtgtgtggtgagtgtgggtgtgtgcgcgtctcctcgcgtccctcgctgaggtgcctactgtgtctgcatgggttgggtcccgcgcgatgagggggtgtggccgccattgcctaccccagtgggtttgcccccttggtctggtgccccttcgcgagcgaggccctgggatgccggtgcgagggtgtgagtagtccctttgtgcgcaaccccccgctgcccgtgcctcggccggtgcgtggctgacacctccgctgggtggaggcgctcgcgtgtcgcctcgtcgccccttttgtgtcggtgtccgcgctccctggcggctgcgtgggcgctctcggccttgcaggtggcccccctttgtgttactgcccctgtctgtgggctgcgcgtcccctagcgcgcgtggccgcgccttctgcaattgcgacccccgcctagagccttgctcgcgcaagtgtgcgtccttgcgtgtctccgagtgacgcagagtgtctgcgcatgggtcctgttgagtgcgtgatctcttgtgtgcggatttaattctgtcgagtgggtatctcttgtgtgcaggtttcgttggtgagcgtgaacgttcgtgcacaccccttgctgtgtgtgcgtgtcacgactctgttgccacctgttttcgtgtgaactggcagtccagtccagggcctgtccccacggaacggacccaggaggggggtaacctcgccgctcccctcgcccccgcgcctctttctgagcattctctcccacagacgctaatgggaaggggggtggacaggatcgagtctggccagctgctccgcagtgttgacgctgccagtgtggcctcttcagccagcctgttcaggagacagaatagggggatcaaagataaaaaatgaagccgagacgtaggtgaatttgggctggtaccagtgcgccgtgccttttccagtggcgccctggacgccaaaaccccctcagttgcagagacctttcaaaatatatgcactctcctactgggcgatgcggtccttaggcgttcttgatgatatttaatggtttatagagtattttatggcattcacctaaatctctttccattttgcccaagatcctggcgagggaaacaaggtagaaattttacagattttactcctccggagagagccttttccttataactacgactctagttaggacattttttgttgcaagaaatttgcgatttatcctaaggaaaatgggatatagtataaggatacctagggtaagaaacttcaaaccccttagagacccagctactgctccgattgctcaaggtttcgtgctctgcgctcaagggctgcgttttggtgtctttgttctgcccaattttcttattgtctaattttcctttttttcttttaatttttggaatatttcagatatcaaatacagagggggagctaaccaatccatgattcagattttacagacgtgattatttaatcttttgccaaatttacttcagatactctttttttttaaagaaataaaattgctctcagttccttcccctccttttctagagatagccactgcgttgaggtttgtgtatatctttactttgcatattttatactttgatcaaggtgaatccatacacaatatatattattgtttgtttttaaactttaatggcattaaaatatacatgcctttttgcaacttgctttttttttttttgctcagcatcatattttgaggtttatatatgaacaaattgaatgattgtgttatctttggttcattcattttaattgctggtatagaattgcgttgtatgaatataccatatttatttatacattcccctgttgatagactttgaacttgtttcagtttttgactcttaaaaacagtcctgcaataaatatctttgtacttgtctgcttgtgcacacatttggaagtttctgtaggaagtacacctaagtagtagatttgccggattgtaggctatgtgcgtcttcaatttaaccaagtatcacagaagctctcgaagtggttgtaccaattttcactgtcactggtgttgagtgagaacacaatttcctcacaaccctgctaacactttatgttatgagactttacatttttgccatctctttactgaccagcttccttatgacttttggttgctgctaaatttgcttgtagccaccttggcttctcttgtagccctgtgtcagcctatggatttatctcttatagctaattggcttagtctttatctcctttggttctcataagattaattccaatgaacatttgttgtatacctaatgtatgtcagatcctatgattgatgtatagatagaatttccatgatatgttaaatatgtacctctttagtggcaggtgaggtgatttaattaaaagtattttttttcttatgatgaatgtttaaaaaatttttcttttcctctccattttattgtagtatttgataaattcaaaatatatgtaaaacatatgcaagctgtatagcagaacaataaaatgaacacctatgaattcaccactcaatccaataatcaaaatgaccagtattgaatgtgcttacttccagaggtgactaccatcctgaattgtgtatattatgccttgtttttaaaaataattttatcagatatgtatacatccctcaaaaatgtattgtatggtttctgttgtttttgagtggaaaaaatcatattgggtatagtttcctgggacttgcttatttcacttgatgttatgtttctgagttactaatattgggtatagatgtaagtcattaattttcactgctgtgtaatattccaagtgtgaatataacacagtgtatgcattcttctgttaatgggcattttggttgtttctaggttttgctgttatgaagttatatactttttggttcacagttgtaagaatttttctaattttcacactggggtatatgagccccagaggagtaatgaagatttgctaaggaatgtgtgggtacaaatgatgttaatgaatcagtttctagatcattacattccataggtactctttcctaaaaatggtaatgcctgaggcctcctgctagtgctactttcttaccttgtgtttctaacattgcactttacataagacaggcaaaccacaggttcttgtggaatcttactatggcattgcccaaagggggaaaactcccttggggaaaacaaagggattttttttttttttttttttttttttgagtgaagttttgctctttttgcccaggctggagtgcaatggcacgatctcggctcactgcaacctctgcctcccaagttcaagtgattctcttgcctcagcctctgagtagctgggattacaggcgcgcaccaccacacccggctaattttgtatttttagtagagacgggatttcaccatgttggctaggcacgtcttgaactcctgacctcaggtgatctgcccgactcggcctcccaaagtgctgggattacaggccaccgcgcctggcctacaaagggataatttaaaataccactatagtgttagggaaagcctcttttaatcctggcacttccccatccatttccttaagagagatatttccaataaagttgcttttttttttatgttatcagggtatattttttggccaaccatatgctggtaataattatacatttaaaagaatgagataatcagttttactttaaaatgttactgtgatgttctagaaattcaccctttgcaattatttaatcttatggtgatattttttaaatgtcatcttaatgggtaaagggtatgcaattttaaaaagcacttttggtggtttgcgagcaaaaaaaaaaggttgaaataccaccatgttaatttgttcagcagcaaaagaaaaagaaaagagaaagaaatactgccgtatcactatagtaagctgtttgctagaaatgggattgctagatcaaggggtatgaatgatcagctttacaaaataatgtcagattactttctgaaggggttgtatcagtttgtactttggccagcagttttgtctgtttatatactttgatcaacagtgtgtaagagttacagttgatctacaacctctccaacacttgttattgtcagacttaatatttgccaatggaatgggtatgaaatgatgcatcattgtggttttaatttgcattttttgttattaatgagattgagcatcttttgtatgtttatgaactgtctttgtttcctttttatgaaatatctagtcatatattttaccctttgttctgatgagttgtcttttaaaactggtaacatcgattatgtgcgttgtaaatatctttttctggtttgtggcctgtctttctactgtttatggtgtattttggtgaacagaagttcttaattttaacataatctgattggaacctttcttgccctgggcttataaagacattcctctgtttctttttagaggttttaaaatgatgtcttccacatttaagttcataatttatctggaattgatttttgtgtatgttctgagatagtgatccacattgattttttttttctcctgtgtggttctaattatccctgtaccatgtattgaattggccctctgttcaccagtggtctgctgtgccatctcttttacatgtttagttactacctgcatgggtctgtttttggcttgcctttctgtgtcacttgtcaccttgtctgtctctgtgttcataccacactgtcttaatcattaatactatagttttacctgaaatctcggtatctggggaggacttgaatctcacctatttttggtcatttgttcttaagaattagcttgttacatgacatgaaaaaccctgtaggtattaattagaattaattgaatcagtttgggggagaatcgaaatctttaagattttgatcctttttatttttaagaatatggtatgtatctctatttatgtaaagttttagtgtagttttgtaatattctccatagaggtcttccactttttcatatgttaattctgatgttattgtttttgttgctattataaatggtggtgttcttaaagattctatcttaacttatttattgttagtaaatattttaacttattgttaaatagaaatttaatgaatttttaaaaatattgaccctttagtcatccacttgataaacttactacttctaatattttttctgaaattcctttgtgttttctgtgtggataattatatcatttgcaaatagtgacagttttagttcttctagttatttttgcttttaatttattcatttttttggtcttaaatgtgctggcatactttatacttacgttcaatggaagtgattagggttgttcattagaagcgattatagtgggcatagagttcttgttctcaattttaaagagaatatttctcagctgagaataacatttgctgtgaatttttgtagatacctttgattaagttagggaagtcttttcagttgtcacatgcttttctgcatttgttgagaatatcttgtgtcttttcttctttaatctgttaaatgtaatgaattccgttttatagatttaaaactgttcattttcttttatattctttcttgagataaacccaaattggtctttatagattatatttttatgaactactagattgagtttgctcatattttatttagatttttgtgtctgtttatggctagaatcacttctcatttttctttattggctgtcttatctgacttgggtattaaagttacactgactttataccatgagttagagaatagttcctctttttctgttccctgggagagtttggattggagtgatttgtttcttaaaagcttggtggaacttaactataaggtcatttggatctaatgttttcttcttggaggtttagtagtaattagcagttgaacagtcataggactgttcaggtattctatttcttttagtcagttttggtaagttttagaaatttgtcctttcatcaagtttatggtatggttttttttttttttttttttttttttttttttttaagatagagtctccctctgttgcccaggctggagtagtgcagtggtgccatctcattgcaacctctgcctcctgagttcaagcgattctcctgcctcagcctcctgagtagctgggattacagccgtgcgccaccatgcttggctgatttttttgtatttttagtagagacggagtttcaccatgttggccaggctcttcacaaactcctgacctcaagtggtctgcccacctcggcctcccaaagtgctaggattacaggtgtgagccaccgctcgtggtatggcattaattctctttttaatctctgttttatttgtatatgtgttccccttttctcatgttgaatattatttatgtctgacttctctttcttgatcagtcttagtaaaagtttgtccatttttaaaatcttggcaaaggattaacttttggcctaatttgttctattatttgttttttatttcattgatcttttttctcttttattatttcattttactttcagtttattattttactatttttttcacttaaattacacacttaatattaattttcaaccattccgatttcctagtataagcatgcaagactgtaaacttcctcaaagttcatttttgcttatctaacatagtttaatttatagtgttttcattaactttcaaatctaagtatttttacaatttctattttgattttttctttgacttatgagttacttagacatttttaaattttcaaatgtgtctatattgttttcctttaattatcgatttcttacttgtgttgccagagaatattttatctttttagcatttttttttttttgcccttgctttatggccttgtacatagtgaattattagaactgttctgtgtacacttgtgaagagtatatattctgtaattgttaagtgtctattaggtaaagcttgttatttgtgttgttctgatagtctttatccttattaattttggtttatcctatcattaactgagagaagtgtgttgcaatattccaccattactagtttctaacagatttcctgtagttctaacaatttttgttcttctgtattttgagacttttattagctacatgcaagcttaacatttttttcctagtggctcgaacctttactatattgtgatcttctctaagtttgcttctttgtcttagaggctttttgtctgatcccgtctttcttttggtgctaatttacctggaatattcttttctttcattttactttgattttttttagtgtccttacattttaagtgtctcttataagggacatactactggatttttcttttaatctcaccagacaacttctgtcttttaattggttatgttccaggtgtcttggttggtgtttgactcagttttagatattaaaaaaaatctaaaagtatttttattttacctttgttcttgacagatcattttgatggatgtacaattgtaggttggtgtttcttttctgtcagtagggtaggaatactattctgctgttgcttatacaaagtgtgctgccagttttatttatgcctttttttttttttttttttttttttttgaggtggagtcttgctgtgttgttaggctggagtgcagtggcgccatcttggctcattgcaacctccgcctcctggattcaagcgattctcctgcctcagactcccaagtagctgggactacaggcacctgccaccatgcctggccaatttttgtatttttagtagagatggggtttcaccatgttggccaggatggtcttgatctcttgacctcgtgatctgtccgcctcagcctcccaaagtgctgggattacaggcgtgagccactgcacccagcctatttatgcgttttttgaagaaaatatcatttttcttttagttacattggattttctgtcttttgtgttacatcatttcacttctaagtctagatagagattatatttatcctattttggatgcatgtgtttcatgattctgcattttgtctttcatgagatctagaagtttctgagccctgtattctttaaatattatgtctcattagtctcttctctcctgctggaactttaactggatatatatatacactaaactgtttccagatcacttattctttatctttcatattttttatctctttgtttctctttaccagaatttacagtgctggataatttcataaggcatatattttagttcaccaattttctcttcaactgtgcctaatatcctctgtaacccatcctgtctcttttttttcttttaacaattgcatttttaattactttttttttttttttttaagatggagtctctctctgtcgcccaggctggagtgcagaggcgcgatctcagctcactgcaagctccgcctcccgggttcacgccattctcctgcctcagcctcccgagtagctgggactacaggcgcccgccaccacgcccggctaatttttttgtatttttagtagagacggggtttcaccgtgttacccaggatggtctcgatctcctgacctcgtcatctgctcacgttggcctcccagagtgctgggattacaggcatgagccaccatgcccggccgcatttttaatttctaaaagttctgcctggttcttttttgatatgtccagtcattcttcatgttctcatgttatatgctgatttttgtgactctatagctattctgtagactatatcagacattcccaatgtctgatatccttgaggagggggatgtctaaatttattgcttttttgtttttttttctgttgtctctcctcaatgtagctgtcacctcatgtgtttggtgatcattgattatgaacttctgtttgatctttgtggtgatcttgagagtctaatttgaggatgcttgctttctgaaagcatttctatcagctttgtctgggagccagaaagtttagctggcatcacttttgagttcctacattttgcttctggcccagggctcagtgtcctgatcctattactgctcttggcaccactacttgtagcactaaactgtagccaggtttaatttctagctcaaggtttgttgcttttgcgtggagagggtgccttcacatgttcccctatttctatgagctcagcaaaaacatccaaaaagtgtttttttttttaatctaggatatacctttttcctcccaacagtacattcccccagagtgtatagttgaccataactgatgggatcagaagctctttattttaatatttaattttagtagtatatttttgtttgattgtattataaaaaattttatggtaccaagcaagctttcttggtgataccaacatttccattaaaactagtttacatctaagttaagatttgagttatcctaaagaaaagtattaagtaaatagcagtacagatggcaaatggattgcacaatatatcctctggatccatagtgaccctgcagagataaacctgtgatggtcaaacaatgtgaaaactgctgtcagagacatgggcagggtgctcttgtttacagagaagaggtgcaaaaatcaacttgatggtagtgggaagatcaggaaatgcttcctgaaattgagtattaagaactaatagacattaggtggttgcagaataagttttgtttaggaaggacaagcagttgggtatgactggcttctaggttgtgtgttgtggagtgactggggataaaagcaggagcaagatcacaaaaggtcttctatgcttatattagggaagttggactttattctcaagctgaagggaagctgttgcatggttttaagcagtaaagtgatatgatcagagttttagaggatgccaagattgaaggcaagtctgaccagttaggagactgcttgttaaattagttcagaggagaaacagtgaaggcagtggcactgggcatgaagaagtatatgtgtgctaattttagatttcttagggaagcagaaatgacaagagttagtggtccattggacagaaatattgaaggagactggggagtctaggttgactcccagggtttaggtttgggcagtaaaatgacatgtagaacaattaactgataaacagcatacagaaagaggaaagaacttcatttcatatgtttgtttttgaggaaaagatgtttgtttttgaacttcctgattcagaggggcttgtgggacatcttggttaagatcctgtagtagttctagtagggtctagaagtcaagagatacaaccccgcctggaaggatttgggagtcttcagcatttggaattttggaagccattgtttactgcagtgcatatgagataatttaaactggtacatagataaacacttgaaaaaattttaatagataggaatttaatgtgtatgagaaacataacttgcacatctaacctttgataatcatggacattatcacttaggccaagtgagctcaataaaagggaaatattaactaaaaatatatgtgatacatggaaatggcaaaaatcacggtgaagctatgcaaacgatgcaagttcagaaagtgctgtgttaagtcatgggtgtggtggataaattcacccaaggagagagtaagagtgagaagaaaagagagttgacattgggtggcggggaatggagaagaagaacccatgaaggaaactgaggaagagcagccagacgaataggaggaaaaccaggagaagatggtctttggagtccaaatgaagagttctgaggaggaagtggtccacagcgtcaagtaagttgtaagctgaaaagtgctctttggatttagcaattaaggtagactatttagctggaagcatccaaacagtggattttaaaaatactcatctaacattaatgttaatgatagctggtatttatagcatttcccatatacctggtactcttctaagctctttacatgtattaacagattgatcaggtaggtagtatcgttatccccatttgatatgcgaggaaacacagaggaagcacagagaggttaagtaacttgcccaagatcacacacccaaggaaacaagagagccaggactcaagcccagagtcttggctgcagagtccctgttcttaaccactttgtcacattgcctctctagttaaaaacaaaatacaaggccgggtgcggtggctcacgcctgtaatcccagcactttgggaggccgaggcgggcggatcacaaggtcaggagttcaagaccagcctggccaatatggtgaaatcctgtctctactaaaaatacaaaaattagctgggcgtggtggtgggcacctgtagtcccagctacttgggaggctgaggcaggagaatcgcttgaacccgggaagtggaggttgcagtgagccgagatcgtgccagtgcactccagcctgggcgacagagtgagactgtgtctcaaacaaacaaacaaacaaaccaaaacaaaatagaaaataaaatataccccagtgtcgtaattacagtacaattggtgctgtgtgtgttatcagtgagattcgctaggcttgaatgaccagtatcagtctgccaggtatgagcacattaattgtattgtaattgatgccatgatgtgtgggctgtgacagttcttggctctttctgtattttatgccaaaaaaatttgtaagacaagtgagattagcatatacctcatattatgtgctatagtttgggtgctccagtatcttatgttttctggtcattgttcacttttagagttaaattttttaaactctagaaatattcatgcagaataggtcaggttctagacattatagataaccagtcttttgtggaaggtcattaatgatcctaatgaaagcagtttcccttgaatggtcgaagtggaaaccaaattgttaggaaactgacagtgaatgagaatggaggattcagatgggtgaaaaatgaagagttcttgatgaagttgaagaatggctgtggtaggaaatcaggaagacatgagccgtaatgactcttggctatggtcagagaggagctaataaagatttaagaactggtttcgacccaggtagtgatctgaggtgtccccctggggtgggagagcctagtgaggtaggcagtgaagatcatgttagttgaggaggttgttaaactacaaggctagggtattgtgtgcatggacctcgatgtggctgggatgatgatagaatttggaggaaagagaaaaacactgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaacccttagtctgaaactttaccaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtggtaagtaggtttgctaatttttcatttttgacattgtgtattgaaggttttctggtttagggctatctgagtaaagatgtttttgtggtacgtgcgttttgacagggaggtacacatgctgttgaaaagttgatttgagaagggaaagtaagcactggctcaaaaataagattgtggagtgccagagaatgagtggtggcaaaaggtggttttctgacagggcataagaaaagctcttggggagagccatagaagcaaactcaggtaatactgtaaaacgggtctcaaattaagactctttggctgaagatgtgtttgaagcatataaataaatgcccactgaaagttctttggttagttctgataatccttagattaaaaatcaagaacattttactagacacaaatcaaaataattttcttctttttagggtgtgcaatataaagattatatccaaagtgagaggaatttgggtgagtacgttggtatttttaatgttaatttatggaaagactacaaagggaggtccatccatcctgtcatagcaatacaacagatttatatgccttttaaaaatgtattcttactagtttttcactagaaatcagaacttttctttgttaaaatagagtttttgccagcacttaaatattcttaacatttaacaggctagaatacttcattcattcatttcttccctctccatatccatttttgcctttttactattaagtgttgattcattaaaaaaatgaggcacaaacattaattttaaactttttttttaattaagaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaagtaagttactatatgttgctcattttgtgtggacagtgataaacatgttacccaataccaagaaatgcaagttcaatggaaggcttatgtcttattcttgtatgctgctcaacgtttgtgtaatagggtggaaaaaacaaatacttgagatttggatatgaatgaataattgtaacataatcagtgaaattctgaatagtactagatggtagactggaagctgagtcaggaggaattaacatgggtgtttataagtatcagtgttatagtgcagaagagaggaaaaagatacagtattttgttcatttaataaatagcttagttattgttacctagagtgaagaaaaagagaacttattttttaatggtttgagatatatagctaagcataaagttcaatgaatttgtatatatgagaatctaatcttttaaaaaataaatttgtctttaagcaattcacgtgcttctgagataaatttgaagaaactacaacatcttgagttgatggaagatattgtggatttggcaaagaaagttgctgtaagtggtagaatgtaggttcccccgagcccttggtttaaataatataagcatttatatggtgttaggctcaaatgactaatttatagcaattaacaggtaatggttttagttttggttaacctgagataaatctgctgtccatcagtgcgtgctcagtatttgagagatcagggagatggctgatgtcatggttctacgctggggaccaggactgcatcttgtcattaaaggatagaaattggaacttgtcacagaaagtggggtatgggttcatgaaaacctttgccacaggttctgaaagtgatgtgctctatctgttgatataaaatcacatcaccatcaacaaatattttgtctttgggtaggtagactttatcagggcagatttgaggaggtgtccttcattatgctattgagataagttgagagtttttgtggtttttaatttttttttgaaagctattggatagctttttaaatttcagttggttatggagtcaagtgttgttcttggtactattaaatttagaaagggcattctgatgtttattttctgcagtagttatttgcagtaacatacaaaccagtgtacctttataaaaaaaattaagtgcaatgaactttattattattattatttttgagatggagtcaccctctgtcgcccatgctggagtgcagtgacgagatcttggctcactgccatcttcgcctcccggattcaagcgattctcctgcctcagcctcccgagtagctgggactgtaggcgcctgccaccatgcccagttaacttttgtatttttagtagaaacggggtttcaccatgttggccaggctggtctcgaactcctgacctcagatgatccacccgcctcggcctctcaaagtgctgggattaccagtgtgagcctgtagaaacctcacctctactaaaaatacaaaaattagccgggtggtagtggcacgtgcctgtaatcccaggtagttgggaggctgaggcaggagaattgcttgagcctgggacgtggaggttgtggtgagctgagactgcgccactgcactccagcctgggtgacagagtgagaccctgtctcaaaaaaaaaaaaaattcacatgtctaaagattatactaagttattttactgctagaaccctattggagactattttggaattcttgtcttaagatcttaaggggtaacttggtcatgtaaatgcttgtcggaagtgtactactgagtacatatagtagtgttcctaaaatgtaggccatttttccgttagaaaattcaagtagaattgactgaataaggaaaaaatatgtcctttttttatttttcagaatgattcattccttattggaggcttattgagaattggttgtaaaatagaaaatgtaagtgttaaacactgaaactggcacagccactgtggatgagtggcagtcatctcactgctcatttccccttgcattgggtccatacactcaatgttctatatgtggtatttggtagtattgacttctatattttccttaaggagactcctcattttgggggtttggatcattttctctcttttttttttttttacccatgtacatagtgtaattttgagcctattttacaagttgattctttttctcttttagattatttacctggcttatgtttccccaaatgaaattattaggcctctggtatgaatattttttgttatataattactaggtaatctccagattcaatgttaaaccaatttttaatgatactgatgccataaacatctatgtttaccttaagcccattgttaactttaatttttgaagttactttagacattagaagtacaaataacatttctgtgaattcttgatccttcatggagatcactgcactgagtgcccatttgcccagccacatcttcctcttgttctttatctccttattcttctgtttgccacagaccacgtaaaatatgtagttcctttggagaactttaatctataaatttaaccttggggtaaggatggaagtctttgtgtagatgagatctgagaaccctcatccaccttgttatattgcacttgcctgctaccccaggcagtctggccaggttgtagacctcaaattgcaggtctgtagtaattgcagaagcatcttgagctctgagggtggcctgaagtcacctgaagaggtaacatatatgagtccatagtatctgttaatttatatgtcagagtctgtctactctaagttacatgccagagtagcaaaaaataagtggttgtaccagttttgtagtaaggatctgaaatacttgcataagatgaatttataatgccacatgcaaatttagaattaataaccaaagccccattcttcatttctcttttgaaacagaaaatcttggcaatggaagaagctctgaattggataaaatatgcaggcgatgtaacaattctaactaaattaggatcaattgacaattgttggcctatgttaagtattttctttactgaatgtaagtataaatgctttaaattgttacttgactcagtttttaaaggtgtttgggaaaatgagatatgtagttaagtgatttctgatttatcttagaatttaaaaaaagtttttattttgttatatatggctgaaaaagagaatttcttttttttattatttatttatttatttatttatttattttgaggcagattcttgctctgttgcccaggctggagtgcagtggtgcagtctctgctcactgcaagctccgcctcccgggttcacaccattctcctgcctcagcctcccgagtagttgagactatgggcgcctgctaccacgcctggctaatttattgtatttttagtagagacagggtttcaccgtgttcaccaggttgatctcgatctcctgacctcgtggtctgcctgccttggcctcccaaagtgctgggattacaggcgtgggccaccgtgcctggccgaaaaagagaatttcaaactggtagttttattctatattttctgtcttaattatttttatgacattgtactttaaaaattttcactgaatggatattgtaagttgttatatgtaatactcaaagagaccacaactgggtagtctcctttgtaagaaaaagtcactgaagctaagcttatgatttttattttcttcatgaatctgttgttcttttatgtatgaggtaactgccttacatatttcttttactttgtgaaatatttttctttaaagcatttgaatattagcagtgtttttatagtatagttataggaatcttgaaacaggaaaggtttggcttttcagtagatgatgaccaataatttaccatctctgctgagataaaggcaaattttgcactattgacttaagtgctagaaaggaattaaatgaagacacatctttctcataggtttattagacactggggtgtattacactgatagaggttgttctcttcattgttttggaggcccttaattataagctagattttatggtggaagtagagaagcagtatcttgtactaggtacacctctttaggcttatagctgattttttacattctattttctttataatagctctgcaaggtggctgttactatctttgttttagcagtgagcacactgactttgagaggttaagtgttgtttctgcagtatagtaagtagtaggtagtagtaggtaagactagataagtcagatctctctgatctcaaagcccaggttttattccatgtaatcttactctgtcccttagaatttctttatttggtgactttcttaggtcctttattgaatcttaaattttaggtgctcttttcactttagaaatgaatatgtttggctagaggcttaactatagttttgttgcaataaatttttttttgccactttaaaatatcctttttatataatagcttacaatgtagaaaatgaggcccgataaactttagttacttactgcatcttaattagtttattaaatttttataataatagtgtttcaaataacttctcattgtaacattttactcatgagagtcaaaatactaaataaaaacttttgaaagtatttatttaaaatatgttgagcatcaaaaatccaaaatctgaaataccccaaaatttgaaaccttttgagcttcgctatgacattcaaaggaaatgctcgctgggcgcggtggctcacacctgtaatctcaacactttgggaggccgaggcgggtggatcacgaggtcaggagatcgagaccatcctggctaacatggtgaaaccccgtctctactaaaattacaaaaaaaattagccaggtgtggtggcacatgcctgtaatcccagctactcgggaggctgaggcaggagaatcgcttgaacccgggaggcggagtttgcggtgagccaagatcatgccattgcactccagtctgggcaacaagagtgaaactccatctcaaaaaaaaaaaaaaaaaaaaaaaggaaatgctcattggagcattttgaatttttggatttgggatactcacccagtataatgcaaatattccaaaatccaaaattatccaaaatccaaaacacttctgatcccaagcattttgaataagagatactcaatctttatattaaatagattgtagaaagtagttttgcaggtttttgttttcatgcatttttattgaatattgtgcatggtacaccatacatgcttgacagtgtttattgaattgacttaagtaattatgtggcctatttggaatatgttatgacagagcatttattgtaaatacaattacaactaatataataataaataaaggttttttattgctagaaataaaaggtgagattagattcatagcaagcaataactgatgttttctgcaacattttatcagtttatttttttactgagttatttaatagacataaaaggttacaagaaacatgtgctatttagaaagaataataatataggaccgttgtggactcacctaactcaagaattagaatattatcaataccaatttgtttttttttaaacaaatgttctctcttgctctctcctaaaaataaaatttagacaagtaccacataactaaaattgtaatggaagactgcaatttgcttgaagaacttaaaactcaaagttgtatggattgtatagaggtgagaatgaatattataaatatattttaagatttgcccattagaactttttaacactcagaggaagttaataaaactgctgacaatatacaattcataaaattggatgacatatttgagggaaagaactaatatcttgatcagagttctctaatgatttaaaaaccattaattgaaagtgaaaatttggtttttaaaaactttagtctttaatgagttgaagaaatatgattttctttggtaacagctgagatgtaattcatgtgctacactgttcattcataggaaataggactttaactcaattttataaaaggaatttgggaaaatatttaatgttgtattgaattccctaatgctgttgatatgatgtgatttagtttatttttaaaaaattgagtgttcgaaatgaaaagttttagttttttctctagcacctttcatatatattctcgttaacctaccaactcatgctttgcaattaatctaatcagcattgcctctatgttattgatttatatatgtttttcggcactaaggctttttgaataacatcacatttgctaacctaaagttaaaattctactttgcatctattttttagccttatagataaggtatatttaaaagtgggtctgccaaataccgcacaaaattttagcaattattcataaggtgatggttttgtttactttttaatattctctaacaaagttagtgttgagtcattcaagacaggtttatttaaatatatataccgaggctgcacatgatggctcacacctgtagtcccagtactttgggaggtcgaggtgggaggattgcttgaggtcagaagttcaagaccagctggggtaacatagcaagacctggtctctacaaaaaatttttaaaaattagcttggcatggtggggtgcacttgtagtcctagctacttgggagactgagatgagaggatcccttgggcctgggagatggaggctgcagtgagctgtgattgcaccactgccctccaacctgggtgacagaccctgtctctaaaaatatgtgtgtgtgtgtgtgtgtgtgtgtgtatagtgggtgtgtatatatatatgtaacaaaatattgggtattgtaatctcattttctacataaataatcccctatgttatttctgatatcgaagatagaaatccagatccatttttactaggtattgggttcttgatgatttttggaggtcattgatgggtcttctttcaccttggtttctcaggaaggagaactaatgaaaatgaaaggaaatgaagagttttccaaagaaagatttgatatagctattatctattacaccagagccattgaatataggtaagagcaaatagaacaaaagagatgctttttctatggcacatcaagttagaatggtagtcagaagaaataaaaacaagacggagaattggagagtatcttccaacttgtgcagaatagattttctcatccttgggtgttggaagcattggagatggcctgggtatatgaagctaacgtagtagcataactcaagcaagtcaggcaaaatggtgaattttctgttccattttctttaaaactttccagtacagagttacctcttttgtcttgttctcattttgctatcaaccaagtcctcccaagttattaactggtcaaaaaggattaaaggattagttcttaatagttaagatgccacccattcagggttttttgctttctaagagggaacttttacaggataattgagagaatgcatacatgctctctaccttgtcttctctttgctcagctgctagaattttgtagctttcctccagatgtgcctcataactgtgcgcctattgtctcagtcaggccgcctaatattgtagcagcctttgaagggtgctctgtagccactgctctttttcctcccttgtgcatctccacagggaatgagggaatccggttagtgtaccacctctgagaggctgctgccctattcttttgaggaagaagtggaggaaagggagatacgtttcaccacacagtcagataaaactaaaaaacaaaagttcaaatgaagctattttaatttgcaattactgtaggcttcctttctcagttctttgtcaaaacgacatagtcctgacttattatataagtaatcctatcctctagagttactctgtagtttgctagctctttaatatgtctcgtttgatcccccaacagccctatgagttagagcaactagagttatcttcattttgaatatagggaagtttaggttggttcaaacaaagttacttatgtaagaagtgaaggaacggggacttcgccagttaagactccaggtcctatattctttttgctttgccacacatatgtaaagtttaaaaaaagttttctcatgccttatgttttctacgtgatttttatttgtttcatgtgtaatgtgctttactgactaaacattgtatctttttaagacctgaaaactaccttctttatggtaaccgagctctttgttttcttcgtactggacagtttaggtaagttggttaaaatatctcaaccactgaattattatgctaaatacccatttttgggaaacgtttctgtttttcaggtatacaagaaaatccttgactggttctttggcagaaatacttaagtggttaaaagagtatgcttaggctttatatataataacaacagtgacagcagcagctattctgattgagtgcagacatatgttaagcattattttaagtgctttgcatatgttatttggttctcacagcacccgtaataggtaggtaatgttatagtccacattttacatgaccaaagtgtaccactagtaaatagtgataccaagatttgaacacagattttatctgatgatgtcaaagtctgtgtttgtggcacctatattacctctttatgctctgttaattaatccatatagtataaaagaagcattttcatcttttctctgtttatcctggtataaaaaattaagtaaatatccttcataagtgaaagaaagcaaataaatttaatattatgagagtggagtcataattaattccagttccttatattgaatttgagctgagtttttatttattagctaagaaagattgagaaagatactgcaccatgattttattgttccccagtataaaatttttagaacataaattatatatattgagcattaatattgagcaggtagactattatatttaattttgtcctgccttactgtaagaaaggtgtagggtgaattcaagaatacatccacacagtagaagaatattcaaaataaaacaaaccagaaaacgaagttggaatctgggattctcagaaccaagctacataggcataaggtcctgcataggtattagttataattcatatttgcctctgaccttcagctacccaaaatgaaatgggaaaacttgacaagttacttaattctcattgtccataaagaaacaggacaccaattggtcaggtgaaacagttttcctagtatttagttttgaaagaagttgggctgtaatattaattgagtgatggagtagagaataatctcagcagtatcttatgcatagcaaaaaactccctgaaagcacagttttgggtttcacaaatactttttttgtgaagttttctcatgaaagctgagagtctgctatcagttgtttttcagtgaaagcgcttgtatgggagggtgggagtggggaaggtagtaaactctaagcatgtagctttaaaaataacatttattgtgtttttcttttattgtaaacagaacacattctcatggtagaaaatttggaaaatacaagagtttaaaaagaagaaaataaaaatcaccagtaatccaaccaccttggagaataccgctgtattaacgttatgcagcttttagatggcttaagccgtggataaaccgaggctatctagactagaggaatggatgggcttgacacagtcttccatcaataccactgtcctcaacgggttctgacaagaaatgagctgcacatgtctttaggttattgctactggctaggtccagaattgcatttattttgtgctgtttgaaggtgaatttgtatgctttcaagatcagatgaataggttggcaacttggctagcctcttgtgaaaattgaggtgcctgtctgaaatattgcctggcagaaggttttccactttccacttctgagagctgagaggcacaccagggtgtttctgctctctttcatgagtgttgaatgctagacacacaaggaagatccttctaataccttgctgcaacaggaggtgaatcagagtagaagtacagaagctaggtagtttggtgaggtaaaggccaagagcagcttgtggatctatccttgtacctccttgctgatggtctagcttgtggtttaataccatctacatttcactaaagccaggtcagcagcattgttcctttgtttcttattaggcaatcaccaatatatattggatgcctattttattcacgaagtgttttaccacactggttttgctggtgtttcctacctcctcacacattgtctatatgatttgctcagtaatgtagggataatgttttcagagtccatagtatatataactcctgatcaggtgactagatggtgtgacttaaggaaagaacacgttgccagtaattcagatgtgccattgacacaggaggacccatgcctgagaaagacttttatctgagttactgagattaagatgttttgaagctcccaagcagagggatgctggatctgctgtggaaatctggctgagcagctgcagggacagctgggggtaaagcatccaccctcccccagtttggcgaggatgcactcctcagctgttctggaaggccagacttcttatctgctgtcattgaagcaagaattgagatgtccaaagagaacagaaatgggacaatttaatactagaaaggaataaaagggttaaagtcttgaatgctaaaacttctgaaataattaatttatcctgaaagattagaaaatataagttgaaactttaaatgaaaaagagattcaatttaaaaaagaactttggcaagattgatatctaaaagggtaaaaataataatactgtatcttacaacatggttatcactgttctgagcatttaatgtgtattaactcgtaaaaccatcacaactacgtgaggtaggtgctactgcctttttacagatgatgaaacaggtatagggaggccaagcaaagtgtctgaggacactaggtggatgtgatggagccagaatttgaacccaggcagcctggatgtagagtctctactattaatcactatgggaaggtggtgatagaataaaagggaatgtgaaagtcgaaaaaattaaaaaataaatggtctaaatagtcaataaacgtttatgaggaaatgattatccttccaggacatgtagattaaaaactacgagtttctcatttatacccatcagatggacaaaagcttaaaaatctcataataccaagtgtttgagaggatgtggaacaaaggagactctcatattcagctggagaaagtgtaaattggtacaatcactttggagagcaatttgacaaggtgaagatgtgcatactctgcaacccacttctaggctcatatcctctgaactctcaaatgtgtacccaagaagatatgtacatgccttcatgatagcattgtttgtaagagtaaagaaatgaaaacgacctaaatggccatcaataggggaatggataaatatggtatattcatacaatggaattctatatggcagttaaaatgaacgcaatgttgagtgaaaaagcaagtcacagaatgatttgtacactgtgatgccatttattaatgtttaaaaacatgcaaaacaatatgcatatatacagactgtgtattaacaatgtttaaaaatgcatgggcatgttaaacacccggggagtggctggggagagaaggagggaaaagggattggagttgggaggggtggtacacggtgggtgtcaactgtaacaaactactacaaaaagagctgaagtatatggcaacatgttaatttcttgctaaggtggtatgccattggtacatgggtgttcattttgttaatgttctctgtacttttatgtatacttgaaatatttgataaaaagtaaaacaaaatgtaattaaaatgcacatgataaaaggaacagaaaaagaacagaaacagtgaccactaaacatcaaggataaaatagtgaacaatgatcttgaaaagagaaatataagtattgtaaggccagttgcagaagcgtgaagtgtgcatggggaagcctgaggtgaggtatatatggggaaacagatgcttccttctggtggcagtggcagtgatgattttaatgccaaaatagtcatacagtttgtaaatccaaccacttttgggtgaatataagttaggccaagagcctttcaaaacccccctgggcctgcgaatgttgcgcttggaaaacgcaggagatggggttggaatgaggcaggggttggggaactgcgctgcctcctgcgcccccactcctgccgcagcctctccccttcaaatcttcacattgaggattgtgtttatcccaggacacctggcttagaagatgagatgtccgttttattctgctccttctcaaagtgtacttttcaaatatgagttggtaactatagggcatttgagagtgatcattgtaattatagtaatcagaacttttcagtttagtcaagaatctggacaaaggaatcagtcatatctgtaccttctgcagttccaacagcttatgtaatgtacatgattaggctttgcccacttagtgttcagttcattcttgtgagactcgtggaaaattcagattcttcggtgggatgtgatgaactgtgtaagggcaaatgttaattggagaaagtgaatgcttagcttgaatcgtttttgaattgctttggaaactcatgtatttttaaacttggtgtttacttgaactgttggtattcatttaagtatttacccatcacatgataactgccttccatcagatcccaactgtgattggtagcagacagatagactttaactaactcttctcttgttgctttttttcccccctaaatttctggaagactagagatataaagcactgtatgtttctgtgagaatttcacaaattcttgtgtgtgtgtgtgtgtgtgtgtgtgtgtgtgtgttggtttggtgaattattcctcactctgccctctggtgtgtgctctttatttttacttagagccactgaatttgcttttgaagaaaacatttacttttttcagtcttctttggggtataccccctttttaaaaaaacagtaacaaatgcacatggtaagcaacagagtaggaaaaggtacactcgccagctctgacccatcctctgattcatctcttcagatccttgtgtattcccataatattttatgcctatacaagcatttatgttgaaccagatgaaattgccatttttgtaagtcagaatataggcagttttatttggtttaatgtaatgtatatgtctttttctttaaatgggtaggaacatactacatacactgttgtacatcttgcttttttttttacatttaagtcttggagcttgttttggatctgtatatagagacctaccttgttcttcatggctgcacagtgttttactgaatggattgcctatgtaatccattagtttgtattatattagtatatagtttatatatatatattagtttatattagtatatagattattttatttacaatgttaaattatagatatattagtatgtagatttccattttaaagattatatatacctatgcaatgattatctttttacttatgttttacactcaggttcaaatatatctgtaggacacatttctgataaatttattttactcatgatatatgaatgaaagaacatatcattttaattacagacactttttatttaaaatgtatgtttattcagtccgtggttattactcactgcatatttgtcagtgactgaccattatacctgaatcttgcttttgttccttagttggaagatctggaaacttggggaatagttgttatttctttattgatctggtcatatcctgaaaataattataattgaggaaaaaaggaatatcccttatatggcttgcaaaattcttgcatactttttatggtatggtttaagagagtcaataaatagcatctcctttcccttccaagtccagaatcagttaaaagatggatggaaaagacaggcaaatggtgatcaaatattgcctttattactgatgcaattggagaacaggccttaagtctgatagtcaaggggctggttactattaggttggtgcaaaagtaaatgtggtttttagaaataatggcaaaacccctaattacttttgcaccaacctaataattcacccacagtcagacagaactgggctcttgggaactttaagcctggaagaaaagggaatctggtgttttagattccaaagagtaaggccaggtgcagtggctcgtgcctgtaatcccagcacttggagaggctgaggcggatggatcacttgaggtcaggagtttgagaccatcctggtcaacatggtgaaaccctgtctgtactaaaaatacaaaaattaggtgggcatgttggtgcatgcctgtaattccagctactcaggaggctgaggcaagagaattgcttgaacacagaaggcaaaggtttcagtgagctgagattgcgccactgcactccagcctgggcgatagagtgagaccatgtctaaaaaaataaaaggattccaaagagtgagaaaaagaagaggtgaagccatgtatgattagtgtccctccctcaccattagataaattattattcatcatctggggatgttagccaagggtggggagaggaaagagttcaggaataattagcaaatccacatggaaactaggggagagggaataactgttctttacaagcatcatcttttagggcagaatgtagcatattttatatgcagtaatggggaggggctggagaaataaaaacacttccctatgtaagagcaataagttggagcacctggactagaactctctttcttactctgtttaatactcaccatgtcacacagtcttcaagagtaaataaccgtttgcatctggagtcttgtcccattttcatacatctcttgcacaggggattgctgctaccaaaagtcaaacctgattatttagaccctgggctgcagtggtctggatgagcaatagcatcatgtaattgactatgcccactttgccttagttgtaggatgtggtcatatgccagtaaatgtgaaattttattagtattaatattaattgcattcatatactaattgtgatatttataatatatgctattataacgctgtttgtagtgctatatattataagtaatgttcagcattgattcaacaaatattggggttctgttgatggataatgtcagaaatgagcaaaaacagcctctgtgtttcagacagtgggctggcattgtgagggccttgtagtgggaaggaatttgttgcatttgtggaactgatagttgctagatggcctgaatacagaggagagggtagtatgttcataggctaagccaaggagggccttgtaggctgtgttaaggcttttggcctttaagagcaataagaaagtaaaggattttaaactgaggagagagagcatgattagcacttaaaaaaaaaatttgagcatagtgaaaatggatctgaaggggatgtagtgtggatgtaggttaggaggctgttgcagtagcccaggccagagatgatggcttccagcagaatattgacagtgggaatggaaaagtagaaggattcaagagtttagaggtgaagctgacagaagttgctcgtggttggtgttggaacttgagagtgaaggtggttggaactgttctgacgtttctgccttaagcagcatcatggattatgggcctactcactcacattgggattgctggaagaggaataaatttgtaggaggtagaactggacttcactctcggacactgaatcgaagtgcctttgaaggccaggcatggtgactcacgcctgtaatcccagcactttgggaggccgaggtgggaggatcaccagaggtcaggagttcgagaccagcctggccaacatggtgaaaccctttctctactacaactacaaaaattagctgggcgtggtggtaggtgcttctaatctcagttactcgggaggctgaggcaggagaattgcttgaacgtgggaggcggaggttgcagtgagccaaagtagcgccattgcgctccagcctcggcgacgagcaaaactccgtctcaaaaaaaaaaaaaaaaaaaaagaaagaagtgcctttgaagcatccaaattccaatgttgtgtaggtagtgagttatatgggtctggaactcaaaggagggtttggatgggaaacatgtttggaatagccagcctccatgatttgaagttgtagatgtgggtgagactgcttacagagaagtttttctcaacctggactgcactttggaatcactgaactttgacaaataccacccaccccagagattctgattcaattaacctagagtaaagcttgggcattgggcttctaggaactccccagatggtactaatgtgcagtcacggttgagacccactggcctagagagaacctaggctgagactaggagaggaatcaggattgagccttgaacacatatggccaattggagaaggatgagcctgcccaggagattattaagatgtgaccagagaggtggaacaaagactaagtgtggtgtcatagaagtaagtaaaagagtggtcagcagtgtctgttggctactgagaagccagttacagtggaacttagatttggcaacatggacatcattcactaaccttagggggagctgtcagtgggaagcttgaaacatgccaattagatggggttgagaaatgcaaggaaatggagacagctagcgtaggcagcttttaaaggtgtttggggagagagacccagggtgagtctctttaaatggtaaagaaaacttaccttattcaagagttccagaagaaggtggcactagggttgtatattcagtggctcaacaatgtcatcagagacttagatttttccagcctcagtgtgtgacttggtcctcaggctgtcccctcagaatgtaggatggctgctgtaattcagacatctttagcagaagaaggacaactttgtcttatgtcctttaaaaaaaatcttaatacacatgctgaaaagtatacaagtgttaagtgcagctggaattttcagaagtcaaacaactgtaaccagcatgcagatcacaaccccagtaccccagaagttcctcttagtcatgaccctcctcctagtcatgatccatctcctcccccaggagaactaccatcctggcttccagtggttaattttgcctattttagtacaatgtaatgaaataatatactatgtgttcttttatgtttggttttcagcatcgtttttgagatccatattgttgcatgtagttgtaaagtgttcatctattgcatgaatataccacattttatccattctattgttgatgggcatttgggtagcttctcctatttggcttttacaggtagtattgttgtgaacatatgtatttatttctgttgagtgtataattaaggagtggaattgttgggacagagggtatgcttatatgcatttagctttcctgtgtgattgtatcattttgtactcttacagcagcatatgagaatttcagttctgtgccctcaacacttactatttttcatcttttattttagacattctggtgggtgtgtagtggtataccgctgtgattataatttgtattttcataaattgattaaggatgtttcagattttcataaggttattgaccatttggatattctcttttgtgaagtgcctgttgaagtcttttgctatttttttctcttgagtagaatgccctattcatttttaggagtttttcttttgtattctgaatatgagtcattggtcagatatatgtattgcaaatatcttctcacattcagtggcttgccttttcactgttgatgttttcacaaacaagttactaattttaatgtagtacagtttatcagttttttcctctgtgataagctctttttgtgttctgtttatcatctttacccattcaaaggtcaccagattttctatgtttcatctaaaggtttaattgttcaactttgatgtacagatctgcagtccatctggacctggtgtttgtatttagtgtgaggtagtgttcaagattcatatgggccaggtgcggtggctcatgcctgtattcccagcactttgggaggacaaggcaggagaattgcttgagcccaggagtttgagaccatcctgggcaacatagtgggaccgtgtctctacaaaaaaattcaaaaattagccagaaattagctaggcatgatggcatgtgcctatattcccagctactcaggaggctgaggtgggaggagcgcttgagcctgtgatgtcaaggctgtagtgagagggactggcactgcactccagcctgggtgacagagtgagcccttgtttcaaaaaaaagaaaaaagatccatatggatgtccaattgacccagcaccatttattaaaagagtatattttctccatgtaccgcagtatcacctttgtcacgaatcaggtcattatgtgtaagaatccatttctagtttctctgttctattttgttggtcaggttgtctatccttatctagttggtttttttttttttttgtacgtaaccttttagtaggtattgatatctggtagtataagttatctagttttgttcttccttgtaatctctttaagagtgatgaattagcataaatatgaatgtgaaatgatgaaccagcaaatattaatctacgttgaaaaaagaaggtggataagtcagtgagttgggtaccctgaggagataggaacaattgaacaagttaaatgggataagcaaggttatagtgagaggtggatacctgaattagtgattgaacagtttgaagtttgaacagttttgagtttgaacaccctaagttccaggggtgcagtgatgggtggctgagttgggctagaggtggaagtcattgaagataaggaagccaggaaactgatagactgtggtatggatctgttagttcttgataggttatgaaagtacatttaataatgtagtatctaatttaatatctacctcagaacaggtagaacagaattatttacattttacagatgagaaaaatgggcccagagatgttaataactccctaatagccccaagaaaattagtgattaaattagacctaacctgggtcttatggtctagcttccatgctctattcagtgtagcttaactgatgttgtgtgaaagacctggtagtgatacatttggaaagtcttactgacatgcagaaatagtacagaaaaacatacaaataggaatgttattggctgggcatggtggctcacacctgtaatcccagcactttgggaggccaaggcgggtggatcacaaggtcaggagatcgagaccatcgtggctaacatggtgaaaccctgtgcctactaaaaattcaaaaaattagccgggtgtactggcatgtgcctgtaatcctagctacttgggaggctgaggcaggagaatcacttgaacccgggaggcaaaggttgcagtgagccaagatcacgccactgcactccagcctgggcgacagagcgagactctgtctcaaaaaaaacaaaagaatgctatgcataggtacaatgtcgaaatgtgcaagaaatacttcagaaatattaaaagtagttattcctgggtagttgtgattgtgactctgggtgactttttccctttgttttatttttctgtattttccaaatttcctataatggacatatattatatggattttttttaattaaaattatcttttgactagataatatacatggaaaattcacaaagtacacatatgcaagatataatacttttactataaaagagtgaaaatttttaaatacttgtttttccttttagaaatgcactcggtgatggaaagagagccactattctgaagaacacttggccaaaggtaggtttcttctgtattttatattgagcaaataatgccatacaacattgtgaaaaatctgtttatagggtgtgtttgttcataaaaatgctatatgaaattacgtagagctccagaatgtgaaaggggagtcatcagatccatgatcagcgtggggacccagccacagcactgacaggctgtgcgtgaggacaggtggcctgtgggcatcttgagtcttcagggtgccttagtgattgagaggtcatctctgcgtattctgggtgggtgtgcctgaatgtgaaaaatgacttaaaactggggaggaagtataggaggctgtctttataggaggcaggaaaagatttcttaacacacagtgcacaaatcagcagtgaagacaaccatcttgatatatttggctatatcgaacttaaaaacttgtgtatgtcaaaaggcaccatagatgaaatagtagtttgagaggagataatttgccacatatataactggtaggatttacagctggaatatgcacataattcctaaagtaaataagaaaccccgtagaaaatgggccagtaaaacaagtaagcatttcacagaagagtaatcctgaatggccaatagaaataagaaactatttcggtaggggtggagccaagatggctgaataggaacagctccagtctacagctcccagcgtgagcgacacagaagacaggtgatttctgcatttccaactgaggtactgggttcatctcactggggagtgctggacagtgggtgcaggacagtgagtgcagcgcaccatgtgtgagctgaagcagggtgaggcatggcctcaccggggaagcgcaaggggtcagggaattccctttcctagtcaaagaaaggggtgacagatggcacctggaaaattgggtcacttccaccctaatactgcgcttttccaatgggcttatcaaacggcacaccaggagattatatcccgcacctggctcggagggtcctacgcccatggagcctcgctcattgctagcacagcagtctgagatcaaactgcaaggtggcagcgaggctggaggaggggcgcctgccattgctcaggcttgagtaggtaaacaaagcagcccagaagctcgaactgggtggagcccaccacagctcaaggaggcctgcctgcctctgtaggctccacctctgggggcagggcacagacaaacaaaagacagcaataacctctgcagacttaaatgtccctgtctgacagctttgaagagagtagtggttctcccagcacgcagcttgagatctgagaacgggcagattgcctcctcaagtgggtccctgacccccgagtagcctaactgggaggcaccccccagtaggggcggactgacacctcacacggccgggtactcctctgagacaaaacttccagaggaacgatcaggcagcagcatttgcgattcaccaacatctgctgttctgcagccactgctgctgatacccaggcaaacagggtctcgagtggacctccagtaaactccaacagacctgcagctgaggctcctggctgttagaaggaaaactaacagaaaggacatccaccaccaaaaacccatctgtacgtcaccatcatcaaagaccaaaggtagataaaaccacaaagatggggaaaaaacagagcagaaaaacctgaaactctaaaaatcagagtgcctctcctcctccaaaggaacgcagctcctcaccagcaatggaacaaagctggacggagaatgactttgacgagttgagagaggaaggcttcagaagatcaaactactccgagctaaaggaggaagttcgaaccaatggcaaagaagttagaaactttgaaaaaaaattagatgaatggataactagaataaccaatgcagagaagtccttaaaggacctgatggagctgaaaaccacggcacgagaactatgtgacaaatgcacaaacctcagtaaccgatgcgatcaactggaagaaagggtatcagcgatggaagatgaaatgaatgaaatgaagcatgaagataagtttagagaaaaagaataaaaagaaacaaacaaagcctccaagaaatatgggactgtgtgaaaagaccaaatctacgtctaattggtgtacctgaaagtgacggggagaatggaaccaagttggaaatatctgtaggatattatccaggagaacttccccaatctagcaaggcaggccaacattcaaattcaggaaatacagagaacaccacaaagatactccttgagaagagcaactccaagacacataattgtcagattcaccaaagttgaaatgaaggaaaaaatgttaagggcagccagagagaaaggtcgggttacccacaaagggaagcccatcagactaactgctgatctctcggcagaaactctacaagccagaagagagtgggggcgaatattcaacattcttaaagaaaagaattttcaacccagaatttcatatccagccaaactaagcttcataagtgaggagaaataaaatacttcacagacaagcaaatgctgagagattttgtcaccaccaggcctgccctacaagagctcctgaaggaagcactaaacatggaaaggaacaaccggtaccagccactgcaaaaacatgccaatttgtaaagaccatcaaggctaggaagaaactgcatcaactaacgagcaaaataaccagctaacatcataatgacaggatcaaattcatgcataacaatactaaccttaaatgtaaacgggctaaatgctccaattaaaaggcacagactggcatattggataaagagtcaagaccgatcagtgtgctgtattcaggaaacccatctcacgtgcagagacatataggctcaaaataaagggatggaggaagatctaccaagcaaatggaaaacgaaaaaaggcaggggttgcaatcctagtctcagataaaacagactttaaaccaacaaagatcaaaagagacaaggccattacataatggtaaagggatcaattcaacaagaagaactaactatcctaaatatatatgcacccaatacaggagcacccagattcatacagcaagtccttagtgacctacaaagtgacttagactcccacagaataataatgggagactttaacaccccactgtcaacattagacagatcaacgagacagaaaattaacaaggatatccaggaattgaactcagctctgcaccaagcggacctaatagacatctgcagaactctccaccccaaatcaacagaatatacattattttcagcaccacaccacacctattccaaaattgaccgcatagttggaagtaaagcactcctcagcaaatgtaaaagaacagaaattataacaaactgtctctcagaccatagtgcaatcaaactggaactcaggattaagaaactcactcaaaaccgctcaactacatggaaactgaacaacctgctcctgaatgactactgggtacttacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaaaagaactagagaagcaagagcaaacacatgcaaaagctagcagaaggcaagaaatatctaagatcagagcagaactgaaggaaatagagacacaaaaaacccttcaaaaaatcagtgaatccaggagctggttttctgaaaagatcaacaaaattgatagaccgctagcaagactaataagaaaagagagaagaatcaaatagacacaataaaacatgacaaaggggggatcatcactgatcccatggaaatacaaactaccatcagagaatactgtaaacacctctacgcaaataaactagaaaatctagaagaaatggataaattcctcgacacatacactctcccaagactaaaccaggaagaagttgaatctctgaatagaccaataacaggctctgaagttgagccaataattaatagcttaccaatcaaaaaaagtccggaaccagatggattcacagccgaattctaccataggtactaggaggagctggtaccattccttctgaaactattccaatcaatagaaaaagagggaatcctccctaactcattttatgaagccagcatcatcctgataccaaagcctggcagagacacaacaaaaaaagagaattttagaccaatatccttgatgaacattgatgcaaaaatcctcagtaaaatactggcaaaccgaatccagcaacacatcaaaaaggttatccaccatgatcaagtgggcttcatccctgggatgcaaggccggttcaacatatgaaaatcaataaatgtaatccagcatataaacagaaccaatgacaaaaaccacatgattatctcaatagatgcagaaaagtcctttgacaaaattcaacaacgcttcatgctaaaaactctcagtaaattaggtattgatgggatgtatttcaaaataataagagctagctatgacaaacccacagccaatatcatactgaatggacaaaaactggaagcattccctttgaaaactggcacaagacagggatgccctctctcaccactcctattcaacatagtgttggaagttctggccagggcaatcacgcagaaggaaataaagggcattcaattaggaaaagaggaagtcaaattgtccctgtttgcagataacatgattgtatatctagaaaaccccatcgtctcagcccaaaatctccttaagctgataaccaacttcagcaaagtctcagagtacaaaatcaatgtgcaaaaatcacaagcattcttacacaccaataacaaacagagagccaaatcatgagtgaactcccattcgctattgcttcaaagagaataaaatacctaggaatccaacttacaagggatgtgaaggacctcttcaaggagagctacaaaccactgctcaatgaaataaaagaggatacaaacaaatggaagaacattccatgctcatgggtaggaagaatcaatattgtgaaaatggccatattgcccaaggtaatttatagattcagtgccatccccatcaagctaccaatgactttcttcacagaattggaaaaaaactactttaaagttcatatggaaccaaaaaagagcccacattaccaagtcaatcctaagccaaaagaacaaagctggaggcatcatgcttacctgacttcaaactatactacaaggctacagtaactaaaacagcatgttactggtaccaaaacaaagatatagaccaatggaacagaacagagccctcagaaatagtgccacatatctacaactatctgatctttgacaaacctgacaaaaacaagcaatggggaaaggattccctatttaataaatggtgctgggaaaactggccaaccatatgtagaaagctgaaactggatcccttccttgcaccttatacaaaaattaattcaagatggattaaagacttcaatgtttgacttaaaaccataaaaaccctagaagaaaacctaggcaataccattcgggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcgaaggatatgaacagacccttctcaaaagaagacatttatgtagccaacagacacatgaaaaaatgctcatcactggccatcagagaaatgcaaatcaaaaccacagtgagataccatctcacaccatttagaatggcaatcattaaaaagtcaagaaacaacaggtgctggagaggatgtggagaaataggaacacttttacactgttggtgggactgtaaactagttcaaccattgtggaagtcagtgtggcgattcctcagggatctcgaactagaaataccatttgacccagccatcccattactgggtatatacccaaaggattataaatcatgctgctataaagacacatgcacacatatgtttattgtggcagtattcacaatagcaaagacttggaaccaacccacatgtccaacaatgatagactgggttaagaaaatatggcacatatacaccatggaatactaagcagccataaaaaatgatgagttcatgtcctttgtagggacatggatgaagctggaaaccatcattctcagcaaactgttgcagggacaaaaaaccaaacaccgcatgttctcactcataggtgggaattgaacaatgagagcacatggacacaggaaggggaacatcacacaccggggcctgttgtgaggtgggaggggagagggatagcattaggagatatacctaatgctaaatgacgagttaatgggtgcagcacagcaacatggcacatgtatacctatgtaacaaacctgcacgttgtgcacatgtaccctaaaacttaaagtataataataataataataataataataaagaaactatttctatttcctagtaattaaaattgtagggatttggtacacagataaaagaatgaaaccaatagtgcagaatagagggcctccacacagaacccactatgtgagtaaatattacaatgtcatattgtctgagtccttcagattggcagaaattaaagaggctgatagtctggtgttggtgggtatgtgtagtaacaggaagccccagtaaactggtgggagtgtgattgcttacaaccaagtcagggagcactataatagactccacagttacttgattctgagtgtgtgtgctctagaaaatttcttgcaaatgtgcacatggtttgatatgcaaggttggtcattgcagcattgttttaatggcacacaactgcaaatacctacatgtctattgataaagcagcagataaatgtggtattttcacttgatcaaagttgttactctgacctgtgtgatctgtccccgtcttgaacacttgttgtttctccaacctcactgctcctgctctgtccctggttcactttatcttggcctcttggcatcctcactgttcctcagacattccaggcccacttccactttgtacttgcccttccctctgcctagaatgcttttccccagagcgttggccagcccccttatttcttttcagtcgatattgaaaggactcttctcagtgaaacattccttggcctcattactaaaatgccaaacacctcacttcctacgcatttcttatcttctttccttgctttacttttttcttcttaggacttaccattatctaatacattatatctactgtttgagttatagtggctattgtgtgtcttccagtataatatgagctccacaaggaaagatttttttggtgtttggttcacttcactcttgaatccagactgtctgacaagctgcctgacacttacttagcaggcactcattagtaaataattgttgacttagtgattgaatgaatcaaatagtagattgcagttgaattagctggcttatcaacatttatggattttaaaaagttaaatgaaaaagtcaataaaacataggctggaaaaatatctatcgagttcatgatagtgtttgcttctgggcagtaagagagggaaaggagattggagagggtacaaaggagatttcagccatatctgtatcatcagaaatagttttatttatttcatttaaaaatcagaagcaaatataacaaaatgttaacagttaattctgggtatctgtgtattagtctctgtattttcctaaattataaaaatattttttttttaagtgaagctttagatgccaggcatgatggctcacacctgtaatcctagcacttcaggaggctgaggcgggcagatcacttgaagtcaggagttccaagaccagcctggccaacatgtgaaaccccgtctctacaaaaaaattttaaaaaattactggatgttgtggtgcattcctgtctagctactcaggagtctgaggcaggagaatcacttgaacccaggagatggaggttacagtgagctgagatcacaccactgcattccagcctgggtgacagagtgaaactccatctaaaaaataaaaaaataaaaataaataaatttttttttaagtggagctttaaataagatatagaaaggcacatgtatttcatacttcattcctggttttacgtaatttaaaaaaagctagtgcaagtagaatcagaatttgaaggccttagggaatttagtctaatttgatacttccattactgctctgcggatagccttcattagattaattgtaggagtttattttgtttaatttttttaaatgaactttatattataaatatcacatgattaaagagaaaaatagaatatagcaaggtataaagtaaaagggaaaagtcagcctggagaccttgtttaaaagacagatttcttcgcttttcccccaaattgtgattcaggtggcctaggaatgtatctaggagtgtggagattgtaaaattccccaggtggacttctgcatccagattttagaatcattttttaaatgccttattttacacatgaagcaattgagtcccagagaggtagagtgatttttgcaaggtgtcattgcaaataaaagacaaaactggtggttctgtttgagggtgaccagtttgttggtattttcattatgagtcattcttttgcttgaaacaaaatctttgctgatccttgaacctggtgtttgacaggtgctatatcaatatttgtaaaatgaatgaatgaatgatagaattccaaatactgaaacccaaaccatgatactggttttccagaaatacttcctgctattttaatatattatcaattaagaaaaacagttattaaaactttttgaagacctggcgctcactcctgtaatcccagcactttgggagggcaggacgggcagatcccttgagttcaagaccagcctgagcaacatggcaaaaccatatctttacaaaaaattagttgggcatggtggcatgtgcctataatcccagctacttgggaggctaaggtgggataatcacctgagcccaggaagtatgaggctgcagcgagctatgattgcgccacttcaaaaaaaaaaaaaaaaaagaaaaaagaaaaaaactttaacaattattttgagaactttgtggagaatacttgttcctggcttagtttcttaaacaaaatattcacttttttttttaaattggaatgtttggtgatgtccaaacatcccttctcaggggatactctcttttgttgccttgtattggtgatgtgtcgtatgattgcagaaatatttgtatagataaaaacatataaccactagtaagtattttaaaaatttggtaactacataactaggttatttttcttttttttttaaaaccagaaaagaatgcttattaaaggataaacttcaggagcaaaagtagatcatacagggtatatttacttttataagattgccttactttagaattaattatgagcctgagtctatggagtcatacctctaagatgtaagtgtgttagtggaatgtattctgtagatttctatgtgagggtaggacatttttttccttcttcttaatggggaagattagtacagtgctacctgtctctagactcactttcaggatttagaaagaatgagtcatttgtcctgaagagtgagaatttttcttagcctcaacagatatgtttgtgcaggtctgtgagcattgtgttttgatctatatcatataggatacaaactaataacctcagaaatgtcctcaagaacatttaaattttgaggggcgcattaggacttttgttgtgaatgacagaaactgaactcagatttgatttaagtagaaaagggaattaattggctcatgtaactgagaagtctaggggttagcttcaggaatggttggatccagatttgtacacatctttctttcattttctcaactttgcctccctgtttgtcagcttcatgtttagtcttttttctagcttccctctctgatttttacatggattctcttgttatgtcttcaagctcacccatcttttcttctgcagtgttttatctgcctttatttccatccaatgtacttttcatcttaaatgctatagttttcatctctagaggttaaatttgggtctttcttgcatatttcatgtctttaacatattccatctttcctttcacctcttgaacacataggggatagttataataagtatttcaatgtccttgtctactaatctgtgtcatttgtgggttgttttcagttggtttattttgctgttcattataggtcatattttcctggtaattgtagatggatgccagatattgtgaattttaccttgtttggtgctggatattcttgtttttctttaaatatgcttgatctttgttttgggatgcagtaaagttacttagaaacaattttaattcttcaaggttttaagattttttttaggcgggactatagtggcatttaatctagggctaattttttccccactactgaagcaaaacttttctgagtactctacttgaagtagagaattcaccccatgaattatggtgtttttcactcttgttgataggaacaggaattattcctgatttgtttccgttccggctcttgttccctgttaacctttcaggttgttctttccctggctgtggaccgttgtcccccagggatgtgctgatcagtacttagctgaagactcaaggggtccctctggagttctccctgtgtgcagctttctcttctctggtcctctgctctgtgaactcagctgccttggtcctctgtactcccgcttctgtctccttaactgagagaggctgccagtctctgcctaggttttctcttcccatgctctggcttagagacattcttatcagtaagcgggatcaatcacagggcttactttatatgtttttcatactctcttttgttgccttgttttcaatgtcttgcaagctgtggtttcttatcttttgtctttgttttaggtaggagggaaaaatcaagtccttattacttcattttggtcagaagtggaggttagagtgtaggcgctcttggttttatttttaaaaagacttttaccatgtagtgggatctgcaaactgatgtcatgagtagctgttaattctaggaaaaggagaccctctctcagtgtgtgtacagtagaccttagggatgcctcagactgattctgattgagtcatgtgcccacctgtggatttattgctttgacctagaaagtagtgcatttcaattggccagtctcctgggttacagccacacttccaccgtgccgtccattgttggggtggagcactggaactgacagtcctgctgttactgtgagaagtgggaacatggtggtctcctaagtgaggggagactagagagatgagcaagagggaatttccacatgtgtgatagagaatgagatagtgaaaagacctttttattgtaattgggtttcagaaactctgagatacctttaatttaagcttcattgaaataacttcagtagggaggtctgaattaagtcttttctcaactaacaggagttacattatgttttatagggttcagggaaaaggatccaataaaaggtgagaaaagtatggagaaaagagaaagaaataaagttctctgcaaatttagtagatttggtttatgatctatcattatttcttatgctagctgtgggttttttaatgcagttatttaaactttgaagtccgtaaatgcttaggggataggatttgaccttgtagcctatctgagagatgcctttgtcttcttatactttaggtgtcaggaagcatggcctataccctttcagcaaaacagagtttaatgaaatgccatatgaattggagtctgagctaagcccaaatagtctgtctaaaaaaactccagaacctttagagccacacggtaccccagagcaggattacttatggtaaacctgcataaacacgtacccacgtaattgtttctggcttcttgtagtgaaaagctgatccttcttaaaagcgttgtttgttttttataatttctcctagattttcactgaatcacagtgttctttgtgaaatgtgtagtgaagaggaaagagctttggaccaggtgtcataaaaatcagggttctttggtttgcctcttaagtaagtgtgatattaggccagtttctagcctctagcctctttcactagtaaatcaccttgccagtagtactgtgcctaaaatgggaatttggtttgggaggagctagaagcagggttggttcagttagcttcaggttttggtactgttagctttgtagattaaaaagtttatacttaatatagaagatttccaaaatatgtaaatggaccagcaaagattttggttctgtagcaaaaaacccttatcattggaattaaatgtaaatccctggtttttggtttcttaaagccaggagctgcacttagagataacaatgaaaagctgagtgaaggggagacggctggatggaagatctagcctgagcacatcccccatctgtctgcactcttcggaggtatcggaaaaccatggcacaggcccatggttccatccagctctaaaaacttctcgatttccaggtgtaggaaaggcgatgacttagagattgttactgccttcaaatatttttaaaacataaagttatttataatgaatgacattttttactttatctggcacaaaattattatattctctgttagcaaaatataacaaaagttgaactctgctgggggtacagaaatttcttaagcaaaaatattgatccttagttattgtgattatttgtgtatttataacttttcacttagctcattaggtaatgttatttcctgaggtattaacattttacatttatttttcattggtagggacctaatctaatattttaagtaatgaatcagttttcaagcaaaacatttttccttacctgttttctttaacttaagcatatttttgagaaaaaattaaatttatctttttggaacagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtatttcacctaagattcttttggttacagtcttaattccctttcaaactttggagggtgggtttcttggattaacagaggaccacaaatcaatcctcagatgatttatccttattttatcatgttatcttggtcatggcacttgagtttttcatttctatctgtgtagagttacatgttatccattaagtaattataaatgatttgtactttttatttgaaacagacagcaaccaaattgttatttattcctctgtagaaaaaaaaatccctttcagaaattttgaataaaataaaagcttttttgaaacaaaattatttaaaaatatttccttcattgctaaagttatttcctaaagaaaagacccttcagtagagctgcttgatgtttccgcaccatttgtgctaattctgcagcgtgctgaatatatatatatataatatatatatatatatattatatatatatatataatgttttttatatatatagcagaaattggctgtgcaggctaggagttgtagattttcattctctccttgttttctctcctaagtctttttgctttctccaatgcctgaaagtcccttagtctacatttttagtgtatgagtctttcctgctttttcttcttcgggttgtacaaagctgagctgaacagctctgtttgaccggcagatgttgttatccatcataacatgattatgtaataagatggtgagctccttgaagacaggtgccacctttgattcagatttacatattgctgtcatcttgtcaatgatcacatgtgatggaatgtcagacaaagtttgtgtaacattttgttgacaccatcctaaaactaaagacatctagaaatgtaaaattgcttagatttacttttcagttttctaaatttgaggtccttactatcagcttaaagtaaatttgaaatcttttaaagtctgtgttgccaatccattgattactatgtgtgtgtgtgtgtgatgacttttataggtcgaacagcaaataaggatccaattaaagccttttatgaaaacaggtaagttaatagcaggtcagtagctgctactactaggaatggctttgctgcatgaatttaagaatcacttatgtttgacgctttaggagctaatagcaaccacagtaaagttggagatggaaggaagagaggtagttttttaagtgtccgtgttatcaggtgacctgtaagttgtcagatttatttcgctgttttagtgaaccatatagatataagctcagtagcctaatcctgtgggaaaagaggggtgaaatgttaattggacattactatgcttggatgggaccagtttggccatgaaactcctggcagcacagagctaggacatagcctgtgccctgtgcccttcacctctgtcttggaagtatctatggcaaaaaccacaattacttttgcaccaacctaatatttccagcttcctgatgtctttcaaaggctaagatacttcctattagaaataggcaacagatagacttgagtatgctcacaagaaagcaatagcagccagggttctacctttacttatttggcaattaaaacagattaaatgtttttctgcattcttgttcagatgtctgggataccgaagctgctaattctgtagcatgctgaacatgtagacataaagaaattggctgtggaggctttaaatttaattttagtatcctaatttaacttaacttaggatatttaaatttagcacaaggtcataggtatttttttttttttaatttttttgagacggagtctcactctgtcacccaggctggagtgcggtgttatgatgtcggctcactgcaacctctgcctcccgggttcaagcgattctcctgcctcagcctcttgagtagctggggccacaggcggctgccaccacgccctgctaatttttgaatttttggtagagatgaggtttcaacattttggccagactggtctcaaactcctgacctcaagtgatccgctcgccttggcctcccaaagtgctgagattacaggagtgagccactgtgcccagcctgagccactgtgcccagctgatatttaaatgttagaacgcagaatacttctttttgaactgttctttttttttttttttttttttttgagacagtctccctctgtcacctaggctggagtgcagtggcacgatcttgggtcactgaaacctccgcctactgggttcaagcaggtctcctgcctcagcctccccagtcgctgggattacaggcacatgccaccacacctggctaatttttgtatttttagtagagacgggggtctcaccatgttggccaggctggtcttgaactcctgaccttagctgatccacctgccctgggctcccaaagtgctggaattacaggcgtgaaccactgcacccagcccttgacctgttctttattattttgagtttaatgccaaatataaaataatgtttatgtataaagccccatctcacaggtaggaaatctttttaaaacaataataccttgctttcaaggaaaaaaggctgtgattgctgcaacctgttcattcaaaggataactttcaaaaaatgtataataattccttttttcccccacttagggcctacacacctaggagtttatcagcacctatatttactacttcacttaactttgtggagaaggaaagagatttcagaaaaattaatcacgaaatggccaacggtggtaatcagaatctaaaggtaagctccattgaaaactacagtttttttcaaggatagatagtctcatatttttacagtaatattttggtggtaatagaaaccaaatttttggcgatttgaaccctttttgcctattgttactgaaataatgattctcttttaaataaataatctgagtatctcatataactacgtaaataatatttgaaagtcacagaatttcttttgaaatcacatttatgtgtttccaacatatttttaaaaataaccattttgccgcttctctttgtatcttttcccttcggttgttggaaaagtcctcttgttgataatattgaaaatttctaagagactgtgttcagttagggagaggagtttataccgagcatctccagctggatctggaattgtattgagcatttccagctggatctgaagctaagggtctgtaaacactcacctcagcctgccttagcagcccttttccagccttccaccctttttgaggtcttgaaatcacacaggtttacttagtgcttccgaaatgaactctactcttgggttcaggccattctgtccaaatcgtacttctttctcaaaaccaaacacaaatgctgtatcctcactaacatttttcttaaccactccagcttaagtgatttttcccttttgtgagttgtgagagatattactgactatgcaatttatatgtcaataacaacacagtattttcttttcttcataaggatggttgttgtttaactactgaagtgatgtgtcttttcaccccatctgattgtaaactgagaacgggagttatctcctgtatctctctgtatctatggtagacctaaatcataataatgatcgctattataattgatctttaataattgattatatttaataatttattatatatagaaaaatatcatcagtagcttcttttttggcttacccttttgtagttacactcacataccacattgctgcttctgtttcttactccaatttatattttaaaaatagttttactctcaggcttgtagatttttatgtacagatgtgatagtgttaattcaaacattattgaacaattgtcatgtcagacatcgtgctaggcaatagaaatagaattgtcattcaagaatttgttcgttgccatatcatgatccttatcattagttatcattttgtttgcttgtttatacatttaggcttaataaccagctgcatattttagctgctagggtgaattctatcctattctattctaaattcttttatatagctattgaattcttcatggctgggttgttttttttttttttaagtctcactaatttcattggcaggtggcggatgaggcgttgaaggtagatgattgtgactgtcatcctgaattttcaccaccatcaagtgagtattgtttttatatcaattgttgccaagttaatataatgtctcctaaatttggatgccctacaatgtgcacaagccttgcttatatccactcttgttctcctttactttataatgcttctatgttaagaaaatattgaatatttatttgaaatcaatgctcagtctttttgtattatttagtgaatgtaattttggaaattcaaataaaaggaaaggaaaagatgaagtacatagctctttttggtctgcttcttaattttttttaggctgttgtttctcattattgaaagtttattattgcctcccttcctcccacctgctaggagcctgtttagacctttttaaatctaattgttctccctcataaaattttaatagctgtttatgtaccatatgtgcatctgcgctttatgtataaaaggaattgattttgtctcccaataactaattttcaccctattgggggtgatatcacccatattgagaacagatgctgctgtaacaaaaataccataaactagatagcttataagcaacaaacatttatttctcacatttctagaagctgagaaattcatcatcatgatgtcaacagattcgatgtctgctgagggtcttcttcccggttcatagatggccatctttttgccgtgttctcatgtagtagaaggagcaagacagccctctggggtctcttttctttttctttctttttttttttttgagacagattcttgctctgttgcccaggctggagtgcagtggcatgatctgggctctctgcagcctctgcctcctgggttcaagcaattctcctgcctcagcctcccgagtagctgggattacaggcatgcactaccacaccaggctaatttttgtatttttagcagagacaaggttttgccatgctggccaggctggtctcgaaatcttggcttcaagcaatcctctcgccttggcctcccaaagtgctgggattgcaggtgtgtgccaccacgcccagcctggggtctcttcttataagggcactaatcccattcatgaggggacagcctcatgacctaattcctcccaaaggttccacttcctattaccatcgccttgaggatttggttttcaacatgtgaatcttgtcggggacacagatatccagaccataacagtgctgtaggctaagtctcatttgttttaagttgtgtgtgctcagtgcatgtatttatttacatatctagtaaacacagacaccgcagaacctcattacttggcatcatttggagatgaaggttctggagaagtgaatatttttgtgcttcatttatttctgaatcttaataccaccagagtttgatgaaaatcctctaaagtatattacatgcttccctgccttttaacacggaatttaggaaaatacaggttttcttgatggcttaaggttgtggtcacacataacagtgactgacctcaagcctggtggtgttcctcccaggattcttcaggtgagattgttgattttttagttagtgatcctctcttttcccttgtcttgtttgttgggtggttggtttttctttccatagttttgcttctagcagccatttctattttttgtgacctgcagctccatgttcgctcaggctcagttagttccatagatacagctacttagtattgagcatttccatttggttagcacattagcgtaatgatagggaggggaaactcaggcagttgtcctacctgatgcagttccaacagcatataaaacatctttgaggataaaacttttttttggaagatagcttttaatttcttcatatttctcaggccattactatcatttaattaaataaattctgtccacccttcagcatttacatacaggggaagaaattgaggttccaggattaaggttaagtagttttgtccaaggtcacagaatggaaatcaaactagaattcttctacctttccaaaagctgcttttgttttctgaggccaccaaagcccaggctctcattccctccttattacattggctctgacttgtgtctgtgccctccccttaaaccttcatcagatgcaccctgctcctcctgccataccagttcttctacacagctctgagcatggctctccctgcccaaaaatatgcagtggtttcctactcctgccagcagaataaatctgggctcacagagctggatctgaagctaagggtctgtaaacactcacctcagcctgccttagcagcccttttccagccttccaccctttttgaggtcttgaaatcacacaggtttacttagtgcttctgaaatgaactctctactcttgagttcaggccattctatccaaatcgtacttcttcctcaaaaccgaacacaaatgccatatcctcactaacatttttctcagccactccagcttaggtgatttttcccttttgtgagttgtgagagatattactgactatgcaatttatatgtcaataacaacacagtattttcttttcttcataaggatgattgttgtttaactactgaagtgatgtgtcttttcaccccatctgattataaactgagaacaggagttatctcctgtatctctctgtatctatggtagacctaaatcataatgatcactattataattgatctttaataatttaatttattatatatagaaaaatatcatcagtagcttcttttttggcttacccttttgtagttacacccacgtaccacatttctgcttctgttttcttactccaatttatattttaaaaatagttttactctcaggcttgtagatttttatgtacagattttaggaacaaatacttttgtgttcacaggtcagcctccaaaacataaaggaaaacaaaaatctcgaaacaatgaatcagaaaagttcaggtatgttttttctctaaggtatgtttttttccccttaatatactcttcccaagaaaaaggaaaaaaaattgtttttcgagtattagctactttaatgtatgtattatgatgactaccaaaatccctttcaaatatcaaaagcatatctttaggaaaggataatttttggctaaaggattattaatcctggatattaatatattgacttctgaaagtcacataatatgaaatatttccatattaatttcttaaatcccagaatatgtactctaaaaggaaaaagcattaagagagatataaggtgcacatgaagcctccttccctgctcacctcatttgaccctcctgcagtcccttctctaaggcctcctccaggaatacactgttaacagtttcatgactattgggaaacttactctgcatacgcagacatgggtatgcatatttcagatgcccttttgagtaattattgttagaggaaaatctttcctaatgaattctgactacttctaaaatgaattctatcaaacatccccatgaaaattaacagtaattaattgcctcctatctttttttttgtttttttgagatagggtcttgctctatcacttaggctgcggtgcagtggtgtaaccctagctcactgcaggcttgaactcctagactctagtgattctttttgcctcagctcccaagtagccaggactactactgctactatggtgcacgtcaccatgactggataactaaaactaaatgttttttagagacagggtcttgctctgttgcccaggctggtcttgaactcctggcctcaagtgatccttctgccttggcctcccagagtgctgggattgcaggcgtgtgcctggccttgcctcctgtctttattgttaacaccccattgacaacaagatataaattgattacaatgtgaaattgtaaatcttttaatacagaagtttatgaagtgaattaaagtgatgttggagaaacagcaaagccatgtctgccacaatacactggttttcaatttcttctccatttcttaatctgaatccatgatagatgcttcagggggaatgatttgaatatcaaaacactaaaaaaaaatcagtgaagtctcatttcttttcaaaaatgaccatttttggatgctgctacaaaaattaaatacaaagcaaggatatagcatattattatgtttttctattatttgatagaaaaatcatgagtcttcttccctgccctcccctgtacccctaaagaaaccagatattaatatatgataattttttaaatgcagagttgtaattttaacctgttttatttaaaaaaaatttatttttctgatattttgtttcacttttccaactgaacactcctttattaggtaatatctaccatatgggactatttcttcattaaatgggataaccacgtaaaacacttagagccctggaacatagtaaatcttcagtgtactttagtcgtcattactgttaccaccatcattttcattattattagaatgactctggcctacagcttgctttttgtcttttacaaaatatcttgtgtttcttcccatgttcagaacacagagctcttccattcttcatttgctgtacagtattttgtaatatggctgtatcccccatttttgtgcatttaggctcttcattcctcttttcctccctcactttctatccctctatccatctctctctttttcttcttcctttgagagggatagatcagacagtacttcaaacatccttgcacatacacctttgtgcacctgttcatgtatatttacaataaatactttgtaaataatgtatagaagttgtttctgtagtgggattgctgtatcaaaggggatatgtaattttatctttgacagatattgtgaaatggttctcttagaaaataggcactgttcacactccgactaatctacaggagggtgtggtataataaaaatatatatatatttggtatttgtcccagttcctggtacagagctcccaaaacccatggcatttcctgaatgataggagtgtattttgttactcatcatgagcccctttccatgtacttgagtttatgctaatgaggtgactcaaggtagtgcctcagatagttcaggaggaggtctcgtcactggaaagaccaaacacctgattagagggttaagactttcagcctcatacctgacctccaaggagaggaggggggctggaaattgaggttaggcaccaatggccagtggttgatttaattgtacctacatacctacataatgaaaccttagtaaagtccttaaaagagggcatggggagcttctgggctgacgaacacattgatgtgctgagaaagtggcatgcccaaggggatcatgaagctcctcgcgccccccaaccttcctatgcatctcttcctcttggctgtttttgagttgtatcctttataataaattggtaatagtaagcacttccttgagttccattgtttttctagtgagcctgaagagggactcatgggaaccctcttgtagtcagcagggcaggagtgtgggtgacctgtgcaccccacttgcagctgaagtgagggcagtctggtgggactgattctttaccctgtgaggtctgcgctaactctgggagttagtatcagaactgaattgcattattgcacactcattttgtgttggacagttgaattgatacggaaaaatgacaatatttggtattggagaaaatctacacattggatgtcagaagtactttcagaaaactccacatcgagtgcctcagattttcttactctcaccaacttagggagtcagactttctgaaatgcttgtatcttattattagattttcccatcacattgaacatctttgcactgtttattgggcacatttattgttttaggcccatgttgttactagtgactacagatcaaggcaaataccccttaatttttctcttttttcaaaagctgtttttccatatcatctttataatcaattcatctggtttccctccacctctgattttataggaatgtttattgagattgcattggatttagagatttctaatagaaatattgccaaaatgccaattccccccaaagaatggccaacttgtatggctcaccatttactcactattttacatggccttcagtaaatatatttttttcttctatctgtcacattggagggatgagagcgaactaatattcagattctattttttttcttttttttttttttagatggagtcttgctctgtcgcccaggctggagtgcagtggtaagatctcggtcctgggctcaagcaattctcctgcctcagcctcccaggtagctgggattacaggcatgcaccaccacgccaggataatttttgtatttttagtagagacagagtttcaccatgttggtcaggctggtctcgaacacctaacctcaggtgatccacccacctcggcctcccaaagtgctgggattacaggtatgagccactgtgcctggccctattttttctttatatgagtagaacttttattttaaaatgatttttaaaaatgctttttttcttttagttctagttcaccattgactttaccagcagatttgaagaacatcttggagaaacagttttctaaatcttccagagctgcacaccaggtaatggagaagcttttccaatggaaaaagcaaaactctttgaacaaaacattgttcacatgaataaggttctaatcatgtacatctctaagttttttttatataattattgtattatattgtagttttgtagagatggggtctcactgtgttgtccaggttggtttcaaactcctggcctcaagcaatcctcttaaagtgttgggattacaggtgtgagctattgcactcagctattatagacatatcatttaatatatatgactgctaagaatccaatctatcactaatttaaatattaacttgataattacgttagctagaggtttaactaatgattagcactgtggaattatttgcttctcaaagagttaacagtagtattaactttaaatatttttaaaagatttaaacacagtttcattatacttattctaaaatcattagagggcaaacttttattctttaaatgatttaacttaatcagataatgttgtatataaaattctttttacgttacttcatgatggaaaatatacattaacatggaatagaatactcatttcaaaacatgtggatctttttttaggtatacataacagatattttacaaagaactaaaatagattcctaatcatttgcttaaaaacatttttgagaatttcttaaagttggagattttaaattatatctttttacattgatttttactgactctaaacaccatgaaatacttaaatagatgacagcctgtgaagatgaaaagactatttaaataaatatgatcgctgtttttgagcctctgtttgttcattcaacacagtttgattgaggctctctccatatgctggggagtgagagagattgggtgcacagtgatatgatttcggcctgctctgctggagctttcaggacagatcatttatgtcgtattgagggaagtgacttccaatgaaagcatgaggctgtatggatctgatttctagactgataaagaaagctgggcatggtggcacgtgtctgtagtcccagctcctcaggaggctgaggtgagaggattaaccactgcactccagcctgggcaacataggaaggccctgtcttatttatttattattttcttttgttttcttttttaagcctctcactagtttgggagccctgtctcttttaaagaagaaagaaaaagaatgagaacaagattaaaattgaatgagtttatgcaaggctaataactagtatttgtagggctagtatatcatcatttataacttcaagttcatatcttaaaacaagtatggctgtcatcgagcttttaagtttttctgaaagctgctcttttctatgcatattctggggagcgttctgccaaactttgattcattggttcaaaagccagcagaggccgggtgcagggtctcacacctgtaatcccagcattttgggaggccgaggcaggcggatcacaaggtcaagagattgaaaccatcctggccatcatggcgaaaccccatctctactaaaaatacaaaaaattagctgggtgtggtggcgtgcacctgtagtcctagctacccaggaggctgaagcaggagaatcgcttgaaccccgaggtggaggttgcagtgagccgagatctgccactgcactccagcctggacgacagagcaagactccatctcaaaaaaaaaaagccagcagaaggcttttgttaatgggtaaccaaactgctttttcctctgtgatttgtgcagtggggcctccttttggatcttcattgttaggaatggtgaggaatacaacatacatatttgcatttgcggcccctttgaatggcgcacacgtgtatagcaaggagtgaggagattttaggcttaatgtctagccttgcctctccaatctttgtggaactttggtgacttacagctattcccatgtcactaaaatatgaattcaaattataatgcgtattcaaattacaaagtttttctcactttaagggcacatgatagcaattttgtttttattttttattccttatgttattccttttgcatttaacctattgttatctctcccagtaattttatctacttatattcaaatatatgttaggcaggagtacagttaacaattacagtatttatttcttgcttagaattaaggtttgtttcagagcaggatggcagttgttaaaatctggtagtgatcagaatattgattgtatgttcttaagtgtctaattgttctactcccaaacaacttacttatttaaatgatggctgttgtttttcatatatattgttaaaacttaaaaatactgtctgtttagtctggagagcaagtgaggcttagtaccatgtagtgtaaaatgagccacctttgtcacaggcaacagaagaggtgttgcaattaggatggtaaagcagtaccttttcattttcactttaaaagtgtggtgctgagaaaggaatatgatgaataagggtagtttgggtattgatgtaaacattttatcattagttataaaatattactatgaacttggcatcttaggttttaaattaaaaatgtgtagattcaggttactgaaatagaatttcttttttccaggattttgctaatataatgaaaatgctgagaagcttaattcaagatggctatatggccttattggagcagcgttgccgcagcgctgcacaggcctttacagagttgctgaacggtttagatcctcaaaaaataaaggtaaatttgccatatcataacttgtttatcaatgctaatgcacctcagatgaatgcagaagagaaccaagggcttaactcattgtagtaatgtacctaagaccttgctgagattggctgaatctacttcaggttatgggaagcaggtactgctccaattcagacttcatgagtatgttcagtatgtgatccatgtttatattctctccttgactatagtttagggtcattagaactggctttttctctgaatcaaggttttcaactatctttagtcacaccttttcacccaggaagaaagtacaggcacacctcgtttcattatgctttgctttattgtactttgcagacaatgcatttgttacaaattgaagatttgtggcaaccctgtgtcaagcaagtctgttttctgaaagcatgtgctcacctcatgtctctgtgtcacattttggtaattctcacaatatgtcaaactttttcattatcattatcactgtatctgtgatcagtgatctttgatgttactattgtaattattttggggcactacaatctgtgcctatgtaagaaagggaacttaataaattgtgtgtgtgtgttctgagtgctctgccaaccagctgttatctccacccccttccttaagtctccctgttccctgagacacgatattgaaattaggccaattaatgaccctacaatggcctctaagtattcaagtgaaaggaagagttgcacgtctctcactttaaataaaaaactagaatgattaagcttcgtgaggaaggtatgttgaaagccaagacaggcagaaagctagtcctcttgtgccaaatagccaaattgtgaatgcaaagaaacagtttttgaaggaaattaaaagtgctacttcagtgaacacatgaatgacaagaaagtgaaacaactttcttgccgatgcagagagtcttagtggtctgggtagaagatcaaaccagccacaacattctcttaagccagagcctaatccagagcaagactctaactcttctattctgtgaaggctgagagaggtgaggaagctgcagaagaatagtttgaaactagcagaagttggttcatgagatttaaggaaagaagctatttccataacataaaagtgcaaggtgaagcagcaagtgctgatggagaagctgcagtaagttatcgagatctagtgaagatcattgatgaaggtggctacgctaaacaacagattgtcaatggagactaaacaaccttctgttggaagaagatgccatctaggactttcatagctagagagaagtcagtgtctggtttcaaagcttcaaaaaggatgggctcattactcattaggggctgatgcagctggtgacttaagttgaagccagtgctcatttatgttccaaaaatcctcaggcccttaagaattatgctaattcactctgcctggagccctagaaatggaacaacaaagcatgaatggcagcacatctgtttacagcatggtttactaagtactttaagcccactgttgagacctactgctagaataaaagattctttgcaaaatactattgctcattgacaatgcacctgattgcccaggagatgtggtgtacatgtacaaggagatgaatgttgttttcatgcctggtaacacaatatccattctgtagcctatggatcaaggagtcattttgactttcaagtcttattatttaagaaacatattttataaggctatagctgccatagtgattcctctgttggatctggacaaagtaaattgaaaaccttctggaaaggatcaccactctagataccataaagaacattcatgatgcatgtgagagatcaaaatatcaacatttacaggagtttggaagaagtaaattccagccctcatggatgactttgaggggttcaggacattagtggaggaagtcactgcagatgtggtggaacaagcaagagaattagaagtggagcctgaagatgtgactgaattgctgcaacctcaggataaaacttgaagggataaggagttgctttttatacatgaacaaaaaaagtcatttcttgaaatggaatctactccttgtgaagatgctggaatattgttgaaatgagaaacttagttgatcaagcagtggcaggatttgagaggattcactccaattttgaaagaagttctagtgtgggtaaaatactgtcaaacagcatcacacattacagagaaaccttttctgaaagtaagagtcaatcagtatgacagacttcattgtcttattttaagaaattgccacagcaccttaattttcaggaactaccaccctgaacagttagcagtcatcaatatcaaggcaagaccatccaccaacaaaaagattatgactcactagaaatacccagtgtagatgacggttgatgggtgcagcaaaccactgtggcacgtgttatacctgtgtaacaaacctgcacgttcttctgcacatgtatcccagaacttaaagtataattttaaaaaaagtttaaaaaaagattatgactcagtaaaccctcagatgatcattagcatttgtagcaataaagtcttaaattaaggtgtgtacattgtttaatggacgtaatgctactacacacttaataaactacagtatcgctaaaacataactttaatatgcactgggaaacccacaagtttgtgagactcacttgattgtgatatttgctttattgtgatgctccagagccgagcccacagtatctctgaggtatgcctataatagctaagtaaatgtcttaatctgtcactagtactgcttatatgcaaaataatatgactttaattataaattaatctattatgaatcatgcctcaaggaactctgagacagtgattctgtgttttaaatagcaggataactgctttattggaacaaaaatctcttttctaatttgatttggccaatcatattgattagtgagattttatgacaatcattgattcgtaagattgattagtgagattctattacacttctttttctgttgtgactggatgcaaattgggcagaattatattcagatttttaactgaggcatttttattgacagcaattgaacctggccatgattaactatgttttggtcgtctatggacttgccatttctctccttggaataggacagcctgaggtaagatttgtaacagtggtaataaacaattaaaatgatattgacatatcttataaaaattattttctcatttttacccattttcttctctgtaccttctgataattttgtctgaaatatctcagtttaatttagtttgtgtttttaaagaatatttagtttcctattagaaaaaggctttgccaggcaatcagtgggaatctactttttatttgtgtaaaaattagtatgtaatgtatcatgattgatagatttcagaaacataatcttgagggaaaggcaagttggaggacataaacattgtgatcccacttatatactttttggaaaacatacataacagtactatatactgtttatgaattctgtgcatcttgtaaaaaagtgaaaaaatatggattatgtttatataaaatttaagataatggctgcctttagtgatggccaggagggaatggacctggggaggtttcgtgttatgctgttttcctagaaaaacaaaggtaacaatgataacgttagtatctcttatttgtacgtagaaagtacttggatattgtattatttctagattgcaggcttcctataactgcatgtagtcagtgtatagacatgagctcccaggatttccattagtcatgctcctgcctggctctcctggaatgtttacctacctatactgtttggcattataactttgctttctgaggttttgagtttgctataaatgttgaaatgctctagaattacctcaagtataatatataatttggtctctatttttccctgtctagatgaaggtttaactctaacttgccacctagtgaggatctaagtagtcttttacgttctgttctctcccagaagttgacagtgcccaagattcattttccttgatctcagtgtcacagattaataatgtctcccatgaatgctctctaattctattttccaagagacagttggagacagaacttcatgattttcattttattcctgacagaataataataaataccatattttaccttattagaattgaagaaatcatttattacatttgtgatttaatgtaaaatagcgagactgatttagaaaaaaaaaatgtgttatagtagaacttacatgtttaaaagaatttcatcagaggacagcccttgcttcaaacgtttttagaatgcctcctttggaactggcctcaaagctccattttgtagtgacatttctttttttcactcacagtagggttaccagtatttcttagaactatgtatcttttggatgttttccaaaaacaaaattcattcaacttagtggtttttcactgttgagaatattcaaaaaagaatgtactctaagctatgttaagtgtttactaatgggctgtttttaagacagagctttcatccgtcttgtgccacaaaagactgtgacaacgtcattggaatggcattccttccaagggattagcacttaataggatctatgttatggtgtgtttacaccataattagccttttttaaaaaacaaaaacaaaaacacgatttgactctttttagtattagccagcacacgccaggcccttagtgcgtactagtaaatgcttataggttgattgtctgatgtgttcagcaggattggtttggttgtgtctctgactatccatatgatcagaaatttatataattcctaagaaagtgaaacacagaggtataattttgccacaggaatttggggatatgcagttgttattttaatattataaaaaaaatcaacctttagataaaatttatttcagtatttctctttgtatgtaagtgatcattgttttcactgctattcaaggaattatctgaagccgaaaaccagtttaagaggattattgaacactaccccagtgagggccttgattgcttggcctactgtggaattggaaaagtatatttgaaaaaaaacaggttagtagaaatgacactactttaagctctaggctggtaactcatttaaaatccaatgtgataatgatccattttctagaattattttgatatctcctctgtagcacactatcataattgtgatttactttgaggacctgaaatttcactatcagtattaattgttaaagcaaggccagtcattgcagttcttggtacttcctgattttaaatctaataagtcaacaatatagtaatttgacattaaagatttaatagtctagtgtataatcatctatagatagtgagtgaattgatataaactaatgtttttaaaatctgattgtttaatttttttgatttaattattttttaaaaatctgtatgaagatggttttaaataagaggtatatatgtgttcaaagacatcatgagtgagttaggaatataaaagtctgtcctctgaactctattgtagttgtaatccttacctgcagtttaatattgaagctgttctctaaatgcctcatgtctcttagtcttgtctccccgaatgtcagtatgtccctgaggggacaggattatgtcttgagctttaaaaaaagaaaatctgtttctgccacttgtacccaatatagaggtaggtatgttagattataaagaaataattgttgactgattgaatattatttataatttctaactgtctttaaattttcatgtaacttgttaggggaaattttatgagattttggggaatcccccccccagccatcttagaatgtgcctagaacctcctttatagttttttttaaattaaagaaagtttttttttggccaggcacagtggcgcacacctggaatcccagcactttgggaggccagtgggtgaatcacttgaggtcaggagtttgagaccagcctgaccaatatgttgaaaccctgtctgtactaaaaatacaaaaattagctgggtgtggtggtgcgtgcctgtagttccagctactcaggaggctgaggcagaaagaatcacttgaacccaggaggcggaggttgcagtgagctgagattgcaccactgtactccagcctgggcgacagagtgagactccatctcaaaaacagcaataacacagagacacaacaaaaaaagagaattttagacaatatccctgatgaacatccatgcaaaaatccttaataaaatactggcaaaccgaatccagcagcacatcaaaaagcttatccaccatgatcaagtgggcttcatccctgggatgcaaggctggttcaacatacacaaatcaataaatgtaatccagcatataaacagaaccaaagacaaaaaccgcatgattatctcaatagatgcagagaaggcctttgacaaaattcaacagcccttcatgctaaaactctcaataaattaggtattgatgggacgtatctcaaaataataaaagctatttatgacaaacccacagccagtatcatactgaatggacgaaaactggaagcatttcctttgaaaactggcacaagatagggatgccctctctcaccactcctattcaacatagtgtcggaagttctggccagggcaatcaggcaggggaaagaaagaaagggtattcaattaggaaaagaggaagtcaaattgtccctgtttgcagatgacatgattgtatatctagaaaaccccatcgtctcagcccaaaatcttcttaagctgataagcaacttcagcaaagtcccaggatacaaaatcaatgtgcaaaaatcacaagcattcttatacaccagtaacagacaaacagagagccaaatcatgagtgaactcccattcacagttgcttcaaagagaatacctaggaatccaacttacaagggatgtgaaggacctcttcagggagaactacaaaccactgctcaatgaaataaaagaggatacaaacaaatggaagaacattccatgctcatggataggaagaatcaatatcgtgaaaatggccatattgccaaggtaatttatagattcaatgccatccccatcaagctaccaatgactttcttcacagaattggaaaaaactactttaaagttcatatggaaccaaaaaagagcccgcattgccaagtcaatcctaagccaaaagaataaagctggaggcatcacgctacctgacttcaaactatactacaaggctgcagtaaccaaaacagcatgttactggtaccaaaacagagatatagaccaatggaacagaacagagccctcagaaataataccacacatctacaactatctgatctttgacaaacctgacaaaaacaagaaataggcaaaggattcactattcaacaaatggtgctgggaaaactggctagccatatgtagaaagctgaaactggatctcttccttgcaccttgtacaaaaattaattcaagatggattaaagacttcaatgtttgacctaaaaccataaaaaccctagaagaaaacctaggcattaccattcaggacataggcatgggtaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacgaagggctaatatccagaatctacaaagaactcaaacaaatttacaagaaaaaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccgtctcacaccagttagaatggcgatcattaaaaagtcaagaaacaacaggtgctggagaggatgtggagaaataggaacacttttacactgttggtgggactgtaaactagttcaaccattgtggaagtcagtgtggcgattcctcagggatctcgaactagaaataccatttgacccagccatcccattactcggtatatacccaaaggattataaatcatgctgctataaagacacatgcacacatatgtttattgcggcactattcacaatagcaaagacttggaaccaacccaaatgtccctcagtgatagactggattaagaaaatgtggcacatatacaccatggaatactaagcagccataaaaaaggatgagttcatgtcctttgtagggacatggatgaagctggaaaccatcattctcagcaaactgttgcagggacaaaaaaccaaacaccgcatgttctcactcgtaggtgggaattgaacaatgagaacacatggacacaggaaggggaacatcacacactggggcctgttgtgaggtggggggaggggagagggatagcattaggagatatacctaaggtaaaggaccagttaatgggtgcagcacagcaacatggcacatgtatacctatgtaacaaacctgcacgttgtgcacatgtaccctagaacttaaagtataataaaaaaaatatatatatataaacaacaaacaacaaaaaagtgtacacctgccacaataaagccagtgtccaagacgagttgtgtttaatgtatattacttttatagcaaacagcaatagtgactttgtttttttaaagaaaatttaggttacattgaatattgctgttcagtgattcatcaaatgtattcgtcccagtaagcttgagatctttggtgacttttgaagggagtgaaaataccattttacatctttaatgcctttttcataattatgactttagatttctagaagctctcaatcactttgagaaagcaagaaccttgatttatcgtcttcctggagtgttaacttggcccacgagtaatgtgattattgaagagtctcagccacaaaaaataaaggtaaccatttatttttgcagagtgtttcttactgtgaatgcttatctgcattgactgactcaggtatcaggaggcggagaggtaggagcattccatccccacctcccttacacgcatttcccctctactgtctaatgagaatctctgacatttattgaatgttttctgtgtgccagtgtgtaccttcatttatcattatgcttaatccttatagcagccccgtgcaggggggcactgtgatcattcccattttacagatgaggaaggttaagtttagagaggtgaaatgatgcactcaaggtgaaacagcaagcaaattgtggtcctggaacttgagtccaggcattctgacttctgagtatgcatgatcatgcactctgctggacttggttgtacttagaggaaggtatagtattgttgtttcatcataaagttaccacagttactgagatggtacttgaagatttagaaaaatatgaatttagtctcatatccagaagcataaagatgctttgcttgttctagaaagacttacgtgtgaaatgactgagataggcttttacttgtagtgaactctcacatgtactcagaacttgattttggctgaagcttttaaaatcacagaagtcaacttttacaactcaataataaaaagacaaataatctaagaagtagtcaaaggatctgaatagacatttctgcaacgaagatatacaaatggccaaaattagcacatgaaaagacattcagcatcattagctatcagagaaacacaaatcaaaaccacagtgagataccacttcacactcattaggatgtgggcagacaataaatattggcaagggtgtagaaaaatgggaacattcagacactgctggtggtaatgtataatgatgcagctgctttggaaaatagtctggcagttcctcaaacagttaaacatagagttaccatgtctcagtccatttgtgttgctataaagaagtacctgagactggtgatttatgaagaaaagttggcttatggttttgcaggctgtataagaagcatggtgtcagcacctgctggtgaaggccttcaatagctcctactcatgtcagaaggcgtaggagagcctgtctgtagagatcatatagtgagagacagggaagtgccaggctctttttaacaaccaactctttagggaactaatggagtgagaactcactcaccccagggagggaattaatctgttcatgagagattcgtcgccatgactcaaaacacctcccactgtgcctcacctccaacaccggggatcagatttcaatgtgtggtttggagggtcaaacattcaaactgtagcataccatatgatccagcagtttcactcctaggtgtgtacagagaaaggaaaacatgttctcacaaaaacttgtacatgaatgttcatagcagcattagtcataatagcccaaaatgggaaatagcccaagtattcgtgagctgataaatgggtacgtaagtattggaacctgggaggttgaggctgcagtgagccttgattgtgccactgcagtgcagcctgggcaacagagtgagagtctgcctcaaaaacaaatggccagtcttggtggcttacgcctgtaatcctaccactttgggaggccaaggcaggaggattgcttgagctcaggagttcaagaccagcctgggcaacatggcgaaacccatcaatacaaaaattagccaaacatagtggcacatgcctgtagtcccagctactcaggaggctgaggtggaagggtcagttgagcccaggaggcagaggttgcagtgagctgagatcgtgccactgcactccagcctgagtgacagagtgagacgctgtctcaaaaaaaaaaaagagtactgataacatgctgcagcatggatggaccttggaaacattatgctaagtaaaagaagccaaacacaaagggcttgtgtgagtccattcctatgaaatctccagaataagcaagtctgtatatagtgacagaaagtagaccagtgattgctgggcctggaaggttaggggaaaatgaggagggactgctaatgcgtatggagtttctttttgaaaatgttctaaatttagaccgtggtgatgtcagcacatcctgtgaatatgctaagaacaccgaaccgtacacttcatttgagttgtatagtgtgtaaattatgtctcaacaaagctattataaaaaatacaacacagggattcttggatttacctctcttcatacaagattgggatagaggcataggagctattgataacaaaaagccagcactggaagcatggcatgagtctcttgggggcttcattagcagtggaataattctccagggagtccacaaacaacagtggcagagctgcaaggaggaagataatgggagtgttaggattctggatgaggtgatgttgggcaagaggagcctggtaaagtcctcaggattaccctaagggttattctgccttacttgacttcctcttaatgcttatggaagatttctgagagctgtaaattataaaatgcgatttgatgattgtaacaggacaaaattttgattctttcgaaattctgaaaaaaaattttgtccagtcctctttttaaatctctcttatgtctcttatcagccttccttttaaaaggaaaaactttaaaagttgtatgtagtttgttgttggtgaaaaaatttagtcattcttatgctgaaaatattttgatggcaagaggttattgaaatcacaagcatttttattgacagattagtattgtaatggtatcatttttgtttattttgttttagatgctgttagagaaatttgttgaagaatgcaagttccctccagtgccagatgccatttgttgctatcagaagtgccatggatattctaagatccagatatacataactgatccagactttaaggtaaataatgagtgtacagtgggacattaacttgcaaaatcatttcttaaaatgggctcaaaacaatctgtaattggaggcacccaagttctctggctagttagcagtcgtccacccctttcccaggattttttttttttttttgagataagtctcactctgtcacccaggctggagtgcagtggcacgatcttggctcactgcaacctccgcctcctgggttcaagcaattctcctgcctcagcctcccaagtagctgggattacaggcgtgtcccagcacgcccagctaatttttgcatttttagtagagacagggtttcaccatattggccaggatggtctcgatctcttgacttcgtgatccaccccctcagcctcccaaagtgtgggattacaggtatgaaccaccacgcccagccttcctggacttttttaggtctacatcgtctcacatgggaaccagagccactgatgtataaacgctctgggctggggtagtgacctgagaaggcaggctggctcattctttttcctcttcaagctaccttaggaggataggaaacaaagtgagattgttacctctgatttgttgcaattctgatctctcataaaatttgagtcccaaatctaaaggtcattgtgatcattgaattagctgttagagacctaaatttgagataagtctggcacttaattgagttatactggtttattcaagaagctagtagctgcccttgtcctgctgttccaatgtccctggttagtaaatcagatgaaataatgtttataaaatatttgatatattttgaagaatgatgcaactttatgctgtggaaataaatatgttagtcaagctctctctgtctttatgtatgttgtagtgagtgagtgtgcagagacatctttaaaacgttaattaaaaaattttttgtaaccctagggttttatacgcatcagctgttgccagtactgtaaaatagaatttcacatgaattgctggaagaagttaaaaactacaacctttaatgataaaattgacaaggtaaagcataacaggattgtctgaatttttcagtatacttattgtatgtcaatttttcccccaagaattccttcctgaacattctgcacataattagaaaattttaaattataactttaataataaagtggaaaatcaaatttgtttttatttggacaatcataaaggcattaaccatagaggctttgtttttttaaagagacggatctcactgtgttgcccaggctagagtgcagtggtgcagtcgtagctcactgcagcctcagactccttgacccaagtgatcctacttcagcctcccaaagtgctgggattataggcatgagccactgcaccaggccccacttgaaagttttgatgtggaattagggatttcaaaaccaaaatttgatgaggtaatttgtactaagaagtcaactcaaaacaatttttttaatgttgggaagaaagatcaacttcaattttaaactgccatttctctccagggattttcttattaccaagataatgatgttaattaccattaagtagacatactttgagggaagtcatagtattacaatcttatttgtattcatagaatttgtttctgatctatagaaactatggaccttttcctacacttcttaggcttatgcagaccactgttcttattggggaaagaatgaggcagttgtactaggcatctgttaacaatagcaattattaaagtatggtagaaataaattctcacattttgtacattttcacataattaattaacaatataatgatatgagtaaataactgtcacctttgagtcacttctgctatgtctttgtcttacctaaattgagtttctctagtgatataccctcttttagtggtcttaactattcccatcattttaaatacactctgtaaattagtcagctttccctaggatatgctgaagtgatgcaacccaaatatcttgtggcatacatcagagaagtttgttttttgcttacatgacttgtcctgcagttctgcagttgttggctgggactgggctgtagcagctttattttgtgtggctctattccttgtttctcaatctaagttgaagaatgacccttttctggaacatcttcctgtgtcagaggaaaaagaacaatgtccagtctatgaagtgtttgttaaaccttttgtctagacatgtgtatgtcatgtctggtcactttgcattgatgaaaacaagtcacatggtcagacccacacctgaaagtatatttttcctacacggaagccttaaaattcgcatggcagtgagtaaggattttcaccacttgcctgaagatggttttagtccgtattttgactgttcctagtggtaaaaatagtatacgtgtatagatttatcccccctagacataacatttttcttgttttttttttttttaatcaaataggattttctacaaggaatatgtcttacccctgactgtgaaggtgtcatttctaagattatcatcttcagcagtggtggtgaagttaaatgtgaagtaagtaataaaggggaaaccttgttagatagataaccaaaatgtttacaccttttgaaacatgatttgaatttgtagatatcatgtaatttggatcttttccaggaaagaaacaattacttcatttaagaaaatataggaaatactgggatgtgagaatgcttcattgtaatgaaagcattcttatattcttttatttcttaataggaaaaggaggctttttatatcttagttttactatttttactgtttttgataacttcattttcttaatcccggtaaacttttgggcagtagtgggtgtgcaggtttttagggagggggaagagcgtcttgagggattacctttaacttcatgacatgggaatggcaagagtgggtagttgtaataatatttacactttattagatcgtctgcttactcttaattttttaaaaactttttcctcaagtgtgtctaccctcttgttcctcttcagtaaattattttgctaaagctttctgggcttttgtctgggtcagaacatcatcactgttctctatcaaactgaacattatgtgtgcttctgaaatacttgttacttgtggttttgtgttttatgtcatgggagtatgagacaaattttggatgtctttgttttatttaaagtttgaacacaaggtcataaaagaaaaggttcctccaagacctattctgaaacagaaatgttctaggtaagatttttaacaatcaatcagtggtttgatgatgtctcttagaatataattctattaaatgcagatttctaaattatgcctttttaaaaattggctgtgtatacatatattcaaataagtgttttttaaaatgatttttatggaaaattaaaacttaaagagaactagcctagaatgattaaatactaaaaacttgattcagaattatttatctagtggttgaatttacaattaaaattataacatttgatgctgtgaaattacatgtttgattaatagatttggcatttatataaaaactatacagtttgctctcagttgttgaaactttaattccaaaagcatatttttctttttatctctcttcagtaaacattttgaacctatgactattttttaccctgaaatactcaatgtactgtctaaattattacttctctatagctttttgtttagatcaaataattcagattcttttttcttttctttttggtcctgcttcttgtttttctttctaagaagtgatttttttttatcatttgtgaccaagaaaaagcaaaagaaaagatgaacagaattatttgttggagagaattcattgtaaccagatcaaccaaattatagtgttgtgggttattattgagatgtgaaaattatattttactatgggacctttcttagaaatgagagtttacatgaattattttgcagagtaatttgtactatttctgtttaccctatgaagtaacttagatacatgaaagtgacatctatacaatctgtagactgcatccttagacatcacctaatcattgaggtttttgttttcatgaaacaagtacccttattttgacaatactgacagtttcttacattgaatggaagatgtaggccgggctctgattaaaaaaggaaaacttctaatatattgcttggaagatggtttctacgatagtcaaaggaaaacagttcattgagttgtcactaattgtaaatgtttatcagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaaggtatgcagaagccaaaggcatgataagaataatatactctcatttaaatgtataaatgtaagcatcttttgggccttatattcatcattattgaattgaaataaagatttcacttagtaatttaatactatcactgtcttctgttactcgaagacagaattgggttggtgtaaagaacactgaaaaacctttcagagattgtattcccactgaaaaacctttcagagattgtattttaactttctgtgcttaatgactaaacatatttattgtatataaagttaaggtagttgatgaggctgggttaggattgttgaaggaagtggccgtattttaggggaactaagttgttttttttttttgttttttttttttgagacggagtctcactctgttgcccaggctggagtgcagtggcgcgatctcggctcactgcaagctccgcctcccgggttcacgccattctcctgcctcagcctccccagtagctggaactacaggtgcccgccaccatgcccagctaattttttgtatttttagtagagatggggtttcaccgtgttagccaggatggtctcgatctcctgatccaccctcctcggcctcccaaagtgctgggattacaggcatgagccaccacgcctggcctagaggaactaagtttcaaatgctactacatgaatggttcagaatgaagggtgtaaaatgcttacttttggtatgtttattttagcgtacactttcatgtcttttcaaaagtattgttaagtgtttatatttctaattaaagtttcttgagtttagtaaaacagtataatcaatctgaatcatattttatattatgtaattttgttatttctaagtttatgtaattgtgaattagtcctatttatcactttaaccattgttatttatccttagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggtatgtccctttatattccagagcaataaactttaatacgaaggggaagtgtaggtctctgagtcattttcattttcctgccatataatttataactttaaatgcaggactataaatttgtatggttaagaatacttttccagtcccagctacttgggaggcggaggcaggatgattgcttaatctcaggaatttgagaccaacctggcaatgttgcaagacctgtctctaaaagaattttttaaaaaaagaactaaatatatgaaggcctttaaaaaacagaaaaactattacacacacacgcacaccacaatttttaggttattttatagataggttacagtatacttcttcaaaaggtgcaatctaaggaaagaccagtcagtaaagaaatccagacctatattagactaaactatttgtaaatgtgtagatgtgtgaatactaggcacaaccatggtaaataacacatcctggagtctgccccctgctcaggagctgtgttgagaagacaaatctataattcagattctttgaagaaaaatttagaggcaagagtggatgagactaattgctcagggtcacctaaggcaaatctgtatctagagattaagaggaacatatcctagggttggactgagctgtggtaaatcacaggattatataactctgtactgtgttctgactttcgtaacttggctgggagaagggaagagtgagcaagccccctgccctcccctaaagcaggcgctttgcctaaagccatgcaggactgcagaaggcagctgcagatacagttgttgtgtaacacgaggtagggatgctttgggcacctaccagggcactatttatcttgctgactggatagcaactggcctagcacaatagttcattcagtcggcagctattagataagaggctaaagtacgccacgggaaaaaggcagggcctttagccgcagaccacagagtgaggcctgctaagcctctgccagccgtccccacctgtctgaatgtttagaaacgtggggctattagaattctagggtttcagagaagatactggtcagcttctgccagaagagacgatgtaagatggcagcaagcctggcatagttagacagctgaacatgcctgctttgaacatagatcctcatggatttgtgatcccggaaagttatttttaagtgacaagattgtcactagtgagtatcaagtaagcaaattataaagttaatgcttgctttaacatgctttaggagatactcaggactggagaaataggtttgcctgggttatgctacacggtcaagactgccagccactgttcattcaggtaaatgcagcacttgagccctccagctcaactggcaggaaagggtgaacatgtcttttgatataaaccatgtgttttttttgtttgtttgtttgtttttttgagacagagtgtcgctctgttgcccaggctggagtgcagcggcgcgatctcggctcactgcaagctccgcctcccgggttcacgccattctcctgcctcagcctcccgagcagctggtactacaggtgcctgccaccacgcctggctaatgttttgtatttttagtagagacggggtttcaccgtgttagccaggatggtcttgatctcctgacctcgtgatctgcccacctcggcctcctaaagtgctgggattacaggcgtcagccaccgcgcccggtcgatataatccatgtttattctgtagattaaaggtatcattttaataaggatatatgtatactatttaaagtagcaatttttatttaaagttgtgaaatgagttcaagcatgttaattagtaaggctgttactacagtcctgaagtaaaatgcacacttacttaaatagtaagtaaagcagttttcatttcctggaattttcttcaataaaacgactattgggtggacttacatcatgcacatatttaccataagagaggtccagtttttatgttcagcaaaagatgaagggaggaaaggaggaaaggagggagggagagagagaaataatagagcactagtgagataaatttaacatcccaatagtgaacactgcctgcctgcattcccctcactgaccacaagctctgacgtggatagggaacgggaatgtgctattttttcattcggctctcataaatcttttattgtgtgagtattctacatggtcccttattctggtgtttaaagatcctaattttcctgcaacatgatctctgcaagctaactctttaatccagaagcaagcagtctaggataattttgactctgagcaatctctgcttcatttgttgacttcatttgttgactaaggccctcggaagaagtgaccgttttatattagaggcatgatggagaaactggacagagctcctttttgctggctgttcatcaggagtggggcttcaccgtcatttcagtaggagtctgtatgagattgtagtcacctgttttctaatttggagagtggagaataaaagtaggcatactgaccaccttgatttttgtagagaggggtgaggacccacattttggggaataaggaatgttattttaggtgttggggaatgggtttacccatttcctcttttagacacatttgggaagattctgcatattgttgatgttttattactatggaatccatataaagaatcataaaatcttgctagtttatactaattggaatgaaagtctttatgaattagtgaaaacattgtttgggtttgtttttttttttagagatagggtcttgccccatcacccaggctggagtgcagtggcgccgtcatagctcactgtagctttgaagtcctgggctcaagcagtacccccacctcagcctcccaagtagctgggactacaggcatttaccaccatgcctggctaactctttttttttttgtaaagataggggtcttgctatgttgccagggctggtattgaactcctggctcaagtgatcttccagccttgtcctcccaaagtgctggggttacgggcctaagccaccatacctggcctcattgttatatttttaaaggaatttaatgctatactttcatctcctaggtctaataaaggtaactatgatagtagaaggctttggcccacattattcaaatctaatagacaagaattattataattagcctaacaatgttaaatggtgtttctaaaatgcccaatagcttgaacgaatctgttctcaactatttaaatgtttttgctgagaatataagcaaactataatcagctggctttcagagatgtgaaactaaatgtgattttacagtaaataatttccctcctcttctgatttgggttttgtttttattacaggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatgggtatgtggactgagtttagacttatattacatttaatcttaagggggaaaaaatctgtgaaggacctagcttgtttaaatatataacaaagaaaatagtgaaaattattatggtacaatcagtttatgtggggaagttagtgattaacagtagcaatttttttatatcatgaagcttttttactttatcagttaaagagatactcaaatgtaggtatgttatgctaacaatacacaatgttcttcccgtcttagatattttcacagcatcatgggaaagattgcatgttacactgacagaatctattagtaagtggtttgatttatagcattttagaaaacattggtctgcagaagtaggtgatgtttgcagaatctagaatggatagcattctaggatgttttaatgggaagagcctagaactgggggtcaggaaaagtaggttgtggcacagcttcttccttagtttggttcattaaaaaccctgtgggcccagtgatgggtgttgagaaggaattcagaaatgcttacacttgtctctgcccttgaggaccttgtgttctagaaaagagaataagaagcatgcactaataacagtaacatggtagtaaactcaatacgggagggccagagaaggtgccaagggcatcaaaggaaggacccaacactttctttctccctgggagagaggaaagctgtggtgcaggggtagagtctcagatgggctgtgaacgtgaaagtggaattagaaagctgggtgtcagggcttatttggaattggggaccctatttgggtaatggcatggagtccagcttgaactaactagctagctagcagctaattccttcttttctcttagatcttaatttcctcacattaaaatgagatgatttggaggcagtgacatgtgtggtcctgttttacttaaaaattataatattcctagattctaaatgataatttcttacctttcatactatatgaacatattatgataatccccaagtccctcagaatcagaagtctcctttatgtgttgttaggagttagacttttaaatgtcatgctgtttgttttaaagggtacattaaaaggtctggccttgtacgatggtgtcacagatgataaagttccaatgcatataaggagtggaaagcttacttttgacaacaaaagttcttagaaaagagcacactcaaatacagatggctttatcttttcaggatactgcttcatgactgaaggtgacatgctacttgatagcctgaatttattgccatcagtttgctgctgctggtaataaaatgctgtcccgggactgagcttacaaaacctgatgcatgtttggatcacaaaacaagacaactaaaaaggacacaattccctctcagcatacactcgtcctttaacttgtgttctctacatataatacacagcacttccagctgccactgtttctctgtttctagtcatgaggtcagaagccactaaccaaattattggcaatcccaatggattctcaagtgcagtagctctgccttccaccttcaccccaaacattttcagttttatctcttcatttaaaagaatagttatatttcttaaaacttttcaaaatctactgatcttgtagatcagagtgtttgacaatgtcatgagtgctttgataattgagagccccgactttttccctgacctcttcatgcatgatcccctagggtatttctgtgagacagccaaatagccccttaaagcagtatgactgaacccacctatcacatcttcagagatctgtttttcctcaatttatctcagtcaataatattgtatatctagtatttaaacaggaaactctgtaattagtctcaattctttcttttcagtattaagagtataacttgtttgtcatcaatccaaatgagctttgtccttgatctgtcctttgctgtccaccccacttcccgaggccaagaccttagttgtctttccacagttagaccactatagtagcctccaaactggactccatgcctctagaatctcccattttccgtcttcctcttatattgcagctagtgactcttctagaacatctgtctaacattctgttaactattcaatttgggaaacatttgtttagttttaattgcagattaagttcacatcatctggggtctgggttcatcatcatcctctatctctgagcacacaccccactactgactgtgcccaaacctgccttgtgctttcctgcctcctgtcttcactcacgtagttcccccagccatgccccacccctttgcttgttcatttcaagagtaacttaaatgtcccctctacctcagagcttctttgcccctcctgtgggcctctcccttgcagacttcagacttgagtccttcgtgagcctttgttgccttgtgtttcacgtggtccttagcacgctgggttacaggagtttgtctgtttgtctttctggcagtagaacaggagttcatcaatggtagggactgtcttgtgcatctctattcccaggactagcatagatggtacctagaaggcactcaacattatgctgaatcagattgaagttttatggttctttgtagttggtttcccgtttagtcagccattttgcccttggtttctaaactacacttgtgtcaaagccaaataaggaatagaacatggcctatgccagtagtatgaggcgttattttaaggctttagtgtactatatggaaatgtaaatatttagttttctcacaaaaccatctgtatattcctacagacagccgctgtactgtgttaaggaaacaagatagtggtgaagcaccggtaagttacttggatcacttgaatcttacgttctaatctgatgttaaaccaaggatgagaaggggacccaggccagtgtttattgacatcacagccagcattcaagaaccacattaaaaggacgtctgggtagtacgtactattattcattagaaagtcactgccagttttcctctcggaattggagcaataatcagcaaactatgaggcttaaattagacaatttctataaagtttcagagctgataaacattaatattctaattaagaaaggaagagttcttcatctcctggcataaaaatgaaaagttgtctttaataactaaacttctaatgttctgctctagaaggaaaacaaagggactttgttttgagtggctctaaattacgtttaagttaaaacagttccagagttgtcttccttagtagtttgcagttgccttttattcattcttcagaaattcttcagtttaggaaagtgagtaaatagagaaaagcacaacattgtggcagttttcaaagagaaaaatgcctgtttactgattttcaggagcaaatcatctatctatatgaaattttgtcttaatctgctccatcaaatattgcccagctaagcagggaaacacagctgaaatactccataaggagctgaaggcttctttattcactgtttgtgccccagtgtctggtcaggtgcagaatgtctagtttggcttagtaaaagaaatatattaataataaatttactattatggcatctaactggaattacttaaaagtctgattaattacttgaaataacagtccaaccctgtggaaaataagataaaaatgttggaacaacttaattttagtatacattagtattattaaattttgtttgttttctattataaatcgtagcacttgggctgatacactgtagtgttatttttgttaaacattttatgtacatttaacttatggctagtctgtaaaaactcatatggtttctttatgttgagcttcataatgctgttatttgagtgttcactgatttttccccccattttttagtttagttcaaccaaggtgaaaaacaaaagcaagaaaaagaagccaaaggattcaaaggtatggagtattttctgtattaattcttgtctaaactctccaaaatagttagttggacatatacattagaattgagcaattcttgggatattttgaaacatttgtagagaaagactttctaggacttaaagatgttttggcagtcttctacattttgaagaaattccaggttcatattatataatagcaagtcttgacactcgtattctttattgtcttttttatttttctaggtatttctgagtaaaaaaaaaaaattgtcataatgtcccaaaaaataaataagtctcaaaaaatagataacatatttaaactaaaaatgatgaatactaatcattatgacagtcccaggattgatagaatcccttccttcctctcaccaaaggctctcctccaagcccattagataagtagggcatttttatttttatttttgagacagggtctccttctctcacccaggctggagagcagtggtacagtgacggctcactgcagcctcaaactcccaggctcaagtgatcttcccacctcagcctcccgagtagccggaatgacaggcgcatgccaccatgcccagctaattttttgtattttttggagagatggggttttgctatattgcccaggctgttctagaactcctgcgttcaagcgatctgcctactttggccttacaggcgtgagccactgtgccagaagtagggcacaatttttaagtctttggtgggttcttcatggctcttgtgtgtatgtggggagcagaaagggggatggagtgagagagagtagcaaatcttcaaaggatgagaacagttaaggagttccaatacaacttttatttttatctttgactatgtatttagtttagataaaatgggagtttaaactgagtaacatttaaatttttttggagcattggaaactatcctaaatgttaatttgagcttatttttggctgttgaaacttttattactatgtgttcctgtttataagaaaatttggatagatcttatatatcagcaatttgtatgtgtgtttatataagtattcatcaattttaatgatttttctctttaatggaattttaaggtagaaaatcattgtcatttttctgtcttttaaaccagcctatgttagttgggtctggaacaacttcagtaacttcaaataatgagatcatcacttcaagtgaagaccataggtaagtataatttttaaatttttgcttcattttaactcaaatgtctttacttaataagttgtgttaatttaatatatataaacttgtgttttatttccctaactttcctttctaaagctgtgcatctgacaacctgatgtaattccatcttgattacatttatatagtgtggctagaaggcattaagaattcattcaaactgtgttaaagtcacgacactggtgacattcattcactaagtacatattgagaacctaccatgtgcaaggctctgtgggaaaatcatagaaaaatgtctagaaattattctttaaaatagtcaataaagagaatgtcctgttaatacttactaggcatttttgcctgtaagagaggaagctgttttgggagctgtatatgatgttatgttttcaccttatatattagtgattttcaatgccatctggttgtcaaaactgagttttcaataaacaaatatttaagaaataaaactagtgagtagcagtaacctttttatatcatactcctttatgaaccaaaaatgtacaacatggttttttttttctcatttcttaaaggagctatcagagcagttaaaaattacgtggtcatttcatggattctttaagtagggtaattgttttaagttaaaataatagcctgtcttagtcagtttgggctgctataacaatataccataaactgggaggcttacacacagaaatttatttctcacagttctggaggctgggaagtcccaagatcaaggtactggcagattcagtgtttggtgagggcctgctttctggttcatagatggtgcctttttgctgtgttttctcatggtggaagggacaaggcaactctctggggcctcttttataagggcaataagtccattcatgggggtagagcctaattacctcccaaggaatccacatcctaacaccatcacattggtgattaggtttcaacatatgagttttgcagaaacacaaacattcagaccatagcatagcctttactgagattaactcttatgtatcagacattgttttgggggtttacatacataaactctttcaatccacttatcctgcctaggaggtaagtgctattatattctgtccaatgtacagataaggaaactctgaggcacagtgcagagcgacttgcccaagaacacaaagcttataaatagcagagctgggatttaagtcatgcagcctggttttagagtccacactcaaactactacatctttttagagtgctaacatcttacatttaaaaaaaacttttgtttagatggagtttcgctcttgttgcccaggctggagcgcaatggcgtgatctcagctcactgcaacctccacttcttgggttcaagcaattctcctgcctcagcctcctgagtagctgggattacagccatgcgccatgacgcctggctaattttgtatttttattagggacggggtttttccatgttgatcaggctgatctcgaactcctgacctcaagtgatctgcctgccttggcctcccaaagtgctgggattacaggcgtgagccaccacacctggcttaaaaaaaaccttttattaataccatttaccagtctcagtctcactttaagttaatttatagcagttataatacaatcttcatttgtctttcagtcatttaacaagttataattaatgcaactttttttaaaaatatggagttttaagaattttgctctttggagcaagactaaataattgaaagtgcttacttagattgtcagatatgatatttctcgcctataactgtggaagggtaacttttctacactaagttccctggtgctatttttttgcaacatagagctgagtaatatattgccattattgtgtttatttcaattagacattcttctggttaaataataaaccaaaggtctatcatccacaaaattgggtgttttttgttgttatttaccagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgagtaagtgggttgaaatttttacaaccattattttatactaaggctgccaattaaagatcagaagttgtttaatttgtgcctgtttttagagattttgccacattttacacaaagttaatttaggattttttttttttttttgagacagagtcttgctgtgtcacacaggctggagtgcagtggtgcaatctctgctcactacaacctctgcctcccaggttcaggtgattgtcatgcgtcagcctcccgagtagctgggattacaggcttgcaccaccatgcctggctaatttttgtatttttagtagagaagggtttcaccatgttggccaggcaggtctccaactcctggcctcaagtgatctgcctgcctcagccttccaaaatggtgagattacaggcatgagccacctcgccccgccctgaggatttttaattattaaatttagagtcctaatgattattgattttgtcagtttgagctactaagtcgatactgagtggggtggataaaacaagtaaaaaattcaggaaaatctcagatagcttaccattttgagctttgtgttattagatagtgcatgaggccttccttttaagaaaataaatcaagggctgaggtctgtaatagagtattaatttaaaagccaactcttctcctggaagtcctgtcagtagcatatccaccatatggccctttcttctgttttcctgtattgcatcattcctatttagttctgtgctcttagatccttcttcatggtttttctttagagttgaaatgctgagcaaatcatatttccagagaactcttgggtgacagtgtggaaacaactgtaaaattatactattatttcttaaagtatgctagaatttgcttcaggcatccaaaagtaaagctaaagtatgtagttttcagtatttactgtacgcaaattcaaataggatttgtttttgagatttgattttctctttttatttaaaattcttattggcattattatctttcctgaataaattttttgttgttgtttttagaataaattatgtaattacatagttgaaagttatgaaataactttttgatttccttttgctttcccctgctcccagaaaagttttaaatgatcattttctaggaggtagacaaaattttctttatagtatcattgattgcagttaaccttatgtttgttatatttgttgttgaggaaaggttgagatcagtgaaaagtgaaacagtgttttcctttgggagaataaaagtttttttcaaatagacatattcaagtacttccttatagtaactcatgtaaatgtaaattttttccaagttacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtaagagttaaatagaaaagtcttcttaatactgaagttaaattttccttttcatttttcattgccgttatatttgcaagaatccttaaagttgattgactttataatgattactgaagcttttgcctgaaaatacttttaaaatatgaactcttttgtgaggcatgacaggtaatcttctcagaaagaagcttgggtccaataaacaatacccatctttgctactgaaattctacacagattgagaaataagacagcaggtggagccaaaacgtcatcctaagaattaataaaggtgctggaggagaaggtggctgtttgtaggaaagttcaagtgctagctggaagtgtagcctgcatcacagtgccttacctgccagttacaggagggcccacctggaggccttccagcgtggggtgcctgccccataggacttagcgcatgaaggaggaagggaaaatgtgctggcagctcctcagaaagagaaggaaaaaggaagactctgacctacacaggcccagcttctcctgtcaaaccaggggaggaatgagaatgttaaaaagagacagccaggtagaaacaagagggatgtgtatgagttctttcctaacaaggaagagatgaaatcaagattctcctatggttgcctttatagggtatgaattcattaaatccttattgaattgccccactcattatgttttctaggaagctttgaaaaaaataggttaagagcaatggatcataatcatttccagatatgctaattctaaataactttcctaatatacatgtttacggaaagcatggaacatgatctaaatgggaaaaaaaacttgaaaaaattgtgggtgtgttttaaagtgttactacttgatgggcttattttactagagcgattgagataaagtgaattttattttttgttttgcccacaggtatcttggaacataatacaccaagaagtcaatactgagccatataatccttttgaggaacgacaagtgagtcaaaattacattaaactgtttaaaggtttagttttcattaatttatctagatggaatgatgaactagaactattttggagtcagcttattccacacaaagttatcatggaataagcttgagaacataacaaaaaaatgattttgtttttattgttgaaatttgagaagggaaggaaaaggtaatttttttccagcatacttatttcaaattataacagcgttattgttttattttattatttttaaaattttatttatttttattttaattatttttgagacacggtctcactgtcatccaggctggccagctttattgttttaactggtataatgagcatataataatttataagtaagcttattcatgcgaataatacagaaagataaagaccttctctactataataatgattcaattagaaaacctactaatataatttagttcgttaatatgcatcataagagaaaagttgtcttatcaactcaaagttgctgtaaaggtattggataaaattcaggtcactgtcttgaccaaaactagtaagaaaatgggaattgatgaatatttctcaacatgctaatattttaagccaaaagccatcatcttgcttaatggtaaaacatcaccattaatatttattgttatcctgggtatattaactgagaaagcagatatgagaaagaaagaagatagaaaagaggagatgtgagtatcattatttacagaggctagggctgtgtaccaggaaaatccaaaatgatcaactgaaaacctacactaacctatataaacctatacttgtatataaaaatatatataaacaattacctgttagaaagtatgttgaaagaaaatattttcaataccaaaaaagagataaaatacttaaatgtatataaagaaaaatttttaaatgctatggagagacacatagaagccttaaatgaaaagatatttcatgtacttggataagaacacatattatgataatgagattggttctccctaaagctttttaaaatttaacacaatcccagtatatacatgaacagggcaaattagttatgtatattgctgtatatataacaaacaacctcaaaagctagtggcttaaaacagtaaaatatttcacaattgtgaaatctcacaatttcgctaagtcaggcattcaggagcagtttagttggatgcttctggagattctcatgtagctagccaagatgttgaccagggcttggtcatctgcgggagtaactgggcccagaggttctacttccaagatagctcactcacatggctggcaagcggatgttggcagttgtcaggaagcttcagttccttgccttgtggacctccacctagccctgcttgacctcatggggctggcttttcccagagtgtgtgataccaggcagaagcggcagtgctttaggaagtcacaaattatcacttctgcgcattctcttggtcacatagatcaatccaccaaccctgatacatggtaggagaggtctatacaaggctgtgactaacaagaggcctggttactgcacaggattaatttgaaactagacaaattgattttaaacttcatatgtaaaaatgaacatcaagaatgggtatggaagagaaactaagaaaaggagttgtgcaactaaatatcaaaacacaatataaatctatctatattaccacatacatagaccattaatatgagagtgcctggccaacatgttgaaaccccgtctctactaaaaatacaaaaattagccaggtgtggtagcttacctgtaatcccagctacttgggaggctgaggtaggagaattgcttgaacctgggaggcggaggttgcagtgagccaagatcacgccagtgtactccagcctgggcgacagagtgagactccatctcagtcagtcaatcaagatggtagattggctgggtgtggtggctcatgcctgtaatcccagcactttgggaggctgaggtgggtggatcacgaggttaggagtttgagaccagctggccaacatagtaaaccccatctctactaaaattaaaaaaaattagctggccgtggtggtggacacctgtaaccccagctacttgggaggctgaggcaggagaatcgcttgaacccaggaggcacaggttgcagtgagccaagattgcgccactgcactctagcccgggcgacagtgcgagactctgtctcaaaaaaaaaaaaacaaaaaacaaaaccgaagatggcaaattatcagtgagcaaaaactggattattaaatacataggagaaatggattgccatctagaaaaaatcaatcttggtccctacctcattccttataccaaaataagttccaggcagattaaagattttagcataaaaaatggacctataaaagtatccaggaaaaaaacgggaaaaattttttgtaagatcagtaaacagcatgggaaaaaagaatgtttatattcatatacacatgcatgtaatgtgtatatcctatatgcatagcatatgtatgacaacaaatacatacacatacacatatcaaaacacaggagagaaacaaggaaaattatgtgcagtgtgaaacagatagagaactaatttccttaacaacaaagtttctataaatcagtaaggaaaagatcaacaatctgtcacaaagatgagaatggatgtgaatagacaattcacaatgaaagaaatacagatgatttttaaacatataaacagatgcccaccccacttgaaataggaaaagcaatcattcacattttgaaagatagtgaaactgaaatttctgggaaggcagttaggaatcgatctgcactcatatatgtatagagagaccagtgagccaaggggatttgtatgtttgttttgtctgtatttgaatcagcagaaaattgaatacaatctaaacctccatcaatagcggactagttaaattatgatatacctataaaatgaaatatcatgctgtcatttaaaaagcagttctatagttagatatggaatgtttgacaagatcaatgtctagttaagtaggaagaaggtcagagcttgtgtttcctgctgctatttgtacaaatagtgtttagtttttgctaatgataaaataatatatagagttcttaaattttttaaatgaataataccaaaaattatgaaagagaaattgaaaatcatctaccttcccatcactcatgttaatattttgatgtgtagccttccaggatgtttgaacatttacatataattaaacaatagtttttaaaagatgggatcacagcatatatattttatttgaaatttgcaggcttcaattaatatattgtagacttgtttccatatcagtaaatacgatttatagcatcattttaaatggatacttggttttccattttattaatgtgtgatcatttatttgaccaatttcttgttgttgaacatttagattgtatcagctttttatgcttacaggcagtcttatagtgaacattttggcctgtttactgttgttgaagtcttatgctgtgcttagctttaaaccaggtaggctctgttgtttaatgagtcagtgcttttgaccatcaaatgaatgtttttatcagtgatgggaatgttcacaaatgctttcttaaattagctgttagttttaggaccttgatgctagtataggtgattgctggcttctcaaccagtgagaattgcatttgaatcccagcattgctactttctcctgggactttgagaagttgcatcacttggttctctgatctattaaaggcaaacataatgtatttctcacagaagtatcgtgaagtttaaatgtaataacatagaggtggcatttagcttcctgcctgtctctgttggtaatttggggcatgtaaattcattcacgacagcaagttactattcactgtgatccttttgctgaattaagaattaaaatggaggtaactaaagtcttaaaccataaagttttgctcctggttgatagtaaggttgactgtttaattaatttagttaagcatggactctatttatagtactaaactttcggtctgagcagacaaagtggcatgctccaaggcaaaagggcatgtatggtcaatctgaccataattcacagttctccaactgatcattcacagagtttcaaatacttgattccctgcttttttacacttgaaagatactaaggtattgggggaaggtacaggaaatgtcagagctggaccaggtttgtgcctgggatagatttctaaagcctggctgccacagggaggacagttacctgcagctggagaagctgccagcatcaaacagatgctctttcagagttatatgcagtttgaaaggttttaaaaaataattacataaatgacatttattgtttgccaacagaatggtttctgggtttggggttttttttgttgttgttaagctggtgcaagaaatataactgacaataattcatagataatattttaatttgtcattttgaaataaccagcaactatttatttgaaacacctaaaagtaaagccaaagttaaaatgttctgtttatatctaaaatatgtataatatgtgcagctttttaaacctaataaataatcgttggtgttaattgtggagagtgacatttaaatcaaactgttgatctggtattgaacccttctaaagcaaatattcagaactaattatagtatagattggagaatttatgaatttcaataatatgaatgattatatttataaaagtgctggttttgctaagcagtgtttaggggtttttaattcctgaatgattgtgacatttcccttgtaaattttcatctgctttttactctcctttgtttattttaagaaacagtaaagaacaagatcataagtaggcattttaaatgatttttaatagattgttttgtaattcacttttagggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaaggtaatcctgtctgaaacctgtctttaattgcatgtagcatagttaggagaatgtgagtgtagctgtgcttgtgcggcctcagctgaacttctgcattggtggctaaacaaaagattctttctcagaatcgcctgcttcagatttcttcatgacatattaaagtggctgttgccatgctttagaacttctgcaaactgccttatgagaaaggggctgtaagtctgggttttcgtttagctatagttcagtttccctggttaactaaaactctattttatggtgactgagctctgaggtaaattcttgtttatattgagaggcagcataggaatagaggttcagaatgagagccctggagacagactggctgggttcagatctaggcatggttctatactagttctaatcttgggcaatttacttaacttctctgtgctttagttccttacctggaaaatgtgagtaataataactcacattttgtatggttagattaatacttataaagtacttaaaactgcctcgttagtaaggactcagtaagtattgtctgctactgttatgatcatcatcttcatcttactcctaaggaagtataagaataacacatggagccttagacatactagaactgtaaagtcacccagagtattttgttgagatctgctgaccttgaattctgttagtcaagactgatcatcagatacatggctagtggagggatagcaattagtggcaaagccagattgaattagtgagaaaatggaatcacagatgtgaggaaatcatggtgcatttgtttttaaaagctaccatcatctgtttagaaaggtaacaaaagaatagtaattcatttaagaaaggaggaatttgttccagaagtctggatcaatagctgggataacatattaaatagaagaaaactagcttagtgggaccttaatcaggaaacctatttactaagattttagtagaaatcttagggtcagtttgtaaaggtaactgtcataacattccccaggacctgtttatactcaagatgaggctggggagagtctaaggacaagaagaattagatagatcctgagactttactcagtttcctggctgggagaagtaaagaagaacaaaatcctacacagcatagtgacacatggaacacaagtttctataagctacttgtgggtttaacaaaacaaaatagttttataaactttatattgcctcaggaaacttcagttttaattcccatgtgggaattcctgtagctgcctgtttgagtgatgaggcagattggagacatagtcttaaaggtagcattcagccggtgagatatctttctttctggccgaggctttcctggctttataaattgctggtctgactgtgtgttctgtgtgcacagttcatcaaggctctttctttgtacagtcagtccagaagagtctcggaaataaagcacccagtgggagggccccagctctcaggcttttttttaacttgttaaggctttgagtctgctgttgcgtggccctactcaagagtgccttaaaagggcaattactaagccccccagatcacaggcctgataagttattagacttgccacgtaaaatgtatacctattccctaccaggataagtcgctaatctgagttccttgggttggtgtccacataagagtagatgagatttagccacagtcatttctttattaatggtggttacgctcatagctcatggagaaatttcttaaaacatagaaagaaatgagtggcttttcctgatatgtccctttggcctttgactgcagattgctgaggttatgagctaaccaacttttcctttatactccagttacttgatgccatgtttggatgtagcaaatgcatacccagccccttatagagaacagaaaaacagggaagctatagaaatctgagtgcattagagtcccactgcccataccacaccctagcacctccatgtagtagctttgtgatgttagacaatttcttcagcctctttgaccctcggtcttctcattaataatgtattgtctacttcacagctttgtgaggcctcacctggggtggttgaaaaaggacaggggctagccagagatagtaagtacagtactcaaggaggaactgtcccacccaaaattctgcttgtgcctctgctaagcaaattgtttttttacaaaccactttaagaatacttagcatatggccaggcgcggtggctcacacctgtaatcccagcactttgggaggccaaggtgggtggatcacgaggtcaggaggttgagaccatcctggctaacacggtgaaaccccgtctctactaaaaatacaaaaaaaaaaaaaaattagccaggtatggtggtgggtgtctgtagtcccagctactcaggaggctgaggcaggagaatggcatgaacccgggaggcggagcttgcaccgagccgagatcacgccactgcactcccgcctggacaacagagcgagactgtgtctcaaaaaaaaaaaaaaaaaaaaaaaggaatgcttagcatatacaggccgggcacggtggcttacacctgtaatccttgtaatcccagcactttgggaggccaaggtgggtatatcacctgaggtcaggagttggagaccagcctggtcaacatggtgaaaccccatctctaccaaaattacaaaaattagcctgatgtggtggtgggcgcctgtaatcccagctactcgggaggctgaggtgggagaatcagttgaacccaggaggcagaggttgcagtgagccaagatcgcaccattgcactccagtctgggcgacaagagctagactccatctcaaaaaaaaaaaaaaaaaaaagaatgcttagcatatactaagcatcagtaaaaatctgagcgaggtattatatatagctgatggggttctattattattcatgagctaagaatggcctctttaggcaattaggccagttatctattctctgccggcggaaaagtggctttttaaatttttttttttattttttagatggagtcttgctctgtcgcccaggctggagtgcagtggcatgatcttggctcactgcagcctctgcctcccgggttccagcattctcctgcctcagcctcctgggtagctgggattacaggctgcacgccaccaagcctggctaatttttgtatttttagtagagatggggtgtcgccatgttggccaggctagtcttgaacttctgacctcctgtgatcctcccacctcggcttcccaaagtgctgggaaggcaccgtgcctggccaaaaggcacgtgaggcaccgtgcctggccaaaagtagcttttttaaagccagaatctcttgttgtttttattgtaccctaacctatgactggcaggttataactggttgcaatattgctgaaggacataggttcatttttgtttgagaataaaattctcataacataaaatttgctgttttaaccattacaaagtatacaatttagtggttttttgaatattcacattattgtgtaaccattaccactgtctaattccagaaaacttttatcaccccaaaaaagaaaccccatatttattaatcagtcactccctatctgcccaggacatatggtcttaaggtgctttaatgagatgctaaaatgggcattgagtcaacattaggtcttaaaacactgtcaaattatttggcccagaataatttacagggtagaattttggacctttgtctgtattagaacagaatcttggccctgcctgccaaaacttcctcagcccacactggtgcagaggtgggattctcctcttcagtcatgggtccttgtcaagttcagccttttttaaatctatcatttatgaagctcctactatgtgccacactcaattgtttttacatgtatttaatctcaaaacagtccttatacaatagtgttatactgtagtacataaataaatctccatgttactggtgaggaaatggaggtgggagcagctgatgcagctttccccaagccacaccagtacgaagtggcagaacaggttgtgtcaggcttcagagcccatgcatttgttctcccttaagagaaggtcagctccacggcctagttcaactaactgttaggaatgtttctcaccactttacagcagtgtaggcatatcagttaatcactgtcataataatgctgagtgactcccagccacaaaaccccagtgacacatgactgtaatcgctaagcgtagaagtctggatcagctggtcctgcttgggctcggctgggtcagttcaccttagggctagcaagagctctgcagcatctttgctgttcttgcctacatatctgggttcagctggctgtagattgatctagaatggcctcagctgggatgactgggacaactagctctgctccacatgtcttgcatcttccaccctgaaaatcctattctgaaggcagtaggaaggtgcaaaggcaagcaaagatggccacacggcacctttcaagcttctactgacttcaggtctgctcagaccccaccggcaaaagcagtcacatagccagccagagcccgggctggggaagatagactttgcctccttagcgaagggaactgcaaggtcacatgataaatggaatggctagagtgtgaaggatggagctatgaatgccatccctccactacagtaggtcagcgccagtaatttactaacactcagtaattaccaagagccttctgtgattggtgcctgcttcatcttccgccttctcccttgccagttctctacattgttctctaatttaatggataatgtttgtcattcgatttctcacttccaaaccttttcccagtaccatcccttctgcctggagtggttttccttctccctgagcctgactccctcctgcttctcctttgggcatcactttcttgaggaaacagttgttgatggcaacctcaggcttgcttacaggcctttgttaatgcagtggtggtaataatgactatgtgagatggtaattatcattttataacatctttattgagatataattaaccatagcataacatttacctattaaaaatagacaacttaatggttttgatatatgcccaggtctgtgtgtagcacaatctaagtttcaaccattttcatcaacctaaaaagaaatcttatactcactagctgtcactccccattctctcctgtatcccagcccttggcaaccactgatttactctctagatttatctattctgggcattttgtataaatggatcatgttacatgtagtcttttataagtgtcttctttcacctatagtgttttcaaggttcatccatgtacatccatctatgttaatatgtatcagtgtgtcattcctttttactgtggaataatattctattgtatgactatatcacattttattcattcactagttgattgacatttgcgttctttccactttttcactattctgaataatgctgctgtgaacattcatggacaggtttttctttggacatatgttttcatttcttttggatatatatgtaggagtgaaattgctgatcatatggcaattccacatttaagcgtatgaggaactgcgagcctgttccaaaaccatcctaccagcagtatataaggattccagtttctccattctcacttacacttatcatcgtttgtctttttatttaggcctcctaatgggtatggagtggtatctcattgtggttttgatttttatttccctaaaggctaatgatgttgagcatcttttcatatgcttattagccatttgtatatcttctttggaggaatgtctactcagatcctttattcatttttgaattgagtttgtctttctattattgacttataagagtttttgggccaggtgcggtggcttacacctataaaaccagcactttgagagaccaaggcagaaagatcgcttgagcccaggagtttgaaaccagcctgggcaacatggcaaaatcccatctctacaaaaagttaaaaaattaaccaggcatgatagtacgcacctgtggtcccagctacttgggaggctgagctgagagggtcacttgagcccaggggttttgaggctacagtgagccaggatcatgccattgcaccccagcctgggcaacaacagagtgagaccctgtctcaaaaggaaaaaaaagaaacaaaacagggctgggcatgatggctcacacctataatcccagcactttgggaggctaaggcaggaggattgcttgagcccagtagttcaagaccagccagggcgatgtgatgagaccctcactcgctacaaaaaaattaaaaaattaaataaataattaggtaggtatggggatacatgcctgtagttccagctactcaggaggctgaggtgggaggatcacttgagaccaggaagttgaggctgcaatgagccatgatcttgccactgcactacagtttgggcaacagagcaagaccctgtctcaaaaaaacaaaaacagagagtttttctatattctggatacaagttgcttatcaaatatttgatttgcacatatttacttccatcttccatatttgtaaatgtatctcctgtctccattttgtgggttgccttttcactttcctaatggtatcatttgcagcacaaaagtttttactttgagtacactaagtccaatttctcttattcttctgttacttgtgcctttggtgtcatagctaagaaacccgtctacttcaagcgcactgcttacccatttaggtctgtgatccatttcacattaatttttcaaatagtatggtatagtaattatcttttatgcatattttctctaccaaactgtgatcttgaaagtaaggactgtttttcattttgtttgttttttgaatgggggtctcattgtattgccaaggtagaactcctgggctcaagggatcctcctgcctcagactcctgagtagacaagactacaaacacatgccaccagccccagaagggtggttttcaaaattatctttggttgacagcacctagcttagtatacaaactaggagctttgcaaatgtttatcaaacagtgtgtgcttggcccctgaaaagctgcatttaatgaattgtgttttcatgttctctatcagcctacatcagaggacatcaggctcacattctgtgaagtttgctgctttgtttactgctagtatggagttggggatattatccattctttcatgtgacagatatttcttgaatgttctcttaagtgtcaggctctgtgctggtcttgtggggcgtttctgcagcatcctcttcttgaggcccttctgtctgccatcacttccagggcctctcttgtgcaactggtttgtttttatgttttatattgaattgtacagttcattatattttctctttgaccttgtctgccagaaagttttcatgttatttctaaagaatggttaggactgcatgccattcatttttatattactctcactcatggttttgtattgtcattcctctctctctattctgttttctttatctgcttagcattctttttattttgtcttttaaatatttatgtatatattatctttttttttacaccatggaatactatgcagccataaaaaatgatgagttcatgtcctttgtagggacatggatgaaactggaaatcatcattctcagtaaactatcgcaagaacaaaaaaccaaacactgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaatggctttataaggagaaaaaaaaaagaatgttttaatttcagtaagaatgaaacaataaaactttagaaaatgtaaaaaaaaaaaaattaaatatttatgtatatattatcaaaggtacctcaaatatttattttagaacaacactgaggtttaataaaaaagataagttttttcctaattgagaaaaagaaattgtttatagttatgtcaataaactgtaatatagcagatacagttgtgtatagcctatttgttttatgctaagtttgaaagaaaaacgttcaggagatcattctgtcttccatgcagtcagaaacaagctcgtgatagctgacctgtttagcattgtgaggcagctatggcattcagcagtggttagtacaaacagaagatgaactcatgtggtattttcgttgcctgagctatatgtgtatgtatgtgcacatatgtttataatactttgtgcttcttgatacttgaactcccttaggtacttgttgccaactaggttcttatgcctcagcataaccttgtggttgcacataatctcccagccaaagggatggatcccaggtgagatcattggctcagaataggagcacaggataggtgagaaacaagattggcttggctgccagcagcaaggcatacaaattcacattggtcctggtagaaccgaaccaggtggaacacaggattcttaagtagagtaggcatggtggtcacctcagtcacagtaatgactcaagaaattcaggatcaacaaggttgcagctaagaagatgtgggaagaactggttcctatgttaaagggaacattactgagctgttgttcaatttttgccacctaagaacagttgtcctgtgccaaaatcaaccttatccctgctgtaggattcagaaatcttaaaggaccttgactggttagcaaatctgcctttaaaaaacatgaaaaccttggtgtctaaggctgaagagggagtagtggtctcttaagttgatagagcttttgacctgagggccatgatttcctatggaatccatgtaggttgactttagtgtcctttcttacagagaagacctcgagtttctatagctgaaatgacctacgtgtgctctaagcctaagcaggaagttcaggctgtagggaacctgataggaagtaaaaaattaaaagtttccctaaagcaaatgtgaagttaggatttcattaagccgtcattgataatagtgagattttaaactagaaaatatttgtttcctttaaatattgctttgattcacgtttaaattaattattagaaatattaacatagggaatgttttacttataagtgactggtatttataagcatgtgccccacccaaaccccttgctacaattaaatagatgatacttcaaaaaagacatcaaacctttagagaatgtgtagattcagaagtttcaaaccagcaactacataggaagttgacaaagagggttaggtgtcaagtggtgctgtaccaaaccctccaggggaacggtaactagcattgtctccaaagaggttttcatttctctttgtcacactgcctgaaattctggcaggtatctcaacccaaatgcctttaatgaccagcaagaggattacatttatatttataaaagcaaacaaaaactattggccttgccaactaaaacatgcatacactccctgtagattagagaatcatttaggctggagagtaagtgtgaacacttctgggcacgtcggagtggttcttcggggtgtcttactgtaatcaggtacacgtagcgggtaggatgtggctgtctggtgtgacttggtgtcccaggcttggctggggggcatagtctgccacagggcgccagcttgggagtgtgttccactgaacttaggtcattgtttaagctatggcaccgtcacaattctagcctttcagtctcttttgttaaaaagtatattttgccatttatttaagtactttctaaatgtttttagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtaagtaatgattgaaaggcagtaatttttatttaaaaaaaaatattgtggcttttggttattttcacatttttgatatttaatattaaactacatcaagtaaagtaaaaatgaatactgttttcattgttttgtctcatttaaaaaagtattcattgagtaattatctcacctgaatttttttctaaacttaacattttttcagataaattatataaaagtgagagtagcatggaactgagaatccccaaggaactgacttccttccagtttgaacaccatccctttctctggccctcttttttcttatcagcaaaacatgggggctggtctaaaatctaaggttcttttcaaaagtaagattctgtgatgattatttataattacttttatcctgaatctataaattattaaaatttgtcttgtagtgtgaacgatttgataacatatacagatcctaggaatgattgtcaggtgggccaagagtgtgttttaagattctctgtgatccatccctaacctccctctgctcttaacagtgataggtcaaattcttcagcttgttttctaccactgtgtaagaaaacacccaaaagtcagtttctttattagcagccattgtatttgctcatggtcctgcaatctgggctgagttcagctgggccattcttctgctggtcttgccaggagtcctcatgtggctgaatttagctgggtgatgactgggggtggcctcagctgggatgctggggtggcttggcctcactttctctctgtgtagcctctctgtgatttttatttatgtggtccttccatatgatctctattatgatagccagacttcttacatggtagctaaggacttcaaatggtgcagaagtggaagccactaggcctcctgaaggttcaggcccagaactgtcacagcatcatctctgctaccttttattccttaaaacaagtcataggcttggtccagattcaagggcatgaataatgggaggctgggttcactggggggccacgctacacactcacctttcaagggcttttgtgtttttccatgccgcatgccatatgatcagatgactttcattatgagtcttgctagcattacatttaggcagtcctcaaacaatgaggaaaagtaaaacactgcctcagaattttcactccctgtgtcatgtcattttgatgatcaaagtagcttcactagtagaacacacttacggaaacaataatgtctgtaaagctttttacctctaatatttgagcatgaccagtcttggtcattttgttactaaaaagtgtggaaatatttatatttaacatactttttttgttcaattcagacatactgtcaaactagacaaggtaactagaggctgttaatgataagaaattttttttctgtactagcataaaagttaatttctgctggagaataaactttttattgttgacttttttccattttattattagatttctttacctttcctgtcacaatttaaagataagccacacgcttctctctaagttttttgcttttttttttgagacagagttttgcttttgtcacccagcctggagtgcaatggtgcaatctcagctcactgcaacctctgcctcccatgttcaagcaattctcctgtctcagcctcccgagtaactgggattacaggtgcccaccaccacgcctgactaatttttctatttttttttttttttttttagtagagatggggtttcaccatgttggccaggctggtctcgaactcctgacctcagatgatccacccatctcggcctcccaaagtgctgggattacaggcatgagccattgcacctggcctgctttttacattttccaaataaatgctttaaagctcaatttttctatttagatttttaagtaaaatctttaaactttttggatctctttctcagagatgcacaagggacatgaaaaatgatttcttggatgtttctgtgctcttgatcacacttagtattcgttaagaaatgactagaacatagagctcatgattggtacagtgacacaaaccacagatggctatgaaagaaggcagggcttccatgagagtgtcagagtgtcacccagtatttgtctatttagaggagggaggaagtgttttacaaaagaagtaaaataatagttaaactggcttgtattagaaacaagcggctttagtaaacagagatgactgcaaaggtatctcagggtagcatgaaagaagaggcagaacccgccttgtgcagggcatggctcaagaatcggagattcacacacttgttttgaaggattatcagagaatgtgagtgtgtgtgtgcgtgcgcacccgcgtgtgtgcatgaatgcttgttttgactttaagttctgttttaaagagtagaaggctgttttcattttgaatgagaatccacatcttctcattttgaataagatctctggttacactgatgatgatgccgcagtacctgtgttctctgcttgagctgcacatcttagactgagatagggtgatttacctgtaagcatatgccttagagtgaagaaaaaggtgatctggaaggaaaatttcccaaaagggaaatgacctcaaattattttcctatttagaagatactaaaaatgaaacaaaatgtaaaaatatatatattaaaaaatcaagaaatgtttttaaggatatgggtgcaatttactgtgtgggggtcctgttaaaaatttttcaaaattaattaatatttggtgattatgcttttataggtatacccagaaaaatgatggaaaggaaaaggaacatgaattacatctggatcagtcccttgaaatcaggcaaattaagcttaaatttatttttaatatattttaatacttttaatgccaggagtacaagcacagtagactttgaaatatattgttgcttgtctatttcttttaaataattatgtttctgttttctttatttctatttctgttgcattttaaaaattaatttataaatatattctttgaatatttaaatatttttattttacaagatttctgcatttatttcccattgtcaatataaaaatactgaatttattgttgtcaactttttttggattaacttgaaactataaacatgttgtaaaaacttttcttttgtgttacttggaatattcgtctccactgtaggctggtagtttgttgctgttattgctttataattataggttcattaaatttttactatgaatctatgcaaagtttccttttaacccttgcttgctaatggaaataatatgttttcacatactgctaaccagtacattcagtgataagcagttgcattctgcttttctcactattgtttcttacgcacattcccatcccggtttttgaataattttgtacagatttctttttccctttgggttctgtccttgtaatatgcgtcaaaacagagtttctggctcaaaggatagggaatgttttataaagcttactttttaaaatttttatttatttattttttgagatagggtcttgctctgtcacccaggctggaatgcagtagtgcagtcattgctcactgcagacaccatctcccagctcaagcaattctctcgcctcagcctctcgagtagctgggactacaggcacgcaccaccattgtattttttgtagatatagggttttgccatgctgtctaggctggtcttgaacttctgggcccaagcgatccgcctgccttggcctcccaaagtactgggattacaggcctaagccactgtgcccggcctatacagtttattaatgtcaccagattgtactccacctgccctcataaaaatggtgaactggaacagtaccctcaccttgattctcagcatgcccacctaatgtgcacttccatttcatatctgcctttgatcacttataaagcacaaagagcacacttgagcctgtgtattgtgtagtaaaatatgagatgagaaactgctctggaagatgtagctgaggctatcgtggtgtggtttcaaagctcatccagcctgaaacctttgtcatctcactgtgaaattttgttcaagaaagttttttttttccttcaatatttgtagcaacacacttacaaatgagaaaatgaaaatagaagagtatataaagaaagggaaagaggattatgaagagagtcatcagagagctgtggctgcagaggtgagtccatgacacttagtgaccactatggcatttgtcatttgtttttgtgtttctttaatgacatatgaggcataacagacattactgaaaagtgtggtgcataaaggatatcctgtaacccataatatatcctccctaaaacgaccactctttttccttgcctatagccttgtaatgttttaccggtattatgttgttacttaaatgcactcatagtgtacaccaaattttgtaacctgccttccttatttaccattataattcagccatttcctatattatacactttgaatactttcatcatatttaatcaagtgatgtaccatgaagtagccaaccatatttgccaatacttggaaaggaacttgaaaataatccacatattaagaatacgctccttctgcccctagaagaatatatagcaatgtcagtacactgtttcagaaactactgagacaaaaatcaaaattatgacatctggctgtattttatttagttccagaaacatgattctctatgtttctgtagctgagaaacaaatgatatttattggcatatgtgtctgtgattattctggtaaagtaagaaaagacttagtttatacagtctgcaaacattaggcttttcaattaagaattgactatgcacctgcttctaaggacaggaaaggaaaaagagccaaagtatgaatactttttgggtcctacaccagcatccgtattcctgagcttgtttaattcacaccaccgtttggtaagcaggtttgcctggtgggccctgtcaagtttactgacacctggattaaaaggctatttaatggatcatttggaccatgaggccattttacatttcctgcagtgattctcacaaaaatggccagttggtttgtggggaagccacagagagtctaaaatcttaaaagcataccccgaagcttttgatgcccttgccgagaacagcttctctgaggcttttctaaacttgcagaggatgcagcctttattaagggttattctgctgcaggaccataggtaatgcacactcgtgtacacatgcagttaacctggctctgtgcttatatatagcttaagcagaaagccatgtacagttattcatatctgcaaaaaggatcatggaaggtatgcatttgtgatgtcattttgttctgttttcaaatctcaaagtctaattcatgttcacctatgatacaatcaagttctgatgattctgtcatgcttcatttaaggagaaatgggaaagtggtttgaatgtttaagttttaacctttaaaatagtttcaggctgtcatttgtaaaatactcatatgtcttctgatctactggcaggtatccgtacttgaaaactggaaggagagtgaagtgtataagctacagatcatggagtcacaagcagaagcctttctgaagaagctggggctgattagccggtattgcagtttcgtgggtgttctcagcacgtcatttagaagataaagctaggaccatttgagaaaaacattattttgtattaggaccattttatttttaatagttatataattgatacatgttcaattgtagaaaagttaagacatacaaacaaaaatgataaaaatcattcctaattctaaatggatagataacatttgtattttggaataaattcatgaagtgtttgaaaaaatgaaaatttatgaattatttttactaaatagtatataggaaatttattttcatattggtaattacatatctccaacctaattttgaaaagttggatagtaattgagcatagaaacatgtcatgatttaccaaacactgctgtgctggaacagtggagttgtttgtgaatttgtgttaatataagccaccctgcagtgagcatccttatagttaactttttatgcacattattagtcatttccatgcagtaaaatttggaatgaagatcacattttcaaggcttttaaaattttttgccaagttgctttccatagtagctattatttaacagtctgcatgacagcatgcgagaatgtttacaaagtatattcacacatgttaattttttttcaactctccacataatctctacctgtttttgtttgtttttttgcgacagagtctcgctctgccacccaggctggagtgcagtggcctgatcttggctcactgcaacctctgcctcctgggttcaagcgattctcttgcctcagcctcccgagtagctgggattacaggcgcgtgccacatgcccagctaattttttgtatttgtagtagatatggggtttcaccatgttagccaggatggtctctatctcctgacctcgtgatccacccacctcagcctcccaaagtgctgggattacaggcatgagccaccgtacctggccttgttcttgtttgtttgtttttgagatggagtctcgctctgtcgcccatgctggagtgtagtggcgtgatctcggctcactgcaagctctgcctcccgagttcacgccattctcctgccttagcctcctgagtagctgagactacaggtgcccgccaccactcccagctaactttttgtatttttagtagagatgaatttcaccatattagccagggtggtctcaatctcctcatcttgtgatccacccaccttggcctcccaaagtgctaggattacaggagtgcctcccaaagtgctgggattacaggagtgagccaccacgccggccggccttgtttgtttttaagataaggcttgctgggattcctagaggatcttcttcaccctagtacttagcacttctctatgtgggattacttttcattgagtccttttaccatgttctatacacagattttgtgtttttaatcccagggttttgatccttcctggtgcttgccttttgattcaaatttcaaaccctcagcattgaaccagagattgtgtgaatcacggacagttttagtgtatagttctttttctttctttttttttttttttttttttttttttttgagatggtgtcttgctctgtcgcacaggctggagtgcagtggcgtgatctcggctcactgcaacctccgcctcctgggttcaagtgattctcctgcttcccgagtagctgggattataggctcccaccaccacgccaggctgatttttgtatttttagtagagatagcatttcaccatgttggccatgctggtctctaactcctgacctggtgatccgcctgcctaggcctcccaaagtgctgggattacaggtgtgagccaccatgcccggccccttcttcattttcaagatttaattttttttcatgagaaaacttttctgattaaaagtaaaatgctgatttagaatataggactagtacagctgaggttgagaccaagtggtagtcaaccgcctgtactaagcacccaccataggctgcattgtggctcatctgggaaacaaagataatctcagactcatttcatctaatagtatcaactcttccaataaacggtagagtatacaaagattctttcttcaggatgccatgctaactctgccttctccaccaaagtatagaaacatagaaaaggggtaaaaagaatgctctgttttttcttcaatatgtataatgaggtcttactatacccacagattggtagtgtttttgatcttctcaattaggagtagtcaatttatctgtcactttcaatagaccagattcatgaggtgctgagattcatgaggtgctgagattataaatttatcttaggctcatcctttatttttatattaaggtaatgattagggtttgattggaatcttttgaatgtttcagactacctttttaaaaaatctttaaatgcagacgctgtctttaatattaaacataaagatgtcagatgaagaacggtcaaactttcaaatttgggaaaagaacttaaaattcaggagacttattttctctctgcccttcggttttagagtttttgttatattaataattaaaattttctaaagtgtctctagtggcaagtttacaagataagcaattccttaaaaatagttggatttttgtgtgtatgtgattatgttaaatgtctcttttgctcatgtttagatgtttatttgaccgtaagtgcttttaatttttaaaatttctaaagcagttttatattatactttttcagtgatcctgcagcatatcctgacatggagtctgatatacgttcatgggaattgtttctttctaatgttacaaaagaaattgagaaagcaaaggtaagttgtaaacatcttttaatcccatcaaaatctttatgatagttataattctcgggaggctggtgtcatattgaatctatttcttttttatctattattatcaataattttttttgttgaaagtattatgagcttttcatggaactaatggttttgttttgtttttttgagttggagtttcgctcttgttgcccaggctggagtgcagtggtgcgatcttggctcactgcaacctccgcctcccaggttcaagtgattctcctgcctcagccccccaagtagctgggatcacaggcatgtgccaccatgctcggctaattttgtttttggttttggtttttagtagagatggggtctctccatgttggtcaggctggtgtcgatctcctgacctcaggtgatctgcccgcttcggcctcccaaagtgctgggattgcaggtgtgagccaccgcgcccagccggaagtagtgatattttcttaattaaattaaccatcttgacctctgccttgattggtaagattagaggagttatgtttgaaaaggctttggagcattcggtttaatgaggtcttattttgaatttccttaccaagacagttatgtttcatttataatgtgtaggaagaaacaaagtattaattgacaattgtggttttcccacactttactttctactcacagtctcagtttgaagaacaaattaaggcaattaaaaatggttctcggctcagtgaactttctaaagtgcagatttctgagctttcatttcctgcctgtaacacggtaagtctagcacatcttttttttttttttaaaccataattcatttgttaactggccaaagtagttatttgttgttgtttcctgggagtgaggatgagattggttaataattgccttaatgtttcattattggtgctactgattaaccttttaagctttataacattcttatataaaatagatcagtctttctacatctgtatgagggatggactgagatgaatacaccattgctacatttctatcactctcatgttccttggcctgtcttctatctttgtgtgtgtgtgtgtgtgtgtgtgtgtgtgtgttgtatatgtattcctgactttgaacaaataatccaggagtagcagttgcctgttgcgcactgcttttgtgattcaagcaggccgctatcaccacctcagattatactcttattcctagatatttgggacataagaccaaaatctaaaaattaagaggtttcctcctcaaatacagaataaaagctgctatgcctgaggcatacagggctttgttggtccggcacatcatattttactatttgtttgaggtatttgccgaatcttgttaataacagtgaataatcttgtctttttattttaatatacacagcacagtaaagaaaagcattaattgcattttgtggactttacaacatggctaaacccatatttcttagatttggacatagatagatgcttagtaaatactaaattgaaatgaattaggcccagaggagatcagaccataggaatttaaagttagatcttgagagaaaacttaggtaaaaaagaaaaacaaaattaaaggaggactgtgtgtgagagttgaaagatataagttccagaatgttgtggcaggacagtgaaatcttctggttcctaaagacggaggagactctctcccagcacctgacttccaccctcccactactgccagacctttgcctgggctgttcctagcctggagcactgtccccgctctgcatcctgccttcccctgaaaccccgtcaggcgtgccctcttttggcctcccactgtgtcccttctctcatgtgcattagatctcagcctggccttgaatgtctctttctcaccagtaccttgcacagtaaacattcaaacttactgtgaattcatctgaaaaaaaaaaaattaagtgtggaaaaagtgtgaccaccctgaactgagtaaaatattctgttgagatccagttttttctctccattgaatgtgcagttttagttagaattacactaaagggcacttatcatttatcgtttttccaagttcttgtaacagatatgtatagagaaaacgttggctctcaataggatattttactgttagtttgtaatcctagcttatgttattttatcaatactcaaaaggattttcatatcctaaattctgggaactcttagtgtgccaggagcttgagtaataagtgtgcctaaaaattatttgtatctcatttctccctcattcattcattcggtaattagtggtgataaagactgatgtgggctgtgccctcaaagtgcacatggacttggggaaaggcagactttaaacccattgttacctgcagcagagtgaggtttctcatggcagaatgctggagcggcgtggatcaggggccactaacctaatctagaggtgtggcctcagcgggagattcccagttggaagtctcccagagacagagatctgcaataggaacttaccagacaaaggagtgagaggggtgtgtttggacggttagagttccagatggaacacacagtgctcctggagcctagagagacagagaacacactcctttcatactgtaatagaagcccagtatgacgcaggggcaaagccaatggagccttcttctctaagctgtgttacagcagcttagacacttctagcttcattagaccagacaggataggtctcaaataagggaacagcagcagaacaggagtccctccttcttcatggcttcgctttccgtggtttcggttatccgcagtcaaccgcagttagaaaatactcaatggaaaattccagaaatacataattcctaagttttaaattgcacactgttttgagtagcgtgatgaaatctgtattctcacatggtcacattgtgacctcctccctttgtccagtgttttcatgctgttgctgctccctgcccgcgagccacttagaagctgatttggtgaccagatgaacttctcgcgttaccccagtgcctgtgttcaagtcacccctattttactccataatggccccaaagcatgggagtaatgatgctggtcaatcagatatgccatagagaagcaatatattgcttcctttaagtgaaaagctgaaagttctcaacccaataaggaaagagaaaagatcgtatcctgaggttgctaagatctatggtcagaacaaatctacccatgatattgtgaagaaggaaaaagaaattcatgtacagtatatgtagggttcggtactctttgcgacctcaggcattcactggggggtctcagaatgtatccctgaggattacgggaagctactatgctttttgaagatgagcttgccactaatgtgggggaatgttggggaggggcttgagtgatttccatttgttcgattatcagtttattgccatcagcctgtcctggatggggcatggcagtgggggtggagggaagagaacagatgtgagaggtgattgggggtacatttacaggtgccatgctgctcaggagaccaggccccatgtgtccacgtgggagttgagggtgagtcttgggcttccgtccaggagtactaggggaagagcaggactggggaggctgcctgaggctggtttccaaaacactgactttgagttgccttggaatcacccaagtggatttgcagatttggatctcaggaaaatattctagactgcaaacttttaaaaagatttggcctcaggcagctgcatggggaggagtgtcagcactgcaggcgtggacggaggcctgagagctgccaggagagctggcagggaagaggaggcggccccctgggatggagacagctctggggagtgtggtggccatgatgttccatctgtcagctacatggtttagctcagaaggggaaaagtgtaaccaggtagaggctgaaggagggccagtaggcaggcaaaatggtctcatcttacagagaaaatagtgacttatagagataattatttagaagtctgagccctcctactcttgttctaataactaacaagttattgtcaagaattcttttaaaacgaaaatatttaattcatggtattcaggtttcctgtgcacggagcctctgcgctgcgttactgtatttattcatcggcctttgtccttgggcgtttcatccttcaagggaagccctaagtgatccatggtgtggtgtgttcctcacaggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacaggtatgaacagaaaatgtctgtgactgtgtttaatactttatcgaactgaggtttcctgattagataaaatcatggctagttaggtgttaacatgaaaagggttgcataattgttttgctcagaaagacagttgctacatttctttctttttgtaaatatagagataagtattttcaaataaattggtgggttttttctttctttttttttttttttttgagacagagtctcactctgttgcctaggctggagtgctgtggcacagtctcggctccctgcaacctctccctcccgagttcaagcgattctcctgcctcagcctcctgagaagctgggattataggcatgcatgactaagcctggctaatttttgtatttttagtacaggtggggtttcaccatgttggccaggctggtctcgaacttctgacctcaagtgattcacccgccttggcctcccaaagtgctggggttacaggcatgagacgccacacccagcctcaaataaattttttaatgtgcatatgtaaattgaaaacattgagcactgggtaatattcatcagaacccatgacaatttgctaagattttgatgagaccaatagcactgtctaaaactagtgttatagtatcaataaatgaacgcaaaacaataattttgcatcatttggggggacaaaattatatatagcaaagaaggcagcagcaacttaaaccttgttatataagacctctgatttgttagagtgtgaggttgaagactggatggaattccatagtgaatggggcatgtggacatgttaacaaggggtccttgtgaatgtgggaaaaagctgcccttacctgagtgagcaagagctgtaaatagagttgggatgatggcaggctcttcagtagcgtttctgcctccacctctggtttccgctgttcaggttgttacgagggggacagagttgcctcttgtctcagctgtgaaagatgatgaggtagaggcggtgtctctgaagtgcagctcggatcaaaggactctatgctcaggaatgacctttggcatgtgccctattatttcagtttctgagacagtgttaattacaggcttcaaaattgaaatttgtaaacaatggggcagttaaaatatgattagccagcaggcatggtggctcacgccaggccgaggcaggtggatcacctgaggtcaggagttcgggaccagcctgaccaacatggtgaaaccccatctcttcttaaaaaaaaatggcaaaactcgcttgaacctgagaggcagaggttgcagtgagcagggatcgcgccactgccctccagcctgggcaacagagtgagacactgtctcaaaaaaaaaaaaaaagttatgctttttagatagttattgttgttatcagtggtcttcagattaattttatgtgcatttgtctttgtttctttgggttgggctgttggattaatattggcatgtaatatttcttagcagtagagaactttctgttgtcattcatcactcactctccctttcagcactgagcttgctggttttattaaaaaagtgcgaagcaaaaacaagaactcactctcaggattgagtattgatgaaattgtccaaagagtgacagaacacattctagatgaacagaaaaagaaaaaggtattttatctagatgttccagtttatccttatttatttataaaatatgagaattgttaaaaaaaaaaaaaagcttcaaaccaaaacctagagagcaatgtactaaagacagaagatggtcaagttgttggataactggttgcttccctcttgtcccctccccgccacccctgttattttcgcagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgtatgtataactgtatagttttgttttttaatgaaaaacaagaagcaaacaaaatttttaatccatgatttagccccattcatttctagacctaatttatttgatcccaacattagaaactgaatttcaatgtacttgaatgtgtccagttagagcaatcagtgaatggccgaggtcatggtgtctgctgtgatacgtttgggcccagcatggagagaagcccctgcacatgagtgacaagggctctgaccatcgtgggggatctgagccttctctctcttgcccttgttttgctgcagatggtcaagtacatgaactttgtacatccagtgtggtattttgaacagttggggaaatcatttttgaataattttcttctgtgtaaccatggctttggaattacacagatgtgtcaatgtgtcgtgtggccacacccaccccaagatagaccgtgattgcctggagaagagggttctgtttttgcttcatgatggatgtttgtagtaacgaagatataaaagctgacttactgaaacttcaccagattgtatgagaaagaaaaatatgtgttcaaactgggacctaatttgataaccatagtttgttaaaattaaaagtattaattttcaaattacaaagtattacatacaatagaaaatacaaataaaaagggcatttaaaaacccgccctgtaatcagtattaccactttggtatatatttttctaaactcttgaatgcatggatatgtgaattagtcaaaactgaatacgctagtcacactttgtatgttctctgaggggctgaatgttttggttgttttccatttttttttttattgtggttgtcctttttttcttttagttagaaatatactgtgcccatcttttctaggaaatagaaaacggtcaagttaagtgtatatttttttcaaactaaacctggctccgagctttgcactgggcattggagaggccttcaatggctcttccccggtctggcacttcctcttcttccctgaccctcgagtcatgggcagcagtggaggggcatgaaccctccttctgcagcatctgccccatctcctcctgggccgagtcatgccttgggagagacagcaaaaccctgaacagcagttcaaggtcttctcagccttggggtgatgcctccagtgccactccctgaacttgatcccactgccagggctgcctgcattcgcccactccctcagcaggggtttttagagcatgagtttgagctaggttttctgccagctgctaaagacccagatgggactcattttgtgccttcaaggcgctcagagttaagaggcagtgagctagagtagaagttaatggtgcagtaagggtaagtgctgtgagctgcagggagaactgtgcctggagtcccaggcgacactcaggtctgctctcacatcgaaagcactgtctatgctcaccagactgtgagccgctgaggccagagccctccattcatctctgcgtccagcacccgacaccaaccctgcccatggatgtttgccggatgagccatccgtttgttttgttttgatttgcacaagtaatccatgctcatagaaactagaaaatagtaaagaaaaagattaaatctcccttaccctgaggcaaccactgttaactgtttttctaggcatgtatgtatacatgcagcccctttattaaaaagtgagttatatatgatacatgttgtcttgttagctgctttcattcagcaggctgttggggccagctttctatgtcagggattatgggcttccgtcatgattttccttttggctacacaatagcccattgtgtggatgtgttggaatttactaccctcaactgttagatgattaaatgtatgattaattcacaccatgccatgtgattatcccatactgtactttaggtatggtaatcttcacctggggatcttctggtcacataaaacagttttttctctgaggaaattagaactttatacttttctttttgtatttttatattttttcttaagaaatgctattaaaaaataagttgtttcctcagactgtttagctgtaattgtgaataatttgccaccctttgtggcagaagatgtttgaaggccacttgaaggaagaactcgtgtcataaaaacaactgtagttattctttactattcaggtgtgtttgtttccacaggcactgggtgcaagttcctgtgaaatatgccacgaggtgttcaaatcaaaaaacgtgcgtgtgctcaaatgtgggcacaagtatcacaaaggggtaagagctctttttggccatccttacagcatgcattgggaccttcaaatattttcaaaataagaaaggaattgttttctagtcatcagtatttattgtgctttcaaactattttctttgcaaacctcccgtgtcagtgttcagtgcctccctgtcctcacaccagctctgcaggaagggcagctctggagaccgtcctttccatcccttgtggggagaggggaacagcagctccagccactcgttagtgctgagattcaaagcagtattagttccttgaaaggtgatttcttacacacttgactaaatggagaaacagtgaaaccatttttttgacttagtgtagtatatgaagtcagtttaacattttagaggagaaaaactaaacctagctgagtcccttctgcctgacccagggacagtcctgctcgtaccgttctgggatctgtgtgtgaactatcatggtgttctaggtaccgtgagcatttgtgtgcacccctgctgctgggttagaacagatcaggtctctgccatggggatttgctaatcccttggaacgggataaatacagcatgctcactgaaaggaattgagaccacttgccaagtctctggtgtggtgtgcctccttgggtacagggtcttatatttgggctagctgactgtccacagcctctgcagtgtgggcagcagcagcaggagtgtggcgtgcaggctggagggctgttccagagccaagggccaaggccaggccaagggatgggctaagaatgagtgattgggtcatagggccgagaatgccaggctctggaatttggcgcagctgaagtggaagagccgagcctggaaccggggatcagggcaagaccaccccctgaggccaggttggaggcccagagcgctcaggatctgaccctgaggtgggatcgtttgcggctggggctttgtccacactctggcctgagcgggtgttggtgtccctgagtattgggcagctccaggcccaagagaccaagggcaagtgagccacgcctgccaaggagcccagcagcacaggggagctaagcttcctcatggtcctgaaggcatcttctgattttgttttctccttttcagtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgag

SEQ ID NO: 37024 - DNA, 32085 bp, Homo sapiens
gggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagaggtgagacccaggcctgaggaccgttgggggcgggggaagcacggccccaggggggagccaggctggacctggctcggtccggcgggcgaggcggggtcgctgccccttctttgcccgggaaagggaggcaacttcgaggggtcatggaagatcgcgagccttgggtagtacaggagccgcggggagcaggaggcagagctgggttcctcgcaccctgaggttgcccaggggtgtatcttgggcgaaatacaaaaacaggactgcggatgcgtggacactggagacgcgaggagtgaaaactgcaagacttagattttgcgtggggttgtttttctttcagtcttgtgtgccctgctcaggtctcattggtacatagcagttcctttacgcactattcctttacgtcgtgttataataatataacactagtaagttaaaagttacaaaactagtaagaataaaaatgataactgtaaaaatgattgtttttaccttacagcgtttgtagctgcgtaggattaattatcttgagaatcacttattatacctccgttacttggcagtgttatcactccaaacacgtctgagaaaaataatttcttaaggcctggcatgtttccaggatataatcttgttgtctttaactgtagagtacttcgctacgtgcaaggagttaattgacaaggcattgtgcctggtgctaggaaacagtataagtactgtctatttagacgaataaatagaaaagttcgttttgatatttactatataatagtaattagcattttatgtgttgaaggagcaccgaagagaaaaagtgacagggaagtcttccctaagatgactttttaaaaaattattactaatggggaactgaaaagatgacatacaaattgcactaaacagggataaatagcaactatgcagaccattgcgactcctaagaggtgctgctgtgaacgttatgtgtttagtgacttttgtcttttagagacagggtttggctgtattgtccaggccgcatacagtggcgggatcactgcagcctccaattcctgggcacaagcgatcctcctgcatcagtctcccaggtggctagcagtgcgggatcgagccaccatacttggctaatttaatttttttgtagagatgggggtcccattaagttgcccaggcttgtcttgaactcctggcctcaagggactcccccgcctcccaaagtggtggtattacaggcgtgagccacttcacccagcgtgatatttttgtgtgggaagatgagctcatgattaccaaatagctcaaagaatatttcttaacaacaatctggttctaaggaaaaaactcgttacaatctgtcagcgttgtatgttgtatttttttcctctaagaagtttttcaatttttagctccccaccaattgtctaactactggaagacttacttatatgtgaaattctgagaccatttaatattactatgttaatagtaactttatgaatattggtaagaagtctattttgcaaactcctcaaccgggaaatgtcaggattaggaattgagggctaggttttagtcgttttctctattgaacagcttgatgatccaaaagccttaagatatttgtatgcttttatcctaattataggaaagaacctgcagttaataaattctttctaaaattccaggtaacgtagacaagtatcacaggaagaaaatagccggctccaagagctggctccactttacattaagtggatacaatgtttttgtttcattcttactagtgaggaagaggagacacagaagaacaaattaaaagcatgtgtaagaacagtgtcctcctgacttgtgctggagtgattgtgcctatgtagagaattccactttaaggtttgcaaaatatttgtcaggcactactatctcccaaacaaaaacaagaaatagtcatataccttattttaacataggtaattccagtttttctttctgattccacttacattctttagccatcctgagttggctgaagtatggggtgaagcatcatggcatatgtagggactttattctgaacttaaattgagatatttaatatagaagctttttctctttatttctgtatttaaactaagatttttataaactctgaggcctttgcgtttgtgtcagtttctctctctgccttcatcagtctgcagttcgagattgtggcagatggggctgaatgtggagacttctaggtccagacgtcttcctaggcctgatgctactgttagggttactcaagttgaaaacatgtgtttctcacaggcttagctgttgaagaacagtacatctgcctatttgctataattgctagcattgtttatagcttagttttatttgatataaggatttattagtttaaccttttaaattgcacaaagagaaatactaaaagtctttctgaactagttgtcagtgaggatccaggagactgttcttttcaagaactgtgttttgagatatttttgtttttccctttttagagacagaagcattctcccactctattttctcccgtttaacaatttagtatcttgtatgtggtttcatggctttacttgatggtaattaagatcgaagagagtgtctttgttttctactccctagtacagtacgtggcacatggcttttcctaaatgttgtaaaggaaatgaacagaatgcatttctaccctcaatatagaatttagagtgtagcaaccaattttttgtacatgtgtacaaataaccatagcacaaagcagattagaaggttatcaaattaagagaaatgtgaatgaagttttatgtggtcctatgtgagaaaagtctctacactggtcctacttgattgtgtaacataaaaaagcctgtagtgccaaagtctaagtggcagtttttggccagaaagtagcttgttctaagccttggaagcattaattgaaatttcgtacctatgagttggtgttttcttccattagttaactagaatttgggatgggagaaactaaatctagcttatgagtaaatcctcttttttttttaaagtttttattttttttgcaacaatttctagctcagaaaaattgcaggtatggtacaaaggaattttttctgaactagttgagagtaagctgccaacattataccccaacaccagtgagtgtgtacttcctacaaagtctttacaatgcaaatactaaacttaggaaactaatgctgatgcatttatgctatctaatcctcagatttatgtgttgcatttagttgccatgtcacgtagtctccattctgaaacagttcctcagtctttccttgactttcatgatcttaacagtttgaatgttattggcaagttattttatagactttcaatttgggtttgtctggccttcccttaggattggatttagcttaatacatttcttggcaggaatatcacttcccaaagttagtgtactgtaagttatactatgtctggatgtcactctaaatacattcctgacgctgcattttgaaacttaggaagaacacagtgtaagaaaccctgtgtcttcattaaaatttaactacaaaggactggtgattactgtgctcttttgcaaagtagtgtttccatagaaaagaattttgtggtgtctatatgcctgttccttatcattaaatcattttactttgctgaattgcagattaggatgttttggatcatataatctttatgtttgacatgggagctattccatattaagggtactgtgtaacattttcttctatcatattaaacataatggaaaaagtaggcacattttcttcgtttgaatggtgcttataagaaattccaaattctgtttcttttcattccatctgctactttgcatttatacttttgcttcatattgggattctcagatgatactaagggagtgaaaaggcaacctacagggtgggagaaaatatttgcaacacataaagctgacaaagggttcatatgcagaatacagacaacaccttcaaataaagaaggacaatctattagaaagctggatgagagttgaactgtacaaaaaagtctttttaaatgaccagtaaatatatgaaaagggactcaactgcaatgagatgccagtaggcacctatcagaatggctaaaaaatctttaagatggacaatagctaagcattggccaaggcgtgaaacaattggaattctcatacattgctgataaaagtgtaaattgataaaagaacttcagaaaactgatgcccatttaaattcagcctgcacatacccttatgaccacaaattccacccaactgaaatgaatgtaagtgtggatatgacaactctagttacaaagaatcaggccgggcgcagtggttcatgcctgtaaatccagcactttgggaggccaaggctggcggattacgaggtcaggagatcgagaccgttctggctaacatggtgaaaccctgtctctactaaaacaaaaaatcagctgggtgtgatggcatgcaccctgtagtcccagctacttgggaggctgaggcaggagaatcgcttgaacccaggaggtggaggttgcagtgagccaagattgtgccactgcactccagcctgggtgacagagcaagactccatctcaaaaaaaaaaaaaaagaaccctttctgttttcaaagttaatatatccccttgttttacatagttaatggcttttgttgtttgtttttaaggcaaattttaataatgtctacgttgcttccaactgttgtggagtgctcttaagtctatcaaccattttagtcactggattgttgcaggtagcccatatactatagggtctgcaccaaatggagcatgtaacgctaattctttgtaatttttctcttctagttatttgcttataatgaattgtgttgccctgaactatttgggaaagaagagtttgtagggtcaggaggaagtattaatggatgaggttgggaggggtgtataaggagaaaatctataatgtgatgggcatgcaaatataagcaagaaaaattctcataggtctcagtcacaggacacaaacattttgaattatatcatgacggtatagttacttcataaactgcatatttgaatttaattgaactcttatttcaagtttcaaatttaggattcagatatacctactgagttgaattctaagttaacagcttgtgcaaatgattttgtcattgcatgttgacatatctgcctcttttcctctgggaagaggcacagagaagctatacattatgtttatttgactcattgaggcaaagaaaggggttcattagccagtagccttaaaataaattttaagctggaaaaaatttaaccataataataccacagcattcagattaattgagagtttacttttaaattttgaaaaggtagtcatctaaatgtctaacgttattttttaggtgtaaatacgttgcgtgacagtgaattttaattttctaaacaaatatcttttttctcatcttcttcaagcatgggtggtaaagtaccacctgctactcagaaagctaaatcagaagaaaataccaaggtaagttttaatttcatttgtatgttttgtgataaagtactataagatttcttaggggttgtttttaaactgctgctctccagttatcactcctgatttccccaagatcacttggaaataagaccttttaagacctctttatctttataactttgtagacccgaattctctggattctgatttagaactgagaatttagggttggatgttcactgttttagaatacatgacaataaaagttacatgtatggcctgtaagtggtaagctccgtgatggtgtgcatccgtagtcttcatcattgccttacagtgtgtcatatgcattgtaggtactttatttattatttgcagagtaaatgaagtatcccaggtcagtaatttaatttttttgctctactacctgagtgatatttgtgagtgtgaatcatggtgttgggttagcatatttgcttaaaggacgtgtaagattaggagaaggttaccagtagctgaagttgagagacagatgaaggggaacatacatgtttaagaatgttttcttttatttgtttgttttttctttcctgagacaaagtctcactgtgtcacccaggtctgagtgcactggtacaatctcggctcactgcaacctcagcctactggcttcaagcgattctcctgtttcagtctcccgagtatctgggattacaggtgcatcccaccatgcctggctaatttttctatttttagtagaaatggggtttcgccatgttggccaggtgggtctcgaactcctgacctcaactgatctctcagcctcccaaggtgctgggactaaggcgtgagccaccatgcctggcccagaatgctttcttcataattttttatttctctcttctgccttcatatctaaaaggctttttttttttttgcaaattttctgattagctgtcttaaatcgacaagaaaatagctgttttattatttagaaacttaaacattgttatctatttggatcttaaagtggaagttatgtctattaagaaggagaatgcgaaaaggtaagcaaaagcccaaaaagtagttaccttttttttaaaaggaccatttatcagagtggtattttctgagccctagatattttgctatttggcaaatgtgtatgaaggcaaaattatatttaacctatgtgtcagctgaaaattttttgtaagaaaaacattctaaactagaattatggcttgtcttttcttttcaatatattctagaatacctagactttgcacattttatagggactcaacaaatattttgtgacaaggtaggtttttggttctaatttttttttttttttttttttttttgagacagagtctcactctgttgcccaggctggagtgcagtggtgcgatctcttggctcattgcaagctctgcctcccaggttcacgcccttctcctgcctcagcttcctgagtagctgggactacaggtgcccaccaccacgtccggctaatttttttgtgtttttagtggagaaggggtttcaccatgttagccaggatggtctcaatctcctgacctcgtgatccacccacctcggactcccaaagtgctggaattacaggcatgagccactgcgccctgccttggttctaattttttaagtaacagggaagcaacctaaaaatggttaacaatatatggttgagtgaatagatgaaggtaggctgataatggtatataatttacaagatacacagcgttgttaaatgcaaaaggcaaaggatagagttgtttcatatatagagagactatcctgcaatgggatatacaagaaaccacactggttatttataggatgggaagaaagtgttgctttctatatgtcgtgcacttttaaattctttgaattttcattgtttattattgtaattccacaggttcttatttgcagttccaaaactcaaaaacccttgtaaagatttttactaaatttggcaataaaatataatgtgagtggacatgaggctatttataatctctaaactgtttattgtcaatgttcaaactttattttgaacagttgtttttttatttttgagacacagtcttgctctgtcgcccaggctggagtgcagtggcatgatctcagctcactgccacctccgcctcccaggttcaagtgattgtcctgcctcagcctcccaagtggctgggattacaagcgggcaccaccacgtccggctaatttgtatttttagtagagatggtttcaccgtgttggccaggctagtcttgaactcctaacctcaaatgatccacccaccccagcctcccaaagtgctggaattccaggcatgagccgccatgcctggccatatttgacagtttatacatagatttgtagaaattagtataaatattcggtatgttattaaatactgatagtactgtttgtcttccctttgctaggaagaaaaacctgatagtaagaaggtggaggaagacttaaaggcagacgaaccatcaagtgaggaaagtgatctaggtgaggagacggtagttagtttgtatttgaaaacctatgatgtgatactttgttgatttttattaaagtgacttaaatcagcactgtgtaatagaaatataatggcacatatgaaacttagaatgttctagtagtcacattttagaaagtaaaaggaaacatgaaataaattcagatattaatggcatattggttgaaatattgacatgtgtaatcaatatttttttttgtttttttgttctttttgagatggagtcgtgctcttgtcacccagactggagtgcactggcacaatctcggctcactgcaacctccacctcccaggtttaagccattctcctgcctgagcctcccgagtaactgggattagaggaacctgccaccacactcggctaatttttataattttagtaaagacgggctttcaccatgttggcaaggctggcctcgaactcctgacctcgtgatccacccaccttggcctcccaaagtgctgagattacaggcgtgagccactgcacctggcctcaatatttgttaataatttattttgcttctttttttaatagcattcaaactccaaagggtattttacacatgtggcacccctcaattcaggttttacattttcattgataataaatcagacttcataatgtttgtattagaaaaagttgggttacatattaaagttgttctaagcatacttaaaaagttttctttttttttttttttttctttttttgagacggagtctcactgtgtcgcccaggctggagtgcagcagtgtgatctcagctcactgcagcctccacctcccaggttcaatcaattctcatgcctcagcctccctagtagctgggactacaggcgtgtgccaccaggcacggctaatttttgtatttttttttttttgtagagacagggttttgccatgttgccatgttggtcaggctggtcttgaactcctgatctcaggtgatccacctgccttggcctccaaagtgtttgggattacagatgtgagccaccatgcccagccaaaagttttcccataactgaattgagtgccaaaaaatagtatttgtttagttcttacaaccatgttgataaaactggttcatatttagaagagtagttatctgtgctatgagtttggttggttttttggccacaaattgactaaatttcttcatgaatttggaagtctcttatatcacagaacctgaagaaaagtacttgaaatgttttaaattttgaatcagtttttttttgttgtttttttggggtttttttggaagacttgagtttcgctctgccacccaggctggagtgtggtggcacagtttcggctcactgcaacctctccctcctgggttcaagcgagtctcctgcctcagcctcctgagtagctgggactacaggcgtatgccaccatgcctggctaatttttttgtattttcaggagagacagagtttcaccatgttggccaggctggtctcaaactcctgacctcgggtgatctgcccgtcttggcctcccagagttctgggattacaggtgtgagccaccacgcctggcctgaatcaaattatctttgatatcattagaggtcttacattctactggcagttgtttgagtgctaaattgaagatcttttactttttataaaatgcctctttagtcttactttctaccagtttctaaaactacaataaattttttaaccaactctccacctaaaagtgttttcttttttgtatacaaatcaaactttgatagacaagcttagttgctgttaaaaaatggattaaaatttttttaccgtgttaaagggcataaactttgagctataatctgaataaattccagagatccagtatacagcatgactataatactgtatacttgaaatttgttaagagactggatcttcagtgttctcaccaaaaacaaataaatatgtgagatggatagttattaatatgatgggtgagaatcatttcattatgtgaggtgcagtaaagtgaaacacaataaaatgaggtatgcctgaggtcaggcacggtgactcacacctttaatcccagcactttgggaggctgaggcgggtggaccacctgaggtcgggagttggagaccagcctgactaacatggagaaaccccatctctactaaaaatacaaaattagccaggtgtggtgacacatgcctgtaatcccagctacctgggagactgacgcaggacaattgcttgaacctgggaggcagaggttacggtgagccaagattgcgccactgcactccaacctcggcaacaaaagcgaaactccgtctcaaaaaacgatatgcctgtatgttaaaacatcgcattgtacaccatatacatatatgtatatatatagtttgtcagtcatgcgtcaagttttgttgttgctggacagtaattctgattttaggtgggtgattttaaattttttttttttgactaaggaaacttcttatcaaattaactatttgcaaatgtgttctttttaaatgatacgtgcgtgtgtgtgtgtatatatatataaaactcgttttccacttgcaacaaattacagttgtcatttaactgacaactgttaaatgacaatttgaaaagcaagatactgcttttcattctttactgttttggttgtaagtactagctttggtcactactgtacatatggaaactaaatttatttttaaatctagccttggtacttgattctgcatcagtagtaagcctttattttaaaattaaaacttgtccatgctacttttaaaaatgaaaataattagggaccaggtgcagtggctcatgcttggaatcctagtgctttgggaggccgaggtgggaggatttcttggacaacatagtaagatcctgtgccccccccaaaattattttaattttaaaaaaggaaagtaatgaatgtaattatattaaaatattttgatttacgttgaagtatcactgtagcttacctgcatatttttgaaaaacatagtacatcagtgtgtagaaaaaaattatttgaactaaatcagtttgttgacaatggtgtatttatatacaatgactaaatcagtggtgtatttatgtgtaatactagaaactgcacatgtcaacaaccccactacaacctgataataaatatcttacatgatgtgacagttaacgtaaagtgtagtcttaccaaagtaacgaaatgtttaatgggaacatattttaaaatgcatcaatacttaaaataattaattgtagtagtcatagtatgtcagtttttaataatcttgggagtggctactatattgtacggtgcaggtcttattgtcattttctcgactttggcagaaattgataaagaaggtgtgattgaaccagacactgatgctcctcaagaaatgggagatgaaaatgcggaggtaagttcggtgacttgatttcctgcttgttctaagaaatgtgaaaggtcctgctgttgcaatgattttatgacacgattcttccaggaaaagcgcatagtaaatctttctctgacttcaggcgttttaggcaagcattgtattttactacttaaaatactaatgaaaataaatactgttactttctgttttatctgttttttaagtttgcatctggtgtgactgcttgcactgtaacgcagaattcacttaaaatacatacctattagtggagttgctcttgatggaatatctaatgccaaattgtattacagaatggtttgtcataacaggccctcaagggagtgaaaattggttcttgggaggagggcttaaaaaaaattctatatattacaatggttagtggtcctccaaagactcatagaatattaatatgtagtgtatctgtggtattaaaattggggatatggaaatgaggaaaagatgtctaaaaaggctccttagtgtctgataaaaatttgagaaacactctaatatagtaatagcagttttaaaagattggtttttatcctcaaaacttgatattatcagatttcatctttgccaagtattgtgggaaatggtatctttttgtggcttttaatttgcattttcctggccagacagggtggctcacgcctgtaatcccagcactttgggaggccgaggtgggtggatcatctaaggtcaggagtttgagaccagcctggccaacatggtgaaaccccgtctctactaataatacaaaaataagccaggcatgatggtgcacgcctgtaatcccagctacttgggaggctgaggcaggagaatcacttgaacccaggaggcagaggttgcagtgaggtgagatcgcacccctgcactccagcctgagcgacagagcaaaactctatttaaaaaaaaaaaaaaaaatgcattttcctgattcctaatgaggctgagcatatttaaatgtttattggctgttcactggcatttgcgaactcctgtttaaactttttccactttttgctggatctttttcttactgctttgtatttcatttcaatattctggatgctaataatttgttgctagtgctgcatatattttctgctagtttgtgactcatcttcactcatctttcttcatgttgtttcaaaaatagtatcttttaatgcagatattttctgctttattactttgaggttataattgctgtagtgcattgctttttctcttctgaacattttatacactcacctttcacctttaatctaccggtcccaccaaaactaaaatacactgtttctgaatattgtgggtctgtttcaggagtttattgttctgcttgtctattttttttctgttcactaatgccacatcgtctgatactaagtcttgttattttgtagaacaaggacccccaaaactttttagtcttttggctgttcttggctttttgtttttccaagtaaattttagaaataggttgatcaagtctccccgcttccattggtttttttcccctttgttagaattgtgttaaatctaaatcaagttcgggaaaagatatatctcctcaccattgagataaactatccataaataatgttatctgcccaatttttaggtgtttttaaaatattttaataacttactaacgtgttccccataagtcttgtgctttgtttttttgagacagtgtctcactcttccatccaggctggagtgtagtggtacaatcatagctcactgcgcccttgacgccctgggctcaagtgatcctcccacctcagcctcctgaccagctgggactatagtcatgcaccaccatgtccagctagttttttatttttatttttaaaaattcttagtagagacaaaatctcaaactcctggccttccagagtgctgggattacaggtatgagtcactgcacctgacgtaagtcttgtgcatttttgttaagaacaaatgtaagtactttctgtcaccatttgtcaaaggaaactttaaaggttaaatgttatgtttattgatggtattacttcttttatgatgtgtctaggtttataattttttatttatcctgcttgggattcagtgagcatcaaattctagggttaactttctttagctctagaatattttcagctgttattaaatattgcctccttcttgtttactttatgctctaattctggatccctggtaatgttagacttttgttattaagtttcatttctttatcactctctgctgaaaagcagtctatgctttgtctgttccattgatgtttgaattggaatgcttgtgtttttcattttggtacttcaaatctttttgaagtctacttggttatttgtaagtcttttgctctttactcattttcagaatttacttttattaaacacattaaattccttgttgaactcttcgctggtcttactcttatttttcatggctcttgctcattaaggtaccttgtttactttatgatgtgtttgtgtgttgtgtgtgatattttgaaaatgtgttctttggaacttcacctgtagaaaaattttgaggcctaggtaagaaggtgattgcttccatgaagtctctgaattggtgctaccaactcaaggaccccttgaaagtctcagcatggtgtttttttgtttgttccaattactttggtaatacagaattccagatgaaaggctggctgtggctctgaattttcaggggaagttcttttaatctcactactcaactgtccgtttctgtaggacaggtttataccattatgcttgccggtattagcatttggagttgcagatttattttggaaggtgtctggttagaccacatacattctcttcctctgaatatagactttgtatcctgtgtcctgcattaccttcaaaataaaattgcagccaggagtggcggcttatgcttctaatcccagaactttgggagagtgaggcaggcaactcacttgagtccaagagttctagaccagcctgggcagcatgatgaaaacccgtctctataaaaaaaaaaaagcaaaacatttagtaggttgcgagcatgtagttccagctacacttgaggggaggctgagcccaggagatggaggttgcagtgaaccgtgattgcaccactgcaccggagcttgggtgacagaggtagaccctgtctttaaataaaacattatttttatatttaatatttattttttctttttattttttgtagagacgaagtttcgccatattgcccaggttggtcttgaactcctgggctcaagggatctacctgcctcagcctcccaaagtgctgagattataggcatgagttgtatatttttttcctgtggttaaagatctccagagctttccattttaggaggatgtttgctataactctttgttctttttttgcaggggtagggtgagacatggtcttgctctgtgtcacccaggctagagtacagtgacacaatcaagactcactacagccttgacttcctgagctcaagcgagcctcctaactcagcctcctgagtagctgggaccagatgcatgtgccaccatgcccagcttgtttttttttttttttttcttttttttggagagatgggatcgccctctgttgcccagatgcacatgtttttgttcttaactaatctttatactgtcagcatcttgtacagtgtttggtctatctatatagcataggtgctcaatagttgtttgtgggaacaaaggaatgagacctttctcttctgaggatttaaacctaaaaggagctagttatctttttgtgaggagattgggtttaatatttatggatagctaggtaggagctggtatgctttggttgggacggaaggttaagcaaaggttatgtctcgggcagagtgtaggagtgaaatttgtttagtataaaaggttaaaactcgtatgtaatttctcactaatgagttatcataattgtctctttgttctctggagactacagaagaatgaatgaaaatgggtattgtgactgcgcctcatccctaagaaagtatgaattgcttccttctctctctctctactaattctaagatgatttttattttcttcctagataacggaggagatgatggatcaggcaaatgataaaaaagtggctgctattgaagccctaaatgatggtgagtaatctttttgctacatttctatggtagtcagaatatttattgcagtaacttaaatagtggtaaagtagaagagaagttacatgtacctgtcctatactggagaagatagtgtcctattatccagtcaccccttcctcattgataaaagaggctgaaatcacttctctctgcaaggacagatccttatttgattcagtgtctctgatttcctgaccctatcgtggtgtttttctgctgagaagaggctttaaagaggtgaaaggctttaaaaaaaaaaaaaaaaagtagtagtagaacagtgacccttaactttttacatactaatacccttgacagatgatgttcataggcataccaatcttcgtcctagtcagagcatgttagattctcttgagtaaatcccctcagagtgagaaagtggtgatagtattcggttttgttttttgtttgtttgtttggttggtttttttgagacggattctcactctgttgcccaggctggagtgcagtgatgcgatctcggctcactacaacctccgcctcccgggttcaagcagtcctcctgcctcagcctcccgagtagctgggattacaagcgcgtaccaccatgcccagctaattttttgtatttttattagagaaggggtttcaccatgctggccagtctggtcttgaactcctgacctcgtgatctgcccgcctcagcctcccaaagtgctgggataacaggcatgaaccactgcgcccagcctctttttttatatatatttatttttttaactctccaaggtaacaataggttattatttttttcttttttctgtttttcagttgtattttattttattttttatttttgagacagagtcgtgctttgtcgtccaggctggaatgcagtggcgtgatctcggctctctgcaacctccaccccaagtcgagcaattctcctgcctcagcctccctagtagctgggattacaggcgtgtgctaccatctccagctaatttttgtatttttagtagagacggggtttcactatgttggccaggctggtctcaaattcctgacctcgagtgatgtgcccgcctctgcctcccaaagtgctgggattgcagacgcgaaccactgcgcccggcccatggtagtattaagtgtaatgtttgatcggttataatttgtaagaacaaatcatgtataaacttgggtactgtggctgcttgagtaatatttcactctttataacagtgatagtgtgtcacaatgccatagttgactagatgctattgtatagtgctcatgtgcatttggacttcattattagatttagaagatgattgaagttatttttagaatgagttcagtattgatgttccgagttagtatatattttaaacattttgtgattctaccacctgattaatttagctccttaaaacatgtttatactgttttatactgcagttgccttaatagtttaccttcctgaaaaatttattcctttattgctttctgtttactttccctaggttattcttagagctgttttttattctactcttgcttgtaacctgtgattaacttttgcatatatatttaagatcttcatcagaggattatagacctgccagactaagatcctgtattttacttctccaatcttgttttctccagtcagactttactgttctagaattttttttttttttttatttatgctatactgtttctctggaaagcttttcttcacatatttcaacttttaattcatacctatcagttgttcccagccattgctcttctgtaccattccttttcatcgcacgaaacttttgctaatttccctaccacctaaattttaagagacagagtcttactctgccactcagtttggagtgcagtggcatggtcatggctcactgcagcctcaagttttgtaggctcaagcaatcttcctgagtagctggcaatacaggtgcctgccaccatgcctggctaattattatctcttttttttttttttggtagagatagggtttcatcctgttgcccaggctcgtcttgaactcctgccctcaagcaggcctcccaagctcagcatctgaaagtgctaggattacaggtgtgaggcactgtgcccagcccattttaaaatttactgtctcggcaatatgtaacaaaaggaaaatgaggctatcacctaatcatgtttttgttttctcacttttttctgaactctctgttcatgtgcctttgtaaatttaatctagttctgattttagaatttatgcaattgtatagtgtattctaaaggataaaagattagtattctaaagcaggggttgtgaatccaagctccaccaaggttggtgaaggcagttttgtttggagaatgtaattaaaacctggagtatggagccagagtggtatggtttgaatcccacgtctggcacttaactgtggctgctttcccactacaacagcatcattgagtagttatgacagattgtatggtctgcagagattaaaataattcttatttggccctttccagaaaacgtttaccaactcctgaactaaatgtatggaggagccatttgtttagttgggaagatacagattgggaatagatttggaaatgggctaggaaatgggaattcagtttttcggttttgagtgggcgtggtggttcacacttaacaatcccagcactttgaggggccgaagcgaaaggatctcttgagtccaagagtccaagatcagcctggtcaacacagtgagactccatctcttaaacacaaaaaattagctggatgtggtagcacgtttctgtaatatgagctacttgagaggctgagatgggaggttcccttgaggctgggaggatcctttgagcccaggaagttgagggtgcagtgagctgtgattgtgtcactgcactccaacctgggtgacagagcaagaccttttttttttgagatggagtttcagtcttgttgcccagactggagtgcaatggcacgatcttggctcaccgcaacctccgcctcccgggttcaagcgattctcctgcctcagattcctgagtagctgggattacaggcatgcgccaccatatgcggctaattttatatttttagtagagacggggtttctccacgttggtcaggctggtcttggtatttctccatgttggtcaggctggtcttgaactcccgacctcaggtgatccacctgcctcggcctcccaaagtgctgagattacaggcgtgagccactgtgcccagccaagaccctgtcataaaaaaaatttaggttttgaacatggtaggtctgagttgtttattagacatttaagtgtaattacctataatagatacctgtagtagtaattaataagactgagcatttttctgtgttgtttttgtgagttcttttcaagtcctttactcattcgctaactggctaagtatctttcacagtgaattgtgacatttatttaaaaatttctgtgttcggcctggcacagtggtaatcccagctactcagaaggctgagttggggggattactggagcccaggagttcgagagcagcctaggtgacacagtgaggcccagtctctaaaaaattttttttaattagccaggtttagtgttgtgggcttgtattcccagctactcaggaagctgaggtgggatgatcacttcagcctgtgagctatgatcatgccactgtactctagcctatgtgagagttagaccctgtctcttaaaaaaaattctgtatttgtcttgcctccccaagatttagactttgtgcaaagaactcttctgattctatagggtgttttatttgttgaatgacataagggattagtaaagaagctaactatgagaataggacaaaatgaattaaagtataggttatggtcttttatgaattctagttttcttgaatttttgtaccatttctttgaattcaaataataagcatattgttgttttcttttaaaatcagccctgtgaagttaacatgggttacttttcctttctaagcttaattttttctttttaatttaatggataaaagaaaatcaatggaataaaattaatttatcttatcctttaaattgattttatctttttacttttttcttttatttttatttttatttttttgagacggagtcgtgctgtgtcacccaggctggagtgcagtggtgatctcgcctcactggaagctccgcctcccgggttcgcgccactcctcagcctcccaagtggctgggactacagggctccgcccccacgcccagctaattttttgtattttttagtagagatggagtttcaccgtgttagccaggatggtctcgatctcctgacctcatgatttgcctgccttggcctcccaaagtgctgggattacaggcgtgagccaccgtgcccgtctactttttccttaaacaagatcaatatgggtcatactaagaatgtgctattctattgttagttaggggcttacgtactcagaaattgtcttacctcgtgagttacagtataggtgtggtaagatttgctttcaagagccagttttagtataacttagttgtcttttttatttttacttgattaaaagaaaaatgtaaaagacttaactggataacagatcaaaactttttattaatatttttatcctctgaatatttctcgataacttttgtttcactttaggtgaactccagaaagccattgacttattcacagatgccatcaagctgaatcctcgcttggccattttgtatgccaagagggccaggtgagaactctaaacagaaaagcatcccctggcaaataatttctgcacatttgtttaaatagagttgcttctgtgttgatcccaaaacttttactgaaatgaatactttttaataacacacttatttttcagtgtcttcgtcaaattacagaagccaaatgctgccatccgagactgtgacagagccattgaaataaatcctgattcagctcagccttacaagtggcgggggaaagcacacaggtaaataattgaatttaattattttcagaactctttacatttaaatctgatgttttaagatgctttgtttaaacaaaaacacaaaagttcctaatgacttaattttcaaattagtgtgtacttagtatcaagaagtgagatagcttgtagacagctgcttaaaaggtaaaagaaaaaaaaaagaaatttaaaagaagaagtgagaatataggaaggaagaaataaaaagtattttcatttttttcattcaaataaagctactcttaccagtttttgactacatatggccaaatataaggaaaggatttttacttaaaattaattccaggaaaagaaagaatgatcttttatcagtgtccttacaaattttctcttactttcagactctgtaagttagcattgaactaccagtgtattatagaagaaggagtatgccagcctgaaactacttcagtcactgctaggccacctgaaaaattaggagaaggcgggggggcataaagaggtgaatttaacccagattagtaattataccttgcagcaaaacttaggaatatttgtatcttgggaatgaagtgttcagtgactttcacatgttacctgggttgaaagggctcaaatgtggatggagataaagatggatatgtttttaggacaactgtattagctgactcagagtagctctagtggattttatgacacatgttaaagataaacattaaaagttgaaataaaatttattaatgctgtgtcagcacaggaaaagcccatgcattgctgttgatccttttgaaatcccattagtccaagtatttctttgccttctaatacaagacagcgttggctcatcttgtgctttgcttgtctcagactgaaaataagctatttctgtgggaaatcgtggttcattatagcggaaactaagatttgatcactgtgtctgttcattgcttctggtatgtactgtcgtttcaatgaacagctagaaaaaaacattttaaaaatcatgaatttagggaaaaaattcttgaaattgtgagtttatactgatattttctattaaaatgtaacattaaatgttttgttttaccttttagtttgtatttttgacacttgtgtggtaaaaatttttgtcctagttttacatttacttactacaatgctgtgatatacataaaactgtttcagaattacaataccttaaaaacagtatacactctaagtaaagtttgaaggttttttgggaagtttttgttttgctttgtcttttgtttctacacagagtctcactctgttgcccaggctggagtgcagtggtgcgatctaggctcactgcaaccttcacctcccaggttcaagtgattatcctgcctcagtcagccttctgagtagctgggattacttacagtcgcgccccaccatgcccagctaatgttttgtatttttggtagagagggggtttcgcctattagccaggctattctcaaactcctggcctcaagtgatctgccctccttcccctcccaaagcattgggattacaggtgtgacccaaggatgttcttattcttagaatatatatcccacttgaaatatacagtcaagataactatgaaaagttacttgaattcatttttttctgtgtagcttatgttgttaatgcaatacacagtgttttgttttgttttgttttgttttgaggcattttgctccttcacccaggctggagtgaagtggtgcaatcttggctcactgcacccgccccgggctcaagcggttctcctgcctcagcctcccaagtagctgggattacaggtgtgcgctaccatgtgtggcaaattttttatattagagatggggttttgccacattggccaggctggtcttgaactcctgacctcaggtgatccaccagcctcagcctcccaaagtgctaggataataggcatgagccatcgcgcctagccacaccttatttctttttttttttttttttgagatggagtcttcctctgtcacccaggctagagtgcagtggcgcgatcttggctcactgcaagctctgcctcctgggttcatgccattctcctgcctcagcctcctgagtagctgggactacaggcgcctgccaccgcgcctggttttttgtatttttagtagagatggggtttcaccgggttagccaggatggtcttgatctcctgacctcgcgttctgcccgcctcggcctcccaaagtgctgggattacagacgtgagccaccgcgcccagccacacagcttcttatttctgtttgtattcaggtttaggatttgctttatttccatttttctgattttattttttgagtatgtaaagcatttaaatgttcgaagagttacacctgagttaaaaggtatacccagtgaattctcagttttcgttgctgtctcctctgccccattctcacctactgtcaccaacctttagtttctggtttacttgttctgagtttttcgtaaagcctgtacacatgtattattttctcttctgtcttacatagaaggtagctaaaagctaacacattatgttagtcctggtttgggcgagttgaaagttactggtctacatacttagaaaattacgatattctgaattaagaaagattttgtttgttttttagcttttagtagaaaagcagctttaaatagaggaaatttaaatgttttcaggtttttatagagttaactaaaatgggatatagtaattgaattggttagtgaaagtttatagttaatatttaacttaagcctgttttagaacaatccttttttgtaaggaagaaagatatcatgccacataggtgaatatgtataaaaggctcctaaaatgagtgtaaatctgtttcagacttctaggccactgggaagaagcagcccatgatcttgcccttgcctgtaaattggattatgatgaagatgctagtgcaatgctgaaagaagttcaacctagggtatgtcaaagtagagaaagggaaagtcattagttaaatactccatcgctgtagtgcttagcccccgacagctgtaattcatctgaaaaacaggcaaagaaacaaaccattggaagatataatctgtaattgctgaagtttgtgctcgactctggagatctcattaggttttcatgctttcatttctcatgcattattagagcaaactctgttactttgtttggaagcctgcagtggaattataaccagaaaattagaaaagggggtatcaggtttacaacaaggaaacaaatagaaaatctataattagcattacccaggattgaatctgatgtgtccttatttatcataggtgtgtacaaccactttataaagcaagaagaccttgtggaagttaagaagtttcaggctttccggccaggcgcggtggctcatgcctgtaatcccagcactttgggaggccgaggcaggtggatcatgaggtcaggagttcaagaccagcctggccaacgtagtgaaaccctgtctctactaaaagtacaaaaagttagccaggtgtggtggcatgcgcctacgtagtcccagctactcgggaggctgaggcaggagaatcacttgaacctgggaggtggaaggttgcagtgagccaagatcacgccacagcactccagcctgggtgacagagcgaggctgtcttaataaaacaaagaagtttcaatcttttaaaaataataatattgaatcccaaaagtagaacattccagcttttaaggatgatttttatctaaaattgttggttaaaataattttaatgtgtttacatggtaaatccttcattttgtgggaagttcagctgtcaagaatttactctcagagattttaagatagtgggaattgtattgaatttaattatttactgccagagagttcatttggttttctgttttcttcttaaaatagggcaaagttgtaactttgtcagcaaagtgtaaacaagctaaagtgacagttgaatatgaatctcttaaatgtattttattctctgaggaaataacatccagagcatttatttgatactagtgtctggtatacatatttacatttttccctcttaatccctatagcaatttgataatattaaatatttcttcctctcccattttatggatacagaaacttaaatatactgtggcatatacttggggtatgagttcccagtctctgccttcccacggcagacatccgtaataatactcttcctactgaattcagctgtccgtctgaaacctaaacactgtgtatctgatagaaactagcaggcaagaattgtcatgcacttagaaacctgtttgttaatctttgagcttaattgtttgagattataacatttctaacttcaaatcccaggcccctttactctgttttacagtgcctcatgcagttgaggttggttttcttaaaggcttagcttgtgttaggtctttttgtacaagacaaatctgtcatttttctgaactgcatgttgaattaaacatctctctacaaagaatatttgtgttgatgttattcagcttttggagcaagcttattttgctatggctcttttttctaggcacagaaaattgcagaacatcggagaaagtatgagcgaaaacgtgaagagcgagagatcaaagaaagaatagaacgagttaagaaggctcgagaagagcatgagagagcccagagggtaaatttcctatagctaagccatgaaaggaaaatacggcaaattatgtagaggcattaggacactaaaattttaattcctggctcttttatttaatgctggctacagttctatagagtaatgatattacttatggggagtctcctttcactgtatctaatttgggggacatttttagtcttaaattattcagtgagcttttatttcaccattttatattcttgtttgtgtttttataaaatcagttgtttttccaggtcaagtaattgaaatgtgacagtattattgtttgatcttttgaggatgcttcgccagattaattaaatttatgattcctcctctcttccaacagtggatgtgttgctatttaaaaatgattctagcagggcaaggtggcaagtgcctatagtcccagctcttgggaggctgtggtgggaggttcacttgagcccaggagttcgagactagcctgggcaacatagtgtgatgctacaataattcacctacttatttctaacattattgaatgaaagaacatgaaagaacctaaggctgtattatataatatgttacattctaattttttgtccatttaatattaagcatcatacttgattttaaggttatagtttataatctttaaaagtaatttatctccttgatatttaaaagcaatatatctcctcaataattttaaaactacatatgagggatatttattttttgttcattttctcttttaaaaagcagcaaaaacaaatcaataaatctacatttgtattatgtagggagaataacggaaaagatgtacctaggaaacaaaagtcatggtagtcttggtaatctagccatgtccttccctatgggtgttttaaagccaggatgaatttagagttttcatattagtactataaattgttttccaggtttacttgtttccagagtagaagtaaaacactttacttgaaattactaccaagaataatgcccactgagaatccagtttggaaaaaatgtttgaagggggtatgaagtatatccttcagttcagtattgccatctactaggttattttacaattttttcatggtcttgcatggacaggttgcatggacagcacttatttcttcttctattatataatttatttccttttgtatcaaaggaggaagaagccagacgacagtcaggagctcagtatggctcttttccaggtatatttaaagaaaagttaaaactgttttgttctattatacagtgatattttaatataatacttaatatttattataaagtgatattctgattttgttctcttatacagtgatattcatgaagaacctaggtaaaagaaatgatggaattattaggcataaaaatgatgttttttgtacagtgtaaaaatagcgtatttttctttcaaatgtgatcagaaattgctagtgaggcaaatctttgaataccagaggacaggactaacacagagatagaagagacggaaaaggcacgcagaagatttattgagtacttcctgattacgacagtgtggaatttatataaagaccaggacaagacttaattttttgttttttaaacaactgtctccagttgtttaatggtaactagctttctcttaaggaaagtttttagaggctacgtatgcttatatgtcactggttagaacttagttgcatgatccgatgctagaaaatctagcctttattctgaaagagtatgtgcacagcaacagaaaacaaacctagaacaaatattgaggatgacctgctgtttgaagaaaaagcaagaaattaaatttagctcatagtttacttcctatgtaaaatataaataatcttattgtcagatatctttgttttagaaagtgactgctaatgttgggctagtactagagagaattttctgttatgtacattttatttagatttgacaagctttgggtcagtaatttcgttacgggtaggcactaatttttcaaagctttgggataagtaggggcagcaagagaaactagaagttgttttatggtccccttagatttcttcatctctgattgttagttattaatggccatattttaattaactgtggaagcaggtaaaaatgactttatcatgtgtttccttctttaaaacggctttacttacagtgaccctttgtagaatacattaatgttgtctttctctatattatttttttttttattattgagacagagcctcgctctgtcgcccaggctggagtgcagtggcgtgatcttggctcactgcaagctccgcctgccgggttcacgccattctcctgcctcagcctcccgagtagctgggactacaggcgcctgccaccacgcccggctaatttttttttttttttgtatttttagtagagacggggtttcaccgtgttagccaggatggtctcgatctcctgacctcgtgatctgcccgcctcggcctcccaaagtgctgggattataggcttgagccaccacgcccagccatctttctctatattattaattgtaattttagaatatctccagtagacatacaggtttatgatattgaagaacagagtagattatttgggtttataatcgaacaaattatactgagagaataaaatcctttttgctagagcattattctctgtaaagaagcaccaggaattcttgttaaaaatccaggtttccagtttcactttcagagaatttttattttatttgaaatggaaatgaaaaatcaacagataagccttttaaggtcgtccttaactgaaggaagatctatgctagaagagtatagttgaaacaaaaacctaaactaaactcgtatgaattaattttaaattgaaacagacaaatattcaagaatggagagttgaaagatgatcaaaatgactagctttataatctaagataattatacaatttataattatctaaggaactgttagatgactctttgcttttaaggcgagattagtcttttttaacagtgttattactagaaaaaagttgctgagcatggtggctcacaccggtaatcccagcactttgggaggttgagggaggcaggcaggtcacctggggtcaggagttcaagagcggcccggccaacttgatataaaaatataaaacatatttataaaaataaaaaatatatttataaaaatataaaaattaggcatagtggtgcgtgcctgtagtctcaactactcagaaggctgaggcaggagaattgcttaaacccgggaggcagaggtggcagtcagccaagatggcaccactgcattctagcctgggcgacagagcaagactccgtctcaaaacaaacaaaaataaaaaacagtgttattactagaaaaaagttaatccaggaggtagcaaagtctgatttacagccttgtttttaaagagataattagaagctataacttatgtcttgttgcagtctggttagaattttcagactcttcagactactttgtgcttagtggcacccatattctttgaacctgtactttttgtggatgaaatactgtgtcagaatatttgggagtatgattagtgtctattcattttttattacaggtggctttcctgggggaatgcctggtaattttcccggaggaatgcctggaatgggagggggcatgcctggaatggctggaatgcctggactcaatgaaattcttagtgatccagaggttcttgcagccatgcaggtaagacttggaagaaaaactttggactttgtatcattaaggcaattctttcataattctgtgtggagacaaaggttactctcatagctattttttatttatcacagttaccaaatagctaattatgcaagagtgacatttattttctttatgcagagtgagtaacttaaatttttaaaactaggaaatacttagcaatcggcaattatatccagttgtccttttctttgtatcaaaattgtgcttttttcatcatacagttcaaatgacttaattcagcttgattttgatacttcaagcactcatctaaaccccatttaacttaactatcaccaaattacaggtctaaataagagatggaatttaggataataaacttactgacccagtaggacactttttaaatactaatgaaccctttcttttcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctg

SEQ ID NO: 37025 - DNA, 2091 bp, Homo sapiens
gcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtattttgtttggctaatagtattgcatacatactttctctgtatactactttctattgtatgtgttaaccagtattaagggaaaatgatccagcttcagctatctaattcacaaattaatttctggaaattaaactttgtaaattaagtttttgcctataagaatttgctggtctgggaaaacctgccctatcaatgagtatgttgccgtggttaccttactaagatgctgaagttctaggagagtaatgattacatcagaaggctaggttcagcaaaataagtgtatcagcaggttttatcatgatcagtaaaaatgttccaaatgcttctgctccattatagcagtaaagaacgaatatccaatgcaacaggacaatt

SEQ ID NO: 37026 - DNA, 2091 bp, Homo sapiens; identical to SEQ ID NO: 37025

SEQ ID NO: 37027 - DNA, 9674 bp, Homo sapiens
cacttccgggtagtgctccacgggcacgagccgcgattgggctaccgtagatggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaagggtgagagcggggtccgagggggtagcgtgtgggggcctggggttggtacagcatcgagggcattgaccactctccttccctctccctttcctggagcaggccgcccgggtctggcctgccgcttggcgtgcgggtccgcgatgtctgcagcaggggtttcccttcgcgtcccgtcttcctcaactacctgttttttcttgtccagaccggggctttgagctcacattcaagaccgctgatgaccccagcctgtctctcataaagtatggggaattcctctatgacaatctcatcattttctccccttcggtagaaggtaagggttccgcgtcgcccctagcactggaattcgagacccgggacttgatggattgctttcttctggttcttgggcatgtcctgggtcacaggatgggttgccagtcctggatggtgctaccacggagataaggaaaatgctcatttctgacctgaccctaggagggtacatctttctaaaagaaacagctaaggattgtggagtcaagtgttgctgcagaccgtggaacccagggccctgctgctctgctgagaagggagtttactctgtaaagggcctgataaaaagatggaaagctcctgggttgggtttgcctgggtggaaagaggaaatggcctgttattaatatggattgctataaagaggcattgtgcattgtggcagttgatcttaagaattcagatagattcatagtctcgggctgaaaaaagagccttagcaattatctaccaccccacccctcctcccatttgaggctggataaatatgtccagcagccttgcagtgggctagtcgtttaacagaatgaatatcttggccagattatccagttgatacttgagtattcttgttttacgaggcaatccactccaccactgaacaattctgttaagaagttcttatattaagaaatattgtctcctgctttattttgttcttatgctccccagcaccttagagaatagatagaatgcttatcttgtttgcaggcatagccttcacataatcacagcttattcggttgtttctcctccagactgaacatccccagctccttagctatttctcttttgccatacttttttggtgagcatgttagtcattctcttctttatttgcttcagtttatctttttcttaaaagactcaagttgtccctgtctgggtaagacaggactgccttcctcccttcagttaatgaagcttaggaagttcttcattggtgccttttttgtttgtttgtttttttgagacagggtcttgctttgtcccccaggctgagtgcagtggtgctatcatggcttactgcagcctcgacctcccaggttcaagtgatcctccctcctcagcctcctgaataactgggacatggcttctttattctctgtagttcatgcgagattcagttccaccgaatccctcaagtactttccctaggcttctgttacttactgtgtcactcccaactcccttgcaacatgtgcttttggaattggctttttggaggcaagattagttaggcggatgtcaccccaaattggtagaagttgaaatcttctgatgactgggcttcggtgcagtaactggtgtttgccaagtttttgctgtgtttgaaactttgaaataggtaccttacagtggactgggtgagatcttaaggatagggagtctgccctggaggagttttttcagtctgtttttgaggaaataaagacctgaaatgagttaccaaaccctgtgtcaggatgtaagatgaagcggaggcactgtcagcttgtataggtcagaaggaaaaaagcagtgaatgagactgctcgggagagggctgagagaggatactgttggtgggagaaacgacagagagtgtaaaacagtgtttcccaaactttagtcatttgcacacgtccttcatggtttttaccatgttacgtatctcctgtgctaataactacctaatatttttcttcaaattgacctgcttaaaaaaaaaaaaaagaaaaggctaggtatgatagcttatccctgtaatcccatcactttgggaggccgaggcagaaggattgcttgagtccaggagtttgagactagcctgggcaacatagtgagacctcatctctacaaaaaaatgaacaaaattagccgggcgtggtggtgcatgcctgtagtcccagctactggggaagctgaggtgggaggattgctgaccctcggtggtcaaggctgcagtgagctgagatcatgccaactgcactccagcctaagcgacagagcaagaccctgtctcaaaaaaaaaaaaaaaaagaaaagagaaaaaaaactaaaacaacattttaaaagggaaacaatagcgagcccagaattaccaccgaaaatggaaatccagtgtcatcacttgatgtacgtagaaggtaactataaatagaataaaaacaacacccgtaagttctagccagatgctgctgcctgccgaaggctttgaacctgaggttccctcttgaaaaaggagattagcaagcattagaagctctaacaactagtatcaaactaagacattctctttgatggagaaagcttgaaaaataaggaaagggagtaactttctgtctctgagattcaaggttatttaaagcccggttcccgcattcgcgttgctgccttttctgcctctggtggagtgggttccacactttggaaggtgctgctgtgggaaatcctcaggcgttccttgggaggaagctgcagggcagggttcggggtaggggtttggtgtctgctcccagggccctgccctcgtcccatgactactgtcactgtcaccctctcaggtgagtgagtgctggcctggcttccctgtctgtgccccagtggcttctttgccctctggcatcggaaggctcccaggtcactggcaatcatgtctacaagggaagaaattttcagcacatcctctatacccgggaaaaaccggatccctgttatagatggggaagtgggttcagaagggtgaagggatttgcctagttttaactccaggtggtctcgatttcaaagcccgtgttctgtcagctttacaagagtttctcaacaggtgcattcttgacgtttcagactggataattttatagtgaggctgtcctgtgtactgtagggtgtttaacagcacccgggcctctgcccattaatgccagtggccacttccctgttatgtgacggcgaagaaatgtctccagacattgctctgaggggcaaaatcggccaagattgcaaaccactgcactgtgccaataggctgcttttggaatgtccaagactgcctggcctctccaaaggagagtagatagatggctttttgaatgtagcatgagaggcagaggtagagaatataggagcttctgcgtatgcctgaaagtcagtcaggtaaggcgcttttagttttctgctgaagattacccctcaaaaaacagggctcttatattcagatctttacaaagtcatttccacctgctactgagggtctaatggacacacttctctgtccagtctcagaaattggcatgtccgtccttccggttgctcagccagactccttggagcttttctaatgcccctgtcgaagcatcagcaggccctgcggctgtgccatcagaaggcgtggaggcctgccgcgcctccctctgttgctgctccaaggtcggctcagcactcttcactgcctagattttcacagtggccttctaacccatcaccatggccactttcaccctcgtaccctagtctctaccccgctgccaggatcgtccttcaaaaataggaatgagatcctgccaggcccctgctcagaatcgtccagcggctccccacggcaggtccctcgtgtggggtgcagagccctgcgcagcctgggccctcacttcacccggccttacctcctgctgctcactcctttctctccagctaagccacactgggccccttgctggtgaccgtgcccacccccctcggggactttgcacctggtgttcactgtgctgggaatcctctgaccccacagactgcctggctcacgcttacatcttttcagatgccacttgcaggtcttccttaaacaaccttggcacaagagctcccctcccacattgtccactttgtttttcttctcggctcacaagaattactcatttaatgaataaatggattactgagcactgtcttcattaccttaggttgaatatcagagtacactttggggagactctggagcctcaaatagccccacccagtgctagttttagatgcttatggcagtagtcacatgatccaattaattgaccagaaaaggataggatctcacagttacagatgttggaaattaatgagcccttttggtgatcactttttaaaaagcagtgtactgggtagctctgttgtggatgtcatggatagaatctgtaggattaatagggaaaaatggattaatgccagaccagggagtactattgtcaagtgatggcatcactggagatgcagaagtgctcttcctcagaccatttagacagggtggaattgacaggctctggaaactggctccagtgatcagcatcactagcgtgaaaggtgcaggtgatgagatgaaatatgggcagtacggcatttccaaatgcatatttcctatgtgagttgaaatgtgtacagcttacttgaccagtgcaattagtggatgtttgactgtttcctccaaacctccagaagtttctaattctgagccataattttgagtcttcacgctgcgaggatggggccttgcccgttctgggatgtggtgtgggaagcctctccctcattgtggcccccagagggtgctgctctgtgagtgatcgtggctgctctgcccttcatgtcccctccctgccagtgtcagaggagcagggagaggagacctctgggtcactgtgtctggtgcctgctttcagattttggaggcaacatcaacgtggagaccatcagtgcctttattgacggcggaggcagtgtgctggtagctgccagctccgacattggtgagtccgacctgggaggttctggtgctttccacttctccagggagttggagagcattacaaacagaagctgccaaattagcattcactgggtgggccttagctggggagtcagtgagggaaccgttttctcagttcagaatctgactcctggaggcagaataccacactgctgtccaggggtccatctggggctgagcccagctggatgaagctgcagggcactggggctgacagagagggagtcacaaggaagccaaggacacttggcccaaggcccccctgtaagggctcagctaggtgtctcttcggtctgtgcaggtgaccctcttcgagagctgggcagtgagtgcgggattgagtttgacgaggagaaaacggctgtcattgaccatcacaactatgacatctcagaccttggccaggtaatcaggcctgtcaccttccaggtttcaggggcatatggcaaagctctgcttagccaaaagccaagagggtgtgaggaggttctccctggcttggggaaccttttcctgaccacccacctttccatctactctttgcagcatacgctcatcgtggctgacactgagaacctgctgaaggccccaaccatcgttgggaaatcatctctaaatcccatcctctttcgaggtgttgggtgagtgagtgagcagggagaggacagcagaaacctgggggaagaaggggtcacttaatttttttgggaaatcaaggcaaaattgtaattctttaagggtacgtagatgggattaatttgttatatcaaggccgagtatagtggctcaacctgtaatcccagcgctttgggaaggcctaggcaggaggatcgcttgaggccaggagtttgagagcagcctgggcaacacagaactcctctctttaaaaaaaaaaaaaaaaaaaaaaaacaaaaaaaagttggccgagcgcagtggctcacacctgtaatcccagcactttgggaggctgaggtgggcagatcacccgaggtcaggcgtttgagaccagcctggccaacatggtgaaaccccgtctctgctaaaaatacaaaaattagacaggtatggtggtgtgtgcctgtagtcccagctacttgggaggctgatgcaagagaattgcttgaacccaggaggcggaggttgcagtgagccaaggttgtgccactgcactccagcccaggtggcagagcgaggtctgtctgaaaaacaaaaacaaaaacaagtcagactccattgttatatcaagacaagagctaagtggttggcaattaagaaaaaaggattcattcctgggaagaactggctctcggggatcccatgtccttgggctcagttcctggggccagtgctgggctgctctcgtcctgctgcaggatggtggccgatcctgataaccctttggtgctggacatcctgacgggctcttccacctcttactccttcttcccggacaagcctatcacccaggtaagggcttcacaaccttgaggcttcgaaataaaaatgaagcagaacagcacatttggctgaggcgaaggaaatgactagttggtggggtggggcatgggcagaagcggtgtggtctcaggctcccccttcaggtagggccagggtcgttttggtctggcctgctgtcctcttgttcgggaggcgtggcagcttttcccttacttggaactgcttgggtcacagcctcgttttgttcccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtagctgccaggaggcttaggggccggggatccgggtggtgcagtgtgtgtatatggggaggactcagaaggggaagaaggaggcttttagctaaaagtgtcagaggctgagtgtttcaggtgctgtcagattatttcagggctttattgctatattgctggtattggcacttccaattttttaaggtagtagtgacttatctagagatccctaacctccaccgttccttttagaaatttgtgtatttgttgtgcagatgacaagcaaccagccatatcttttcgtttgtttcctgcgttccctttaaccatgagtccctaggtgcccaaggcctacaggcagaacttcgctagggtactgtcatggtggacatgagtggtcctgcccatcaggcaccactggaaaggtggctctggtgcccaagctgctcctgtttccctcctgcaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggtaagagatgtttggggtgggagggcccaaagggtttgccaagctgactgagctcagctcagaagcacttattgaacacttctttgctggcctaaagggcataaataaagatgaataagttaatccctacacctaagcatgccaggtgagatgcagagcctggcgtgaaaactgatgtcctaataggagcacttcttttgaagaggtgtgtgtatttgctatggggggcagcagtgggaggggcttcactgattaactctgcccaggaagttggacttaataagagaaataggtcattaggttgaatttgttaggcaagagaaagcgaatatggaagcatgaatacttgaaagtgcctggcacatgtcggggcaggagggtggtttgggtccagactttgatgggccatgaatactgtgtgaaggaatctaggccttcagagaagaggcagagatgctgtgttgggggattaaccttgctgaggagagagactggttactgatcagggccgggtggcaggggcatctgcaggtcttctgaactcctgggcattcctgccatgttcgtcgggtgggaattaagtgcagctctgcctgcaggtggtggaaggcctccagtcatggccagccctggctaacctggccttttatctcaggagtatagcatcgtgatccagcagctctcaaatggcaaatgggtcccctttgatggcgatgacattcagctggagtttgtccgcattgatccttttgtgaggaccttcctgaagaagaaaggtgagtgtagttcctgcacgaggatgctgccagaaacggccccaggcctcacttgctctcgaggcccaaccaggaaaagctctgggaaacccctcccggttattcttgttggttcttccgcaggtggcaaatacagtgttcagttcaagttgcccgacgtgtatggtgtattccagtttaaagtggattacaaccggctaggctacacacacctgtactcttccactcaggtaagcacaggtgacagcttctgttttcagctagcatgtgccctgcctgggctctgcagtggccaggtcctgccacctctgtcctcctgcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaa

SEQ ID NO: 37028 - DNA, 8662 bp, Homo sapiens
ggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagtgagtgcggcctcgggggtcggggaatcaaggctgatagggaaaggtaacaggctggcccggaaggggctggagcggaggggtcatgcggactgagctactgaggggcccgcaccggtccgctgggcacggcgtggtgggaagacccggtgtcgcgcctgggacctgagcgggcaggcccaggctgaagtctatggaggtgcgggtcggcgaccaggatgagcgcagagaggggaccctggcaggctccgacccgaggccgtttgttaggaggcaagacgtgttttctcttgttcctatccttcattcccgattattgcttcctctgattctggcagcggcgaggccacctcgaaaaggaagcgcccagctattggcgacagaagtgcccctctgtttttgtagcgtctccggggcgtcaggagccaagccggcacgtgttgctgggtcccattgcggatggctggcccccttcttactccgctagtgtccctgacaccagcttccccaccaccagcttccccaccacgtgctttgctggagcctttccttctttacttcagctcttaccctggtgggggcccccttctaccttgggccagctaaggagaccgttggagagcactcctggagcttctaatgcaagtcttggagatatatatggcttttcttgaagttactcattactaccacctttccaatctgtgcagatagtcttagttagcattcacatttgttgttctcagtgacttgacaactcaaatgttttggggtctccgtcttatcccaactaggcaagcttgtgaacattactggaaaagggaggactgattttaggattttcacaagtcatccttactccaggtgtgctctgacgatctcagcagttgcctgtcactctaggcagatgccactttctcttttctctctttccagttagcctttccattttattccagttagggagatacaaactgcttgtcattgtgcttttaaatggttttaacagcaaagatggtggggaacaggtatttaggatgcctcccgtcctgtgggtgaaaatctgagttttaccagctttcaaagaatcaccaaaactgagataccaaaagtcaaacctgtgctttatatcacagtggacatttagtatcgtaccctggtttttggtgccttttagtatttgagatactagtggtttgaatcagaaaatctcttacagtttataactttggcctcatatttcttttagataagccatgatcccccgaaatgaaacccagggaccttagattaagtttccttggcttatgcacttgtttatgaggaaataagtctatatagattgagattcctaacacctaattagagtgtctgagaaaggaatgcggtaacatttaacagtgcatcggcttcgagtcagcaattctgtctaccttcttgtccctgatgcctataaatttcatctagtctttgcgtgtatgtggggataccatggcaagaaccctctgaagttcataactctgtcctgtcacaccaaaggtagcatctttggaaagtctgaggccttgcctagggagatggattgtatatacccagttgtcacataatgtaaggaagagaagggaatgttgacctttcagcctcagggcaatggcaccagggagtattatggaaactcttaaattcaacttccaggtattccttgggtggtaactagacaatgaatacatacaaggctgacatgatgggattctgtcctcaggggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtaaaaaaaaaaaatccctcactaattttccgtttgacccttatttggtcctatatgtttttatttttttcactgtaatgacgcagtccccaccccagctctggctgaggtatttggaaatttggaatggcaagtgggatacaagcagtttcctacctaatccaaactgatgaaacttaagcaagaccctgaaaaaatccttctacatttctgaagggcactagggctcccgggagacagcaaggcagtaggctgatgattctttctttacaggtattgcttttcccaccagcatttcggtaaataactgtgtatgtcacttctcccctttgaagagcgaccaggattatattctcaaggaaggtgacttggtaaaaatgtaaggttaaaccgttttaaagcatttttctttttttaaagcatttacaaaatgccagttcctaatgcagtactctgatcttgcctttcagtgaccttggggtccatgtggatggcttcatcgctaatgtagctcacacttttgtggttgatgtagctcaggtaggtggcctgcttttgatctctgtttagccttggggtagagggaatgcactgccatttgcttcttatccccacccccaatcaccacgtaagttgagagagtctctagagaagcaaaaggagaaaggtttttgttgttgttgttgtttttaccctcctgttcattggctggtcttcgcatatgggctcacagatattaaccagatagccagctgagttaacagactttccaggaagatactgattgcatgtccttatctacaggggacccaagtaacagggaggaaagcagatgttattaaggcagctcacctttgtgctgaagctgccctacgcctggtcaaacctggaaatcaggtaagctattttatccaattccaaagctcgtttgaaccaaagatgcattaggcacctatagctactctatatgaaactaccaacctcccctacagaccccttataaaacagctttttaaaattagctatatttagctgggcacagtgactcacatctgtaatcccatcactttggggggccaaggtaggaggatagcttgaggctgggagttcaagaccagcctgggaaacatggtgaaaccccatttctacaaaaaatacaaaaattagctgggcgtggtaacatgtgcctgtattcccagcttccagggaggctgaggtgggagaatcacctgagcctgggagattgaggctgtgctgagctatgatcatgccactgcactccagcctgggcaacaatgaaaccctgtctcacaaaagaaaaaggaaaaataagcatttgctgtccccacaaaacagattagaatgccaggtaaaaaaggataaacactggacttaatattataggcatgtggtggcacatgcctgtaatcccagcactttgggaggccaaggtgggaggattgcttgaacccaggcatttgagaccagcttgggaaacatagcgagacccgtctacaaaaagaaaaaagaaaacccaggtttatgaccaagttctttcacttaacactcatttaacctggggcaaatcatttaacctgagactcagtttccttgtcttctagattgggatatacatctgccctgttcacatgcaaaatttattgagttagaccatctttgtgaaagcactgggtaaaatgatatgcagttacagctggtcctcagcttgatgctacattcagtagaagctatactttgagtacccatacaaccattctgtttttcattttccatatagtatttagtaaattacatgagatattcaacactaatataaaataggcatgtgttagataattctgcccaactgtaggataatgttttttaagtgctctgagcacatttaacataggctaggctgtgatgttaggtaggttaggggtattaaatgcatttttgacttagtgatattttcaacttatgagttttttggagatgtaaccccattgcaagttggggagcatctgtataaagtatttttagattgtagggataatcaagctatgaaatgaaaaaccagtgaatgacaatcattggggcttgatggaggatattagaacgctcagttctgccaggtgcaatggctcatgcctgtaatcccagcactttgggaggctgaggtgggcagatcacgaggtcaggagatcgagaccatcctggccaacatggtgaaaccccgtctcttctaaaaatacaaaaattagctgggcgtggtgttgcgtgcctgtaatcccagctactcaggaggctgaggcaggagaatagcttgaacccgggaggcagagattgcagtgagccaagatcacgccactgcactccagcctggtgacaaagccagactccatctcaaaaaaaaaaaaaaaaacgctcagttcttttatgcttcttattctcattgtagagaacttattagctcctgatatctcacctttcatttgatgttgtacttctagaacacacaagtgacagaagcctggaacaaagttgcccactcatttaactgcacgccaatagaaggtgagaacagataacagggttgagggtctaagaatgagtggctttgccaggtgcggtggctcacgcctgtaatcccagaactttgggaggctgaggtgggcggatcacctgaggtcaggagtttgagactagcctggccaacatggtgaaaccccgtctctactaaaaatataaaaattagctgggcgtggtggtgggtgcctgtaatcccagctacttgggaggctaaggcgagataatcgcttgaacccgggaggaggaggttgcagtgagccaagattgcgccactgcactccagtctgggcaataagagcgaaactccatctcctccatctcaaaaaaaaaaaaaaaaagaatgagtggctttgcagaattgaggcttttgctcccttgaagatctatcctggctataacccagtctaagccagaaatctcagagccctgtgtttccataaccaggtagttgtctcactgcctaccacttcaaactactgaagtgggtggatttggaaaccttttgggatactggatagcttgttccataggttgtgtactatctacaggtatgctgtcacaccagttgaagcagcatgtcatcgatggagaaaaaaccattatccagaatcccacagaccagcagaagtaggtgccaaccctacttattaccttctaccacacaagactagtcatcaggtttttttctatactcccaactgaatcttgtccgccctctactccatgttttcaggagtgacctgttgctcttaatattccctttctctaggccgggcgcggtggctcacgcctgtaatcccagcactttgggaggctgaggcgggtggatcacctgaggtcacgagttcagaaccagcctaaccaacatggcgaaaccctgtctctactaaaaactacaaaaatgagccaggcctggtggtttgtgcctatagtcccagctacttgggaggctgaggcaggagagttgcttggacccgggaggtggaggttgcagtgagctgagattgtgccactgcactccagcctgggtgacagaatgagactctgtgtcaaaaaaaaaaaaaaattcctttctctctattccttttaggaaggaccatgaaaaagctgaatttgaggtacatgaagtatatgctgtggatgttctcgtcagctcaggagagggcaaggtgaggagagtaccagagttggcaaagaggggtgactgagagtgttcaccagaccaaatgttacttaaattactctttcaggccaaggatgcaggacagagaaccactatttacaaacgagacccctctaaacagtatggactgaaaatgaaaacttcacgtgccttcttcagtgaggtggaaaggcgttttgatgccatgccgtttactttaaggtactaagcaatgatagtacttggaaccagtctgactcacagaccatacacccaggaacactttttcctctcccttcctgcctagacttgtagcgtgcatgtgctcactccctccctctctctccccatctccttctcattgaaggtaatgtaaaagagcaatcctaagcatgatttctgcctgagggtaggagctattttaaaatatgagcaaaatggtaagacttgatggggagttaaagatacctctgaatatcatcttccctgccagagcatttgaagatgagaagaaggctcggatgggtgtggtggagtgcgccaaacatgaactgctgcaaccatttaatgttctctatgagaaggagggtgagttccaaaaagagcttcactttggattccctgattataagatatccttcctgtaagttcagaagagctaagtatgacaaaggaactttttatcaaaacacatcttcatttttgccataggtgaatttgttgcccagtttaaatttacagttctgctcatgcccaatggccccatgcggataaccagtggtcccttcgagcctgacctctacaagtctgagatggaggtccaggatgcagagctaaaggttagtatggaatagaaggtggtgagtatgtacatggtatcctgcttgggagtgagggctaaatgccagcaaagtcctgaaaagagctgcagtactgaaagtaaccctttatttttaatttcctccacatttctcaaaatttttttcccttcttcctgttttccaggccctcctccagagttctgcaagtcgaaaaacccagaaaaagaaaaaaaagaaggtgtgttattaacgatcattcctctctggcagggtgaacctgatccctctttctcccactgtgttaagttgtagtgaaatacggatttttatacagatgctcctcaacttatatgatagaactttgtcccagtaaacccatcataaattgaaaatactgtaagtcaaaatggattttaaaatatatatatatatattttaagagacagagtctcaaactcctggccttgaacagtccttccacctcagcctcccaaactgttgggattacaggcatgagctgccatgcccagccttgctttggccgggcacagtggctcatgcctgtaatcccagcactttgggaggctaaggcggatggatcacctgaggtcaggagtttgagatcagcctgaccaacacagagagaaaccccgtctctactaaaaatacaaaattagctgggtgtggtggcacacgcttataatcccagctactcgggaggctaaggcaggagaattgtttgaatctgggaggcagaggttgcagtgggccgagatcgcaccattgcgctccggcctgcgcaacaagagcgaaactctgtctccaaaaaagagatgatctcactgtgtcacccaggctgacgtgtagaggcatgatcatagctcactgtatcctcaaactcctcctgggttcaagtgattgtcctgccttgacctgctgagtagccaccaccatgcctggctcaaaatggatttgatgtaccttaacctaccatgaacctcatagcttagcctggcctaccttgaatgtgctcaaaacatttattgaacaaattatcatgtatcgaaatatccatattgctttcacgccattgtgaagttgaaaaatcacaagttgaccattgtaagtcagagacctgtatgtctttatttcagctgtgacccagaggattgagataactttatggctgggtgtggtggttcacacatataatcccaacagtttgggaggcctaggcaggagcatcacttgagcccaggagttcaagatcagcccgggcaacatggtgaaacctcatctctacaaaaaatacaaaaaagttgtacatggtggcatatgcctatagtcccagctacctgggaggctgaggtgagaggatcacctgagcccagggaagtggtaccactgcactccagcctggaaaacagagtgagactgtctcagaaaaaaaaatacttttatctctggtcccagacatccccaagtagttagaaactgacaggtcttctccctctccttttcttgcatataggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcatttttt

SEQ ID NO: 37029 - DNA, 37197 bp, Homo sapiens
ggccggctagagccgggggctgggcggggaccgggcttgtcggtgaagcggcagtggcggcggcggcggcggctcggcaggcgggttcaggcttcgggggccaggtcggttgggtgggtgggtgtctccacagtctgcgtgcgtgggccagcgcgttcgtcttacccttccctccaccccggcccctctccccttctcccctaacctcctaccccacccagccccactcagggggcagcagggccgctccctccgtccttgcctcccttacccaccctcaccggcccttgtttctccttcccctgggggcagccgccgccatgatcctgctggaggtgaacaaccgcatcatcgaggagacgctcgcgctcaagttcgagaacgcggccgccgggtgagcgcgcgcccggggccgggggtggcgggggaagcagagttgaccccagctaatccccaatgttgtccagtcccccagacctggaggagagaaatggggtgcctggcagggtgtaggggctgccccagcggggtagacgtgggaggcgattgggcgcggccgggcgaggggcagagatgcgtggggagaggctcagaggagggatgcggaagcagcgagtggtgagggctgtgcgtgccaaagggcaggagacctgtgggacgtgggggaccctggagccggaactcgctccggagtagccccctgccctctggggcgagaaggggaccccttccctgcgtgaaattccccggcattgttctgaacccagagagagcctgtttggaattgggttggaaggagttttcaggaattcccaggactggaggagggaaggagatgcaggcccacatcgccaccagcattctcgttccccacccccatctcctttaaaaggagcagaagagaagactaaaagccgacccagtcttagagccggaaaaacgcgatctctggtttcccttccccgaacccttctgtgagagacactgggccattttgttacatatttttaaagcaaagccaattgtccctcgctccacaccccttccttatctctcctttgaggttctaatgctctctcctcacccactagcctttatctggttatcttgtaaattcttacatcaagaccctaggtctgtgatttcttctgtggtagccctggcccagttacacacttcaaagactccagaatctataaagttcttagataacctgtctttacgattggactttttaaaagatgggcttagggcatctttccaaggcagcctctctgccaaacacaagaatcagtagaagacaatctgctcctccaaagctgctttgcttttctagtataatatttaaaacatgagctaaggattttgggttctaatttttggtggcctgtggccagtccctttgcctcatttccctatgtatgagcatggggcttcacatctgggtttcacagttaataagtgcagaccgtttctggtgaactgggaactagtaataggaaagtgcttgcagatccacagatgggagaagattggtagaggggaatttttaagtggtcataatgtacttgtggcttggaggcattagaaagtattaactgccatttaaattgaatatatagtatgtcctgtctcctttataaggccacagattttatctgtaaaacaaagcactactttccttgaagtaatacgtgtagtgagcagtactgtttcctgccaggggctgcagttggttatatttgaggctgacttgcttctttcttgtcttagcctctcttaccagtttctttgcattttaaatattcaaatgaatcagcccagagtcttattttgggtgattgctgtatacttttttctgagcagtgtaacacataggaggaagttgaattaacttctgcattttcataactgatcttaatgcattctcaggtccagactagcaaagaatgagacctgggcggttataagctgatctacaagataaatggctgtgtattttcaagtagaggcatgtcttttaacataggagtacattctcatctatttgtgtattaatgacttgtgattccaaaatgtggcccattattcggaacttcagttctttctttttcttttagaaaattattcttaaaaagagaagctaaccatttcggagggattaaataggccctcaagtctggaagacataagttagaacttccaggacttttttttttttttccgagacagagtctctcactggctggaatgcagtggcgcgatctctgctcactgcaacctcgccctcccaggctcaagtgagtctcatgtctcggcttcccaagtagctgggattacaagcacgtgctaccacacctggctaatatttgtatttttagtagagatggggtttcaccatgttggccaggctggtctcaaactcctggcctcaagtgacccgcccgcctcggcctcccaaagtgctgggattacagcactgctcctttcctcaggacattttttacaaagatatgcattgtagggaagctgtatagggggtgcactggtgtgtatgcttgtgcacatgtgcgggtgtatgtgtgtataaatctaggcttttattctggcccatctccccctttgagatgtggttttcaataagcaggctcaaaacattctgctgaaaatttgaaactttgaaaatctttaaaaaaaaagagaccatgatattgtgcctggtaggcagggctctcctgggattacagatgtatcacccagtagaagcccgaatgaagcaaatgtaaattatcagacattccagtaaggtaaggcaaggtgcatgcctattccagaacttacagcagagtttgcctagtgtggttatcataaacatgtatgggattctaccagtgctcagcccaggcagcaacagaaaaaaaggggcctctctgagagcctattagccaagttagggaggtgctaaggggtgaaaggtgttggggtggagatcagagaaagacattaaagggagtagtttggaggagaaaccctggagatttgaaaggctttgctggtgtgggaacctgctaggagaggtcagctccaccctactttttgcacttctcagaataaaccgatgggggaaattacagttcggagcagccttttccagagtgcatcttccatctctgtgatgtccaataagatagccatacaaagtggctggctaaatttaagtaaaaattaagttgaaataaaattgagttcctcggtcacactagccacatttctggtgctcatttgccacatgtggctggtagctgttgtatttagcacagacatggaacatttccattattgcaaagttctattagcactgttccagcttctgaaaatgaaagcatgagatggtcttaaaaatagttctgtggcatatacttcagaatatagttgcattaattttccatttgaagttgattttttttttttttaatgattcctctcagatcatcctgctggatcttctcaccagtggcctcctactaaaagtatcagctttcttttgggtaaagcagtgttgtcatctaaactgtttaagaatacatttgatcataaccttttaatttggaggcagtttgacaaagcctaaggttcattccaaacagattgctttttaattttttcctacacacttctgggaagtggcttattgaaacaactcatagattgtcacaaaataataattattggtaaattgtcttcccagcagcccacaaactaagagaatgtgactgacttaaaagctatgcccaacactgcaaataacctcatgcacaggtctgatcaacagcattgccttttcatttggaaattcttacccagaccctcaaagcaaaagtaatcagacaaattaatttaattctttcgttagtgtacacaccaagaaccgtttcataactgagaagctaggcctgtcaacttagctggagtctggagtccaaaattgaggaaattctgtcagatgcaaattgctgttggatttaagtgtgtgctggctccgtgccacagccagtgtatattgcggggagctgtggttccatgggggggagtgaaactcagtaagcaagcagtgccagttggggtgggcgaggatgatgggaagagaaatttgaaaaaggaataaattaaatcttgctgatactctgttctcattcccaaatatattgcatatgtcctcagagagacaggctgtttggagtgatttggaattaggacattgtttaagcatttagaagaaatggaatgttgtgtccaactcagtaagaagacctggttggtctttttacaggtcactgtagttaattacacactgccacctgtcctgtggcctacttgggaccactttggtcctgaagccccagagctgtgctggaccaaactgataactccttaagagctgggtctatcactttaatcatctttgtttccccagcatcctcattgtgtatatagtcaactcagtaaattggtttattgaagaaattaatgaagccagatagaatgattccttgtttctttaggagctgacatttttgtgacattgagtaaatcagcttttaggtctctgttctccatattttgatatatggcttagtggagaataggaccacctcttacctaatatgatctatttttttaggctttgctcaaaaagaatgatgggagctttatagaagatttaaaggagaatgctcagaaacctttatagtgagcagaattcagtaattcctctaattcaggacataagaagggataagtaggagagagacataaatgcccaaatggggaattggggccaggcaccctggctcacgcctgtaatcccagcactttgggaggccaaggagggcggatcacttgaggtcaggagtttgagaccagcctggccaacatgacaaaacatatgtctactaaaaatacaaaaattagccaggtgtggtggcgcacacctgtaatcccagctactcaggaagctgaggctggagaatcacttgaacccaggaggcggaggttgcagtgagcagaggtggcaccactgcactccagcctgggtgacagagcgagaccccatctcaagaaaaaagaaaaaaatggggaattggatcctagggtgcattcaggagtaaaaaccccaaagttgttaatgagaaaagaagatgagataatacagttgccagaagccctttctggattgattattgacattctagaagcttccttagagaaaagatagaagaaaattttttctaaagggttttaagaatagctcttaaaacctgtctgaatgaattgattatgttttagtgtcttgggttgtccaggcagtaactctgaggacttacccagccggcttgttctaggattccagacattacagcagtctgacacttataggagttctgtttttccttgtactgctaaccaattcctgattcagggaattaccgcaatcctaaaacctctcccaaccacagcttcagagtccgatctctgactccacctaggagaagaactaatttattgattaccttctatgagctaggcactgtgctatatgccttaacatggtttcatttcatttctgtgacagatagtggatctcatttacaactgagaaaaccagggctcttgaggattgggggtgggggtagatattgaataagtaactactacatattaagtaagcaccgtgcaggcatccttcactgtgattcttgaccttgtttatcgtatggcacacagaacatgattgtatttgtatggcacatttgggtaaatggtctagcctctcagagatcctgccacctgctgcctgccctaagggatatggggatcattacctcagcatatctataacttaaaagacaccgtttgagaaactttgctgtacagtagtccccccttatctgtggttttgctttctgcagtttcagttacctgcagtgagcagtgaaccatggtctgaaaatattaaatggaaaatcccagaaataaacaatccattaattttaaattgtgcaccattctgagtagcataatgaaatcttgcgctgtcccgcccaggacatgaatcatctttttgtctagcatatctacagtgtgtacgctaccctctgttagtcgcttaatagctgtctaggttatcagattgactgtcacagcattgtagtgcttgtgttcaagttacccttattttacttaataatggctccaaagtacaggagtaatgatgctggcaatttggatatgccaaagagaacccatgaagtgattcctttaagtaaaaaaagtgaccttggtgtttctttgctacagttcagtgctatccacacttttatttatccactgggtgtcttggaacatatcccccacagataaggggagactgctgtactgctggacatatatcatctcagtcttcacaccaacctgggaggtagatgttttgtccccattttgtagaagaggaacctgaggcccggtgacatttgaggagcattgcctgtggtcacatagccaataaattctgaattctaaataacttgctttttctcacccccagcatctgaaattttagcagctggtagaacagtaaataatgtaactattaattctgggggcctatttagtggaacacttttcctgggccagtcttcctcccgctcctttgtaattttaaaccacagaagtaaaataacaaacgccaggtcttggaattgagaagcaatcttgtgatggtatacttcacgctcagcaaactcatcgttaaggcactgagttctcggacctctaactcccagaagacttcccatgaagtctcctttggcctaatactctcctcagcagccattctctctcttctagccataaatagtaaactaaaatattaatgaatgtgatttgacaaatattgctaagtcagacagcagaccacttaagatcgatcgtagcaacttttcccacaaggatctgtgctcaggatactttatgcctagagaaatttgaaattagagactcaaagtgtgtatgacttggagcccaaaggttatttatttatagttggtttttctcaggtcttttgacaaagtaggagagtgaggaactcagcccttctttggctgaattaaaacctaaaggttaaaaaaaaacttactaagtgatgtaataatgggcttttataaactccctgactcttcagcacagtcagccttccccaggaaagtatgcttccatgcttcctcccattggtcatcctcttaatatttcattcagttggtccatgattaacatttccatatttttgttctttgctcttgttttctagaggtgaggaatggtattggactcgttgcctttgtttcctggctacagtttcaaaatgaaggctcagaagcaatttaaattttcatctagttttttccttctattctgaactctctgcttctccgtaaacccacttgatacttcaattcgtagagatacccagtgcgcttttcctaagtcacatatagggctttgaagaagcaaggtgaagctttgtatgattcgtataggttgatttttcagcagggctagcatgcttcatagaagccagtttttttgaaaggtattgtctggcttctatatcagctttttaacactcataaaccatgttatatattccattatttcccagcatccctggagagcaacttagtcttcgtttctttcgcaggtaatggagcagagatcgtggaaagatacgtacttgattaagaggtcttgagcaagttagacaaaaataaatgtgaaaacatgcgcatcttgtttgctagcccctaaaacaaagtggaatcattgagtttacaggtagctagctggtaaggcaatagtcttcatttgcttcctactttggacttcaggtctgttcttgtgttatatgtagtagttccatgaggtaaataggttcatttttattcccccattttattgatgataggggagaatgcaaaggtgtaagggtatttgtcccaaaacatgagcgtgatgagaaagctaaagttgtaaagcagatgtcctgactattcttagtgatttcatagtgttattttgtgttacactgtctattttaagttccgagctggaatttacaaagcaagacaaaactagggtagaactaaagagggtttcttgaaggtgagtggtaagtactttggtgatgtaaaggaagaaagaaagatgagtaggaaggcttacagacgggttttgaagtggaatagaacttgccgttttgtttatggcccgaaatcatcctttctctttaagcatattaaaaccattctacattatacttagccattttcctgctgaacgttttactcctaataccactgtcctgtggggaaggcattgaccaaaagatggcattttgtggtatatagcatgttgttaggaaattcagaattgaaagtgagcaccaaccaaagcagtagattcaacagcaggtgaaaaacaaaagctatagctggccttccttttttatctgaccttccttttttatcctctacttaaagcaagtccaaaggttcaggtccatgagaaaatgaattgtgtactctgattggcagtaacctaaaatttatacagaatggtctgatcttaagtgaagctcaggtgcctttccagttccctttgaaggtaagcagcaatacagtcatcttaactgaggaccttttttgttgtttacagaaacaaaccggaagcagtagaagtaacatttgcaggtaagcatctttatctcagccctctgaagagaaggtacaatatgaaaaataggaaataggctgggtgcagtggcacatgcctgtaatcccagcactttgggagtccgaggcaggtggatcacctgatgtcaagagttaaagaacagcctggcaaacatggtgaaaccccctctactaaaaatacaaaaattagccgggcatggtggtgggcacctgtaatcccagctactcggaaggctgaggcaggagaatcacttgaactgggaggcaggagttgctgtgagctgagatcacaccactgcactccagcctgggcgatacagtgagactgtctcaaaaaaaaaaagagagagacaagaaaagaaaattgtacctaaaataagctttgacatggattgggtgcggtagctcatgcatgtaatcccagcactttgggaggccacggcaggcggatcacgacgtcaggagatcgagactatcctggctaacatgatgaaaccctgtctgtactaaaaatacaaaaaattagctgggcatggtggcgggcacctgtagtcccagctactccggaggccgaggcaggagaatggcatgaacccaggaggcggagcttgcagtgagcagacatcgcgccactgcactccagcctgggcgacagtgagactccatctcaaaaaaaaaaaaaaaaaaaaaaagctttgacattttggatactgtccctcatcaggtctttttgagctctttataatagatgaccatttcatgtatttaatccactgatgactgacaatataaagttacctgctgataaattagaagtttggatttaattttgtggtaaaactgaggtttttttgttgtgttttttttttaatttggaaatattacattatcttcaagtagctgtcagtcttagtttgcctagcactagagtagtagggaaacatgaacagctagagatgtgttcatcaagtcagagagagatgttgctgctttctgttccctataaagaattaggtgttggtactatttacttgttaggtgaatgaactcagaggaatacaaccaccctttctacaacaagagtcctcgacaagatgatcttggaagacttttgcagctctgaagtgctgttacctggaggccaggcaccatccctttaccctcctactaactggcattgccagatatcccttcgtgattcccatgacagctccataaagtgatggcactcagcacctaattctagtttcaggaacctattcctagtttcaggaattacacaggctgagtcagtcctgtgtactgcagaaagatagaaccgaaaaagaggggagtcctatagattagaagcaactcaaaagataaccaaatgcaatgtgtggatattgtttgcatcttaattcaaataagacaacaatgcttaaaattttttgagacagtagagaatatttaaatacttgactgaatatttgttttgtttttttgagactgagtctcactctgtcacccaggctggagtgcagtggcgttgataatctgctcactgccgcctccacctccccgagttcaagcgattctcctgcctccgcctctcaagtagctgggactacagatctccaccaccacacccggctaattttttttttttttccagacagcgtcttgctctgtcgcccaggctggagtgcaatggcatgatcttggctcactgcaacctccaccccccgggttcaagcgattctcctgtctcagcctcccaagtagctgggattacaggcatgtgccaccacacccagctaattttttgtaatttttgtagagacagggtttcaccatgttggccaggctggttttgaactcctgacctcaagtgatccacccacctcggcctcccaaagttaacaggctgggttaacaggcttgagccactgtgcccggccttgactgaatatttgatattaagaaattgtttttaaaaatttaggcatgacactagtatcatggttatgttttttaacaaatagtcttctgtatcttccaaagatatattctgagtatttatggatgaaattatgtgttgtatctgggatttgcttcaaaataaatcaatgggaaggaggatgtctaaatgaaacaagaattgtccatgtgttaataattgttgaggctgggcaaggtggttcacgcctgtaatcccagcactttgggaggctgaggtgggcagatcatgaggtcaggagttcgagaccagcctggccaacacagtgaaaccccgtctgtactaaaaatacaaaaattagctgggtgtggtggcacatgcctgtagtcccagctactcgggaggctgagacaggagaatctcttgaacctgggaggcagaggttgcagtgagccgagaccacaccattgcactccagcctgggtgacagagtaagactctatctcaaaaaaaaaaaaatcgttgaagcctcatgatggagatgagagttcattatactgttcgttctgcttatatacatgtaaaatccaattatttcagcaccaagctgtgattaaggaaagaatagctttgtaattttaagaaagagcaaagaaacaagtgctcagcaattctatcccagtgtttctgctgatttgtcacatggatttaaaataagttccattttacttacatgcctccttaaaagtggtcttccttgtggcctacggcaaggtaggcgcttggagagattatttcccattcccaaattgttacgcaatcttatttgctttcctcacagatttcgatggggtcctctatcatatttcaaatcctaatggagacaaaacaaaagtgatggtcagtatttctttgaaattctacaaggaacttcaggcacatggtgctgatgaggtaagatccacatcattttccttgggactcttgtttcctcacctttcattggcagtttgccattcatggaagatccatggcactaaatcacccccacatgactacttgctcacctaactaggggctcttgacttgattcctataatgaattgtgtttcctagaaaaggttttgactcttgcttgcttgctttaaaacaatggaaacaaaaatagctttagttctccaaaaacatagcaaagaatacttttccttgatcagtacaaaaatagctgttgcaagaattaggttctgttctatttttgtaatattatcaaggcagatagataacttctagcttgtttaaattttatagtctcaggttctcattctggaggcttaggcacaaatagctgtcttttgaaatttttaattaaagctctttaaagctaccgtctttaaatatctcttctttataactaccataggggaaataagaaagatgtccagacattatgaaacttcggtggccatgccttgttcactggcttctttaaatagttaagtagcaggtttggttcctgttgaactgtatttgctctgaggagagccatttatggaagaaagaaaatgctattacaccagtttgtgcacgctgtggttgggtctcaaagcaggaaatatgactcagttcctgaatcagttttcaaatttcttagttttaacaaactaggttctccttaatctgttaaatgaagatataaccatagctgtttctttctgaaaagtagtagcttttgaattatttaaaacttatataataaaagatgatttgtaaaggaatatggtcaaaagcttgtttaattttttagcataaaaactaaaattagtcttaataccaagagccattggttgcttcccttagttattcaaatgcaattgattttctcataagttcaaagaaagaagaaatatttagaggatttggaatccagattagtttactggaaaaagaaaagcttcagaaagaagacctagtgcttttataaagcttatgaagaattgttttgtaaaagatagtggctgacacttctttaccagataaagagtgaaagaaaacaaatggctattaaagcagccctgcctcttttttttttttgaggtggagtctcactctgttgccccaggctgtactgcagtggcgccagctcagctcactgcaacctccaactcctgggttcaagcagttcatctgcctcagcctcctgagtagctgggattacaggcatgcaccgctacacctggctaattttttgtacttttcatagagatggcgtttcaccacattggccaggctgctctcaaacttctgacctcaggtgatctgcctgcctcgacctcccacagtgctaagattgcaggtgtgagccaccgtgcccagccttttcttttttttttcttttttttttttttttttttttttgacaaggtcttgttctgtcacctaggctggagtgcagtggcacaatcacagccactgcacccctcaacctcccaggctcaagcagtcctctcacctcagcctcctgagtgtctgggactacaggcacgtgccaccacacctggcttattttttgtttgtttgttctttagagagaggaggtttcactatgttgcccaggctagtttcaaactcctgggctcaagcagtcctccttcctgggcctcccaaagtgctgggattatagatgtgagccaccatgtccagctgcatcgctgctttggatcagctataactacctgaaaagaagtgttaaaatatttgaatagactttttttaaattgtgtaatcattctcccctagacagtcttcactaggtgcaagcctgcacagtggcacacacctgtagtgccaactgtgtgttgggacttcacacagttggcttgaggggttcaagtggggagagttgctggagcccaggagttcaagtccagcctggacgacatagtgagattccacctcaaaaaaaggaaaagatctaaatgcaataataataatcctggaaagaaagagttaagctagatttcttaaatctcctttccattctgtgcttttcttacgatggagctccagaacacattgctattcttgtagctaccacaagggtcaaagaaccagccccacccactcaagtgggtggagtaagtaacattcatagtgttggagcagagtgcacagtaaatggctccctgggttggttaaacagtgaccaacccatgataaccacaggaaggttattactttgtcacaggccatttttaaaggtggaatgcctctgctgctagagtgggaaggtaatggtgatgagtgataggttgcctccacccatctcctggtgtcattgggagagggggtacaaactgaaaagtgaatcatggttaaaagtgcaagtgaagtgacaaggaagtgttggctggttttaccaaggggagggagcaaagcagttgaacatgatataaatttggctctcagtacctcttagatctcagaatattaacttagtaagcttgaaattaaactaaatcttagggacttagggatttaaactaaatccccaccacatctgatttccccttcctcgaaataccaatagtacgtgcaacacagacttgtagctcagaggtcgcatgctgtttcaaattcttgggatatgcatgttacttttttttaaagaagtggtatatcagacacctgaaggtcaagtctctctgtgccaccaagaaactctcgtgaccttgagcccctcctctcaattcctcttcggtaaaagaaatacctcacagtggctgtgcaatcaccaaataggaactacaggtggcattatttatcttttgcccttgtgtaagaaaatgtagtcttgcaggttgaaaatttcttccagctataggaaaatggttaaataaatatgtggaatattaggaaattattgttcagccaggcgtgggggctcattcctgtaatcccagcacttttggaggccaaggcaggagcatcgcttgaggtcaagagttcaagcccagcctgggcaacgtagtgagaccctgtctttgtatataaataaataagtaggccaggcgcagtggctcacgcctgtaatcccagcactttgggaggccaagacaggtggattgcttgaggtcaggatttcgagcccagcctgggcaacatggtgaaaccccatctctactaaaaaatataaaaattagcttggtgtggtggtggacacctgtaatcccagctactagggaggctgaggcaggagaattgcttgaacccaggaggtggaggttgcaatgagccgagatcacgccactgcactccagcctgggtgacagagtgagactccgtctcaaaaaaaaagaattaattaaattaaaataaaatgtttgtttcttaagccatgtcattctggaagcagtttccaccaggtgaagcagtcacggtgacagagaaaaaaatagggagtctcagtctgttttttgttgctataacagaataccacagactgaataatttatgaagaaaatatgttatttgactcatgttctggggactgggaagtccaagagcgtggcaccagcatctggcaagggccttcgtgccctttcccgtcatcctgtagcaaaaggcagaagggcaagagagggccagactcaatttttttttttttttttttttttttgagacggagtcttgctctgtcacccgggctggagtgcacccaggctggagtgcagtggcgcgatctcacctcactgcaagctctgcctcccgggttcacgccattctcccgcctcagcctcccaagtagctggtactacaggcgcctgccaccatgcccagctaatttttttgtttttgtatttttagtagacatggggtttcactgtgttagccaggatggtctcaatctcctgacctcgtgatcaccccgcctcggcctcccaaagtgctgggattacaggcatgagccaccatacctagcccagactcacttttttaacagcccctcttgtgaataacaaaccaacttcccctataacaacatgaatccattcatgagggcagagccctcatggcctaatcacctattaccgtcacagtggcaattaaatttcaacatgtggccaggcatggtggctcactcctgtaatcccagtactttgggaggccaaggtagaaggatcacttgagcctagaagttcaaggctgcagtgagctattgtatcaatgcactgtagcctggactacagagtaagaccctgcttccaaaacaataataataatcgtaaattttggctgggtgtggaaaaattagccaggcatggtggtgcatgcctgtagtcctagctactcaggaggctgaggcaggagaatcgcttgaacccaggagatggaggttgcagtgagctgagattgcaccactgcattccagcctggacaacagagtaagactccgtctcaaaaaaaaaaaatcataatttttaacatgagttttcgaaaggacattcaaaccatagcagaaggtataaaaggggttcttggttttttgggttttttttgttgttgttttcatttaattcaaaaacctggaaagtagccagcagtaggttctggtttggggggaaagacatggagagtatacaaccttctggacaccagtattaatagctagctaagatttcattattgactgtcctttgccttaagagctggctatgcactgagtaattttaaagcatacaagatcagcagacaaacagatcagttcccgagagtcctggttttttctctttattcacctgggttagtggctcagtctgtacttaggttgataactaacaatctgttctctcacttggaatttggcatccttttgctctcttgaaaacaaaacatgattaagtacaatgtaggatctggaggagaacagagaacatattaagggtgtagtcaagtcctaaaaaaggatgagctttgattaaagattctcggccaggcatagtggctcatgcctataatcccagcactttgggaggacgaggcgggtggatcatccaaggtcagtagttcaagatcagcctgaccaacatggagaaaccccatctcaactaaaaatacaaaaaaaaattagccgggcatggtggcgcatgcctataatcccagctacttgggaggctcaggcaggagaatcacttgaacccaggaggcggaggttgtggtgagccgagatcgcgccattgcactctgtcccaggcataaaaagatactcatctcagttttgtgacttgtttggtgactaaatccacttcccctctgtctctactttcccatccaccaaatgaaagttaggaagaatgccaacttaggaagagcttggcaagtgcagtactttaaaaataatgaaattatcatggcctttggattaacgtatttggttttgttttgtttttattttctagttattaaagagggtgtacgggagtttcttggtaaatccagaatcaggtatgtagtcatgtgagcaactatggaatgacatgggaagagaggtgtcctttttatattatgctttttttacccaaaggatttcgtttaaatattattacaaatatttctgcatgagcccattcctaatttcaactccgtccataaaaatagcttttaaggggctttgctttgtccaatatggaacacagtagaggtacaaaattgatgtgtgacatttttaacatttacttgatggggccacatgactcttacttaatctttcagccagagggccacatttgtttgttcatggtgattaaaatggctttgaaaagaatgagcaaacattgattcccaccctcggcccttagtaattctgcatactacatatttggagaaagaagaggaatattcaccacactattcttgtgatttcaagtaataaaaatcagaccctttcttaatccagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtaagaccattggaacataatattttttactcaactattacaactttggtaccttgattagaaaagtcttctaagaaggaagttctctgtcactcttaacagcagttacttgtgctagcttatttcatcacctcacctattttttcagacagtctcattctgttgcccaggctggaatgcagtggtacagtcatagctcactgcagcctcctccaaatcttgggctcaagcaatcctcccgctttagcctctccggtagctgggaactacaggcacatgccaccatacccaattaatttttttaatattttgtagaaacagagtctcactgtctgctgcccatactgccaaaacagagtaaggaggtctcaaactcctagccttgagcaatctacccacctcagcctccgcctcccagagagttgggatcacaggcatgagccaccatacccagcaccttttttttttttaatctccaaattggcgggatgaatgtgtcacagaaataaaagccaagataacactgtaggcttttggcaaaatcaaggtattaaaagaaagaaacaaacagatctagaacagaaaaatcatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctcaaccaggtgcagtggctcacacctgtaatcccagcactttggggaggccaaggtgagtgaattgcttgagctcagaagttcaggaccagcctgggcagcataatgagatacctgtctctataaaaaatacagaaattagccaggcatggtggcagccacctgtaataccaggtactcaggtggctgaagcacgagaatcgcttgaacccaggaggcagaggttgcagtgagctgagattgcgccactgccctctagcctaggcgacagagcaagattcagtctcgagaaaaaaaaaaaaaagaccgtagagtctctcctcctcttttttaatgggtttatctaggcacgtttggaaaactcagcaagttatactagatttttacttctcttcatcctcagtatattctgttcatcatgttagaagccttacttaaagacagactttaccttagctatagttttatttgctcttatttggcttcctaaaactagcaaacctcagctctaaatcttttcttttttaatctaaccttgtaatctgtgtgcttatttggttttcaagtacccaaaatagaatgatgattgatattatttaatactggagtgcctctccagtattaaataaaatgtgctaagcattatctagagcaaagatttagcccatcctcccgaagagcccatgctcaacaaaaaacacagacctcagccgggcgcggtggcttatgcctgtaatcccagcactatcggaggccagggcgggcggatcacctgcattcaggagttcaagaccagcatgaccaacatggagaaaccccgtctctactaaaagtacaaaattagccaggcctggtggcgcatgcctgtaatcccagctgcctaggaggctgaggcaggagaatcgcttgaacctgggaggcggatgttgtggtgagccgagatcatgccattgcactccagcctgggcaataagagtaaaactccatctcaaaaaaaaaaaaatacagatctcaggaatgcttttgggaaaaaatgaaatagtaatgaggtttcagatacttagaagtgtgaaagccatacagttctggtgaagttattcccgtcagttgcctagaatataaaatgatcctcagtgatgtagaaatattcttgcaaaaacatctctaggcagtttgacacttattaatcatttgattctataatcaagtgttccagccggcttctgggaattcatagtggacatgctgtaaaaaggcaggtcatccaatggtttcagtccatgttctgcacccgtattgatgacctgtcatgttccacacactttaagtattgaacattcttttaatgctcacaacattctcccctatctccgcaccccctgccctgctcctttttctttttttctttttttttgagacagaatttcactcttgttgctcaggctggagtgccgtggcgcgatctcagctcattacaacctccacctcccgggttcaagcaattctcctgcctcagcctccggagtacctgggaccacaggcgtgtaccaccacacccagctaattttgtatttttattagagacggggttttgccatattggccaggcaggtctcgaactcctgacctcaggtgatccacccaccttggcctcccaaagtgctgggaatacaggcttgagccactgtgcccagaccaccctacctgccccccaccaccaatttttttttttttttaacagatgaggaaattaacaagtcaggcaattttttttgtttttgttttttttttttggagctggagtctcgctctgttgtgcagtggtgcaatatcagctcgctgtaacctccacctcctgggttcaagcaattctcctgcctcagcctcccaagtagctaggattacaggcgcccgccaccatgcctggctaatatttgtgattttagtagagacagggttttgccatgttggccagactgctctcaaaactcctgacctcaggtgatctgcccaccttggcctcccaaaatgctgggattacaggtgtgagccaccacacccagcagtttttttaaggtcacaaaatgacaagactaggatttggacccagttctgttcgactcaaaatagagtgccctacacttatgtgtcatgctgcatttggcaagtcacgtcacttctttgaatctccttttccctctgcaaaacagtaaccttatctagcctgcagacttcaaaggtggttatggagatcaaatgaagtaaaatgttttaaaaattgtacaatatataccaataaaagctattggggaggtatatgtatgaacaggtagttggtttttctaccctgccacctcataaagagtttgcagtggcacgtagaagggtttatcttattatcacaaagctacccatttgctggccatactgatacttggcacattaaactatcagagaaatatatgtggctcctttacaactgtgtctagaagggtacatttccaatcagagttcccaggttctgactttctcccattacatatttgtaattagtcatctttgatactgattcaaatttttgattaacattaattatatatatttacaagaatcttataaaaattaagattttatttcacctcattttgccctgtgagatagatggaaatagactatattctacccaggttaaaagtacagataatgagacaaaatgtcaatagaacctgaaaaaagatttttttagttgcctctagtctctgtttacttggtatagatagtatgctgcttttttttttttttttttttttaaatgtaactgctgggttgttttttgtttcttgttttttctttccctccaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtgagtatagaatttggtcctgaagcctggatatggctgctacaccaccatggcacttactgaaagaaatatggcttggtcaaactttcagctgtattgcgtgaaaatgtttttctcataaaatgtcttaagccaggaagtagatgatagggcagaaatcagccactcctcctactctccagatactgagagctgacagatggtggaaagagaatccagtgctttcctttaaggcaccactgttctgagtcatgtttaagagtatagcctggataatcagcaggcagggtgaccataggtccatgttatatttacaagtcaataaaatctacttctgataatttccatctgctgcctctcttagggcattcattttgtgcactgactttgttgaccataaatatcatctcatttggcacacctttatattatgatttaagagatttatgactttagccttctgatgtacttgtagatcaagttattgacaaaaccccattctgattctgtacttatcctcatggattttgttcctctcaggtatgttgagtctaaaaaggacagagtcacagtagtcttcagcacagtgtttaaggatgacgacgatgtggtcattggaaaggtgttcatgcaggtatggagcagacatcttgggggaaacccatgcatggcgacttatacctttgcacccaaacataccatgagcgtaggaaagagatctagcaactctactgatgttagaattttttttttttttttcgagacggagtttctctcttgttgcccaggctggagtgcaatggagtgatctcggctcactgcaacctccgcctcccaggttcaagcaattctcctgcctcaacctcctgagtagctgggattgtaggcatgcaccaccacacccagctaattttgtatttttagtagagacggggtttctccatgttggtcaggctggtctcaaactgccgacctcaggtgatgcccatctcggcctcccaaagtgctggtattacaggcatgagccaccatgcccagccttgacgttagaatttgttgaagatttaatagacaactcccacaaaactcagtgaatattttttgttgctgctgctgttgttttgaggtggagtcttgctctgtcgccaggctggagtgtagtggcacgaactcagctcactgcaacctccgcttcctgggttcaagcaattttcctgcctcagcctcccaagtagctgggattacaggcacgcgccaccacgcccagctaatttttgtacttttagtagagatggggtttcaccgtgttggccaggatggtctcaatctcctgacctcatgatccgcccgcctcagcctcccaaagtgctgggattgcaggcatgagccaccgcgcccagcctgatattttttttctcagtggtttagttttgcaggacagaactaaagggtaagttgagaattaaacatactaactatgaatgaatgttatgcatccttcctactgtggggtctttgacctaaaactttgtcaggtttcctaaccctaacctcttgtgtttcctcagatttctagtaaggtggctgctcttggtttggtcctaaggtcttttcagaatggactgtatagccaattatttggtagtagataacgcatgaacaggtagagttgttgaactgacagactgagcctgagtttggatgggtcaccatagagtacttccctcacaagaagctcatcttaagaagagtcatgagaggccaggcgcggtggctgacgcctgtaatcccagcactgtgggaggccgaggtgggcggatcacgaggtcaagaggtcaagaccatcctggccaacatggtgaaaccccgtctctactaaaaaaatacaaaaaattagccgggtgtggtggcaggcacctgtaatcccagccacttgggaggctgaggcaggagaatctcttgaacctgggaggcagaggttgcagtgagccaagattgcaccattgcactccagcctgggcaaaaagagcgaaactccgactcaaaaaaaaagagagtcctgagagttagcagggcattttgtaattggatttttggtgtagttgcattcaggtcattgtgtaccagtctgctggccagttagttgctgcctctaggatggacatgagagttcattggtcaagtgacattcaggctggtttcttctgagatggctcagcattcaaaatctagtacaatggtaaaattttttgaaaacgttactaccttcattctgttccttggcagggtggtaaagatttttaaattctgaagcagaatctcttttgccaaatagagttgaaagacagctgtgcttaacagtaaagatactttgcatagccttctaagtggctaggaaaatcttcaaaagtgatattctcaactgctccatccctagtggcttttgtattttggctaattaatcagaaactagtttgggagtcactatacagaaaaattggaatattgacacttcagcatttgctagtgctgaacttgatgaaggaatatataaatatacatgtatctcttgggtcctaaaagtaagcctctagagaggcatttcatgtgtttttatgcagaattgacaggggaattaaatgcagtagctcagaaattgggctaaatccagagtaacaaaactaattttaaaagctctgaagtatatatttagatttggctggttttttaccaatcttattccattttattccaggaaacaacttatttttatactttaaacagatcttatcttggagagtgtaccggagatttgttccttaggagaattttgtgtattcttttttggcatatgatttaaatgcctccttcagggtacctgtggtagggcacttacctaaaaggaaagacaaagcctcttttgcattttggcactaacaggatctctggatagtaactggcctggtgcagtgctagctagactcaggaagtcatctgccctgccaccctttccaaattcagaggcttaggtaatttgttggaaatgacaatcggaaactggacttttgctggattttcccaaaaaataaatagaactttttcctaggcctggaattgtaaatttctcggaaaaagaatgagggacacctggcacagaaagttgtaccctgagaacactatttgaagttcctcatggtcactagtctacttgttgccagcctttgtggcctttcccttccagcatgcacatccagcctgatcagaattcaagtcttgcttttgtcatttggcaagcaggctctgagggatgctttctacctctcagaaaaagacaggaagtgtattcctccacactagtggtatgggcatatcagctgagtactggagaatgtctgatagaagccatcatttcaatgcttattccatgaaaagcaataggaccagtaattatgcttttggagattagcttatggtgaactagaattcttttcatattctaagattttaaagtcaagttagtaactaaataaccaggaaaagttaagtggaaaccactggtttttatatgttcagggacaaagacacaagcacctgcctcttaggcagttgtaaagatgtattttgagggccctttctgcctgtttgcatgtgtgggtatgtctgtaggatattttcctgaactgggaacactgagtccaagtcagtaattttggtagacattgccaaactcttctccatcagggtagtggcattttatcatctaccagtgatggagaggagtgcctgttttcccagagtatgttgtaaacttgtggatttctcctgatctgataggttaaaggtggtatctgtgtctgcttatgatgacataaaaagatgttctgaggtcagaacatcttttcttaatgttatagaccatttgattttcttatgaagtgtctctttatgtcctttacccattattctgtagggtcattgagcttctcaatttctttacatactagggagagtagcctttcatctgtgattaagagttgaaatattttctccagtttgtcattggaccgtgttttgtggggttttttccaccatgtggaagtttgtttttacataatcaaattaatcagtcttgccttttatggcttctagattttgagttataggtagaaagcccttccctactcgaaggttataaagaaatttacctgttattttctgagtatttttacagttacatattttatacatgattttttcttatttgttgagagctcctcttgttgtatggtatgaaagaatgatctttttttcctaaatggctatccagtggtcccagtggcaattatttccttttttacacccctgatttaagatgctacttttatcatatgctaaatgccttgtatatatttggatttattccgaacttcctatgataaatagtactttggaagagagaaataatctgatgctcaaaagacatcctagccagaaggagagtaaaaaggcaatattgcttgattacgtataacaaagatgccaatgaagatggagggctgtttgggtgtgtttgtttgtttaagctttatttaggagagagaactgaggagaagcaaagacatcagagaatctaaagaatagtcccagtcaggcacagtggctcacgcctgtaatcccagcactttgcggggcctaggcaggtggatcactagaggccagtttgagaccagcctggccaacatggtgaaaccctgtttctactttaaaggccaaaaattagccgggaatgatggcacacgcctgtaatctcagctactcgtgaggctgacacatgaaaatcacttgaacctaggaggtggaggttgcagtgagccaagatcacgccactgcactccagcctgggtgacagagtgagaccctgtctcaaaaaagaaagaaagaataggcccaagccagaaacgtatcgttgaccgagccttaaatatgttattttccatatacaaaactaatgagtgctaataagtcaccactggtttataaataccccatctcattgtgaataccacatgtacctgtgaattagagccttggagacacttaacagacacaagaaaatgccaacagttacgtatctgttctgtttaattccttaataccgaaaagtaaaaccagtaaaagttaaaaagcttcttaacccctttgtagaataaaaaatgttttctagagaagggcgattttagaagctttgctctagaaatttccatttgggataatcttgactccttcccttcctttttggatatttttccttcggggaacaaaatctgttcaaaaggggactaatctaacccagttgatggtcatttcttttcctacttaaagcttggtagtgttagcatgagaggcagtttgtgaaataggtgaggtcccaggctgggcattggggctcctcagccatcatctttcttttgccactaattgtcgagagggcttgctaatcagtgtttattcttcctgcctgcaactggaaacagcccttgcctattcctgtacagtgtgatgatactaaaccagctagggtagaagcacttgctttctctcagcaaggcatgtgctgcatagcctctttgaaagacagaagaataaattacaaagataaattaagcaggatctttgatttgaactcataacctggtaggggagccagatacattaatgaatggtaaaatatcatagtagaggtttgtagaaaagacatggcagctccagcaagagagcagtacctgcctgggtttgttggagatggtattaggaggcagtatttgagcagcagtagaagggcacgcaggccacatggctgtgtaaccatgccttcagaactcctaaaacaagagaccttggagagtccttggcagcatcctcctgctgtctatcatcttggaaggcccacttgatgaatttggattatccagttttactggcattgctagaaaatctacttctgttcttgcagatctggctgagagagagaagccttgtattacttgtctatttacataggaatgtatggactgtagaagcttcaggtttggagattggaacatagaaggaagggcttcctttatgagcaccaagacaactcagcttctttcattccattgtcttctgtccgcaagaagagcttaagtttgctctaaagattttattgatgaattctaaatagcaacaggatcctcagtgaaaaaagactcatgcaaagtcccagagcccagagaaagtatggtagtttatcacctatgttagtgcaaaggaaaaggattatcactacttttcatcacattttgaagatctgacttattaagtactttgcagtctctcccgtttgaatctgaagtgtagtggtagcagctagcacttgtcatatttcaggtttggtgtagtttatttttaacctcctgctggtctggagggctacaaaggtcacaccacatagaacaaaccctatagcttgagttgccactcatcttacacccacttctcttctggttgcttttgctttgtcttggcaggagttcaaagaaggacgcagagccagccacacagccccacaggtcctctttagccacagggaacctcctctggagctgaaagacacagacgccgctgtgggtgacaacattggctacattacctttggtgagcagggtgcacttgctgcttttgtgccgctttaatgagttcacacagcagaatacctaaatctgcacagaaccttggttaacattttaaggtaggcaaacgcaggcataccaacttgttcctgttgccattgcagtgactaaaggagggatgtcacagggtattaattacagagcaggccatatgctatttttgtacagtaatcctttcctttttttccccatttttcttaaatcttaaaaataagactgaattctgatatcaagagttaaggtcccttcaatagttcagctggtagagcagaggactatagctacttcctcagtaggagacgtccttaggttgctggttcgattccagcttgaaggagacaagtacagttttggctgggcacggtggttcatggctgtaatcacagcactttgggaggttaaggcaggtggatcacgaggtcaggagatcaagatcatcctggccaatgtggtgaaactctgtctctactaaaatacaaaaaaaaattagctgggcatggtggcgcacgtctgtagtcccaggtactccagaggctgaggcaggagaattgcttgaacccgggaggtggaggttgtaatgagctgagatcgtgccactggactccagcctgggcaacagaacaagactcttgtctccaaaaaaaaaaaaaaagagttgaggctgggtgcggtgtctcacgcctgtaatcctagcactgtgggaggccaacatgggcagatcacctgaggtcaggagttcgagaccagcctgaccaacatggtgaaacactccgtctctaccaaaaaaataacaaagaaattagctgggcgtggtggtgtgcgcctgtaatcccagctactcgggaggctgaggcacaagaatcccttggacccaggaggcggaggttgcagtgagctgagatcacaccattgcactccagcctggatgacagagtgagaccttgtctcaaaaagaaaaaagaaaagagtaaaggataggcggggcacagtggctcatacctgtaatcccagcactttgggagtccgaggttggtgggtcacttgggtccaggagtttgggaccagcctggataacatggtgcaggctcatctctacaaaaagcaaggggccaggcacagtggctcacacctgtaatcccagcactttaagaggccaaggcgagcagatcacttgaggtcagaagttcgagaccaacctggccaacatggtgaaaccacacctctactaaaaatacaaaaattagttggacatggtgacatgtgcctatagtctatagtcccagctactcgggcaagcgaggcatggcaattgcttaaacccagaaagtggaggttgcagcaagccgagatcatcctgctgcgctccagcctgggagactgtctcaaaaaaaaagataactaggcatggtggtgcatgactgtagtcatagctacttgagaggctgaggtgagaggatcacttgaacccaggaggtagaggctgcagtgagctgtgatggcaccactacactccagcctgggtggcagagtgagaccctatctcaccaaaaaaaggagttaagaagagaaccacctaagcagctagatgggggttctctgtcatttggcaattcttggttttttgcttattaagcccaagctccagccgtgatccacttactccactttttcgcggaataaattcaggtcttccttcagttgctccagcctcatgcactggctgattatgatagcttacagtttggaattaataagcttgttcacactgcacccaatgccactggaatgtctcctttgtgaaatgtaatttaattcacctcagtggtaaaggtgaacctgtttattggtgatgaatctgttgatttaccaaatttcattaaatctaaactatacacttttttcttttttctttctctctgtcacccaggctggagtgcagtggtgtgatctcggctcactgcaacctctgcttcccaggctcaaacaattctcgtgcctcagcttcccaggtagctgggaccacaggcgtgtgccaccacacccggctaatttttgtattttcagtagaaacagggtttccagctgggcacggtggctcacgcctgtaatcccagcactttgggaggccgaggcaagtggatcacgatgtcaggagatcgagaccatcctggctaacacagtgaaaccccatctctacaaaaaatacaaaaacttagctgggcgtggtggtgggtgcctgtagtcccagctaccctgaaggctgaggcaggagaatggcgtgaacctgggaggcggagcttgcaataggccaagatcacgcgactgcactccagcctgggcgacagaacaagactccgtctcaaaaaaaattaaaaaaaaaaaaaagaaacagggtttccatgttggccaggctgatctcaactcctggcctcaagcaatccactcacttcagcctcccaaagtgctgggattacaggcgtgtgccactgcgcccagccagctataccatttttttcaagtttttgtctttgaagctgggatgcatcttacaattcatagcatgtcacactttaattggcagcatgtttctcttgtggtacataaaattatggcagacttacagtcataagcaccttagattctttgaagtatagttgtcttctgttgtggtgttcatttactttcaggccagggcacattgacacagaaattccacacttccttaggaggcattccttttcatttcaacgaaaacttcagacaactgacggggttttgcagatagtgagtagaggaggtgcagcaggtaaaaacgattccagaaaaccagggcaagaggggcatgcaggcctgctgtagtgcaaaggactttgtgatgagcacacaggtctttttttgagatggagtcttgctctgtcactcaggctggagtgcagtggcaccgtcttggctcactgcaacctccaccccccgggtttaagcgattctcctgcctcagcctcctaagtagctgagattacaggcacacgccatcacatgtggctaatttttatatttttagtagagatggggtttcaccatgttggccaggctggtctcaaaactcctgatctcagatgatcagcctgcgtcagcctcccaaagtgctgggattacaggcgtgagccatcgcgcccagcctcacacaggtctttaggtggctggtgtcacagggtggacttcagtcaggcccattcagagcagctcctcctgcctggcctatcatgagggttcaggtccttacaccttattgtctgttttcacagtgagaatatgggaaattctctggcatctgttttctgggaaggtttactctatttcagcaccaaggacctaagacaggcagctgcatttcctaatcctgattccttaaagtaaactgttacagccagttagtgtgatcctggagtgtgtccagctgcagaggcaagagctagtacctgtgtggcagaccggaaatagatttcaaaatgcacagctgcagaattcaggagtagaatgaaggcctagggtcaagccctgtttttcatcgtgggctcctccattcacgctcgttgacacctttcctggccatgctgtttaacttccatgtcaagaaaaaaccctgacaaagcctggtaatactgacacaagtggagtgtacttaagcagagagggagtgatgttcactaggctgttgttcttccccaccctttggcatttgtgtcgtgtcctgacgccttgtttgtgtcttccgccttcagtgctgttccctcgtcacaccaatgccagtgctcgagacaacaccatcaacctgatccacacgttccgggactacctgcactaccacatcaagtgctctaaggtgaggggggtgccagcatctcagcctctatgctctgggtcttttcctccaccagaactcctgacagaaagtcattccattagtctacgctgtggatattgactcttaggtaaataattctagaggcttcaagaaaccatggtctttcttcatcaagccactgtcccccatccctccctatagcagagatgaatatttgtttccagaattgctcaccttcctgcttccctgcagggcctgggtcaatcccagggtgtatgttcccaaccgcccttgatgacctctctgatgaaagacagcaaagctgtctttctagaccatgactgtgctttagtacctgttatgtttgttcccaggcctatattcacacacgtatgcgggcgaaaacgtctgacttcctcaaggtgctgaaccgcgcacgcccagatgccgagaaaaaagaaatgaaaacaatcacgtaagttaggcagcaccccagcgaccaccttcctctcctgagtcaccgagaaggaagcagtgggcgctggtggcctggtcctccatgtatctgggcactggctacatatgaggtcagcagggctaagtagataaaccaaaggtgggattccatgttctcactgccatataggccaggatgggtttccttgtttccgtatctttgtgagctatgagaatggcagctaggaaataaacaaagtttaccaagagactgttctttttgggcctgagttatgaggtcagtcttgtgcttttggtggtctttctggagagatggagtaagttgcttagggacctttaattgggtaaataggcctgaaaccaccccactaagtgttctttttcctggtccactctcagcaggaagtttgcatgcagaggaaggttctctttatcagggatagaattgaggagagccgtgacgggcgctgtggctcacgcctgtaatcccagcactttgggaggctgagatgggtggatcacagggtcaggagttcaggaccagcctggccaagacggtgaaaccccatctttactaaaaatacaaaaaaaattagccggtcgtggtggcaggtgcctgtagtcccggctactcgggaggctgaggcagagaattgcttgagcccaggaggcagaggtcgcagtgagccaagattgtgccactgcactccagcctgagcgacagagtaagacttagtctcaaaaaaaaaaaaaaaaatttgaggagagccctaaataggggtgtggctctgcatgcaggaaaggcgagcatggcctagagcctagagagttccatctttgtgaaaggtgccagaccttggttcttctgatgaaattcaggcagtcctgtccttaagataaggtaatagtgttcatttgctggtttttgtttgtttgtttgttttttggtgggggtgttgggggagacagagtctcactctgtcgcccaggctggagtgcagtggcgcgatctcagctcactgcagcctctgcctcccaactagctgggactgcaggtgcacaccaccacgcccggctaattttttgtattttagtagagatggggtttcaccatgttgcccaggctggtctagaactcgtgagctcaggcagtccacccacctcggcctcccatctgctgtcttttgtaccagttgaactaaaagtcttgaggtcataagcctccctcacagccagtgttatttgccagcaccccagtactgttgttgttttgttttgttgttttgtttttgttttttgttttttgatacagagtttcgctcttgaagcacaggctggagtgcagaggcacaatcttagttcactacgacctctgcctcctgggttcaagcaattctcttgcctcagcctcccaagtagctgggactacaggcgtgcgccactaagccccactaatttatttgtatttttaatagagacagggtttcaccatattggccaggctggtcttgaactgctgacctcgtgatccacctacctcagcttcccaaagtgttgggattaaggagtgagccaccgcgcccagcccagtactctgtgatccccagccaggctcaacctcctgggctcaagcaatcctcccatctcagccccccaagtagctgggaccacaggcatgcaccatcacagctggctaatttttgtatttttgtagagacgggatttcaccatgttgtccaggctggtctcgaactcctggactcaagtgatcctcccacctcagcctcccaaagtgttgggataacagacatgagccaccacacctggcccagcactcagtactcttgaggcaaagttttagtgggtgtggtacgcctagggctttacactctctctcttgcatttgagggctcttctaccaagttagtttctgctgtcatttgaaaggatgagaaagagatcaaggacttgagcagtaggtgagggttttcagacattgtcaaaaagcagtttaaggccaggtgcggtggctcacgcttgtaatcccagcactttgggaggccgaggcaggcggatcacctgaggtcaggagttggagacctccagcctgaccaacatggagaaaccccatctctactaaaaatacagaattagctaggcatggtagtgcatgcctgtaatcccagctactctggaggctgaggcaggagaatcagttgaacccgggaggcagaggttgcggtgagctaagatcgcaccattgcactccagcctgagcaacaagagcgaaactccatctcaaaaaaaaaagcactttttaagtcacctcgacttctttaggcaaaggcctgtctctgtagcagctcagagaggagtgtccaaatgccatgcaatgaaatggcagcatcgtttcttttctgcagcttcttgggcagatctttaaatgggcaaagtgaccaacaaggtgggtgggcaggtgagaggatgtgcttgctgcctctccagaacctagtctccatcctggtgtctacattttcccctttccctgcttgctctacacaggagtacttttctcaccgggtacttgtttggtgacctggagtgtgaggcagtgaatttcatgctgctttcagggcccagtagacaggcagttcagtagaggccaagaggtaaactggcagccaggtacagtgagagggaagcctgacctggcagcctgtgataaccggactggaaggctgggcatcataatagtctcagggctgccagcatcacctttggcactggtagctgcttgtgcatccaggaggaaggcctgttaggcagctgctgcccgattccacagccagcaggcagtcgtgggagtccctgcccagtgagtgcagttgtgtagcgggcagggatagctccctgtcctggtgagagacccaggaagggatgaatccttaaaatgaacagactgttcataagcctcctctctgggacttagaaagagcaactttgccttcttctgtgctgcagcttctctttggcagagttgggccccagaaaggagaagcaggagacaaacagctgcatccaccctgaaaaccagattatgttactaatggtgggtaggagttaagtgactcagctgtgggcagaagccaggaaccctcgatgggccgcccagaattgaacactcaggagcttttcatttggagagaaggataataaggtgtagcttcattttggaataagcgatacatccaagacagggaaaatctagagcccatgtttttgccctgatttcccatagttctcagctctagcttccaggctgctttcccagatactgttaggtaccagttagaggctctgtccttgagaaccacctagcccatctggagaaatactgggtggaacaggacaccacaattcaggagcctcgaaccaggcaggtgttgtataagccagaggaggagtcaccacgtgatagcagaaatacctttagccttggaagttctgaggattgctctgaaccagccacctgccttcatggtgagagataaaggaactgctatctgggagccctgagaggtatacactgtgtaggaggagctgacaaatgaggtagtactaagaagacggtttgagcctagtcggaaattcaggtacgtctaggccatccagaaattgtgaacaagtgattcttctatctaacttggtacgttgaatgtccttgtgggcttaacactgatattcccgggcatccaaagtatccaataggaaggaagagctcgtgaaaccattctgtgaaagccagattttagccgatgtcctgtggttccagtgcctctgcttaaggaatctagccctttccacctctcatttggtgtttctttgggatcccatctagtctaggagtgtggggtgggaggaaagggcagccagaaactgaccttcgcacttatctctccttttgaagggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctt

SEQ ID NO: 37030 - DNA, 10902 bp, Homo sapiens
actctcgcgagatccctactggctataaaggcagcgccccggagagctcttgcgcgtcttgttcttgcctggtgtcggtggttagtttctgcgacttgtgttgggactggtgagtgtgggcagtgcggcccctgcggagtgaggcgcggcgcgcccttcttgcctgttgcctcttcctcctcctgtccggggcccgcccgcgctcgggtgggggtgctgtgatgcgtgaggcagccgggggaggcccggagtccgagactgcttgagcgctgcgcacacccctctcgtgggccccccacgtaggtgcgggaacctggttgaaccccaaggcaagcgtggactcgagtcgagtcttcccccggcaactcgagcacgtggcgcggcgtctgggcgggctggtggtgggggtctccgagactagcctcctgccggacggggtgggttcgggaagcttctggaatggacctgtatccagactcgtggctgtagaagacagcctctatgtatttggctgttccgggtcctgagccttgactagctgcggagcttcgggtaccctttccccgtctttattttcctgtacgtggaatggagttagcgatgagcccaaatgtccccgctgaagcactctctctgctggtgctttctccagtgctggggagggacagggggcacctgaagtggggtttagggatgtggccctctacgctgggcagatcccctgaaggggcccggtggcggcctgaatcccagcagcctttaccccgaattggttgggttttgtacttgggggccacttgggaaagaaggattggacgagaaggccatttgggggcaccaagttgcagcatgccttagtttttggtttttgttttttgtcgttaaaggtgttaaggactttttaaaaaacagttaaaagtttgctaagatccatgcttacaaaatttcttttgcttgtggtattgtgaactaagaactttgggacttggaaaagctttcagaccgcggcttagtgggttaaatctctgttttttgagctagagtctcgctctgtcggccaggctggagtgcagtggcgcggtctcggcttactgcaacccctgtctcccgaattcaagcaattcttctgcctcagccttaggagtagctgggattacaggcttgtgccaccaagccccggctaatttttgtattttttttttttttttttttttgagacggagtctcgctctgtcgcccaggctggagtgcagtggctggatctcggctcactgcagcctccgcctcccgggttcacgccattctcctgcctcagcctcccgagtagctgggactgcaggcgcgtgccaccacccccggctaattttttgtatttttgttagagacggggtttcactatgatggccaggctggtctcgaacttctgacctcaggtgatctgcctgcctcggcctcccaaagtgctgggattacaggcttgagccacagcgcttggccaagatctcaatactaatcttggtgttgatctgggtgaatccagtgcaaccttccttttcagcagtaaattgattcttatacttgttttcgccctgggatattagccccaaagtcaggaacccaccttcacaaatggtgaagggaattctagggcttacacaatacctaaagatttgaaattaagcagatgccaatcaatatcttggtcttgcctcttttttttttttttttttttggagacagagtctcactctgttgcccaggctggagtgcagtggcgcgatctcagcttactgcaacctctgcctcccgggttcaagtgattctcctgcttcagcctcctgagtagttgcgattacaggcatgcaccaccacgcccgactaatttttgtgtttctagtagagacggggtttcaccatgttggccagactggtctcgaactcctgacccggtgatccgcccgcctgagcctctcaaagtgctgggattacaggtgtgagacactgcgcccagtggtcttgcctcttaaaagttggactgactggaagggcgcggtggctcacgcctgtaatcccagcattttgggagactgagttgggcaatcatctgaggtgaggagtttgagactagcctgaccaacatggagaaatcccgtctctaatagaagtacaaaaaaattagccgggtgtggtggcctgcgcctgtaatcccagctactatggaggctgaggcaggagaatcccttgaacctgagaggtggaggttgcagtgagccgagataatgccattgcattccagcctgggccccaagagcgaaactccgtcaaaaaaacaaaacaaaacaaaaacaaataaaacaagttgaattagttataggttgtgtgctgtcttggacaaagctacctggagaaaagtcaaatatgcttctgatgttatgaaggcaggtggaggcacagtgatgggaaaggtcaacgtgacttttggggagccaaacaaaagtgtttgtggcattgtgcatttggattctggtttgagagtcttcatctgcctctctctctgcttctgtataatgaataagatgccactgcactaattatggttcagaaagaatgagaggttatctcagtatataaagaaattgccttgctgtttttaaatgaaaacaaaggctgagattcagagacttgtttcgttccaaaagttggaaagctcagactgtgacccttgactgctggctggagcttcttactaaaacaacatttaatgtattcagggacactggacaatgccttgattgtttacagctaagtctctttaagtaggtgaaggctgctggttatgtagaaaattaaggcttgtttctaattcatttctgttatttctagctgataggaagatgtcttcaggaaatgctaaaattgggcaccctgcccccaacttcaaagccacagctgttatgccagatggtcagtttaaagatatcagcctgtctgactacaaaggtgagagaattaacactgggctcattgagatggagttattttatattctaggggtggcttgttagatttgtgtcaatgttgtttgactgtaaaatgttttgtctcctaggaagaagtatttaggttgttaccttcatgttgaagtggtgattatcaagtgattacagggtatatatcctaggaccaaaccacttctggagaaaccacatgcttcattatgtctggacatactagctcaattatcttttcagtattcctcgtctattttctttctttatttttatttttgagacagggtctcattctgtcacccaggctggagtgcagtggcgcagtcatggctcactgcagcctctacctctctgggctcaggtggtcctcctacctcagcctcccaagtagctgggactgtaggggcatgctgccatgcctggctaatttttgtactttttttttttttttttttttttgagatggagttttgctcttgttgcccaggctagagtgcaatggcgtgatctcggctcaccacaacctccactgcccaggttcaagcaattctcctgcctcagcctcccgagtagctgggattacaggcatgcgccatcatgcctggctaatttttttttgtatttttagtagagacggggtttctccatggtggtcaggctggtctcgaactcctgacctcagatgatccgcccacctcggcgtcccaaaatgctgggattacaggcatgagccaccacgcctggcttaatttttgtactttttgtagagctgggcgccatgttgcccaggctggtctccaactcctgggctcaagccctctgcctgccctagcctttcaaagtgctgggataacaggtgtgagccactgcctctggccctcctctattttattattggagaaatactcattatctcttgttataagagacattctacatttaaagtctcagagctcactcaaatctctggagctgtgacactgctcgttcagtttgtttgggtcacgtatatatcacagctgttaatattaggctgagggctaggcactttcccttgcctgttttgaccccggaggagagttgatattacagatggaacaactctcctttctgttgtcatagtttttttttttttttttttttttgagacggagtctcgctttgtcgcccaggctagagtgcagtggtgcgatctcagctcactgcaagctccgccttctgggttcatgccattctcaggcctcagcctcttgagtagctgggactacaggcgcccgcaaccatgcttggctaatttttttgtatttttagtagagacggggtttcaccatgtttgccaggatggtctcgatctcctgaccttgtgatccgcctgccttggcctcccaaagttctgggattacaggcgtgagccactgcgcccggcctctgttgtcatagtttcatgcagacacttggcaagttctgttgaggctcctcctttctttaccttgtagttccagagcagctcgatctcctgggacagttgaggatatagattccttagaatgctaacctgaaactcaggtgtcaagtgtccttttctcagtggtgtagcattagtccctggagttagtttttggtagaacatttgactaggtttcctgacataatcacactttgttcttggggcttctcccagcaaacaaggtaagttgcaccatagggaggtgacctgggcccaggggtataagcaggaggtctaggaggagctgttctctgccctccagagcttgacctgctgaggccccaaagtgcttgttaggcaaagctggaagggttgtttagatgagttagtttccagtgatactgcaaagtggtaaatgtcaaaaagggctgcttgtttggctttttttttttttttttgaggtggaattttgatcttgtcgcacaggctgtagtgcagtggcatgatctcaggtcactgcgacctccatctccccggttcaagtgattctcctggctcagcctccccagtagctgagatttcaggcccccgctgtcacacccagctaatttttgtatttttagtagagacatgttttaccatgttggtcagcctggtcttgaactcctgacctcaggtgatccacccgcctcggcctcccaaactgcctcccaaactgctgggattacagacgtcagccaccatgccaccacacccagcctgtttgacttttcaaacattgctgctacctggaaatgagtgaatatttggaattgttctagtatttaagcctggtgggtgtggcgagaaggctgcctggccagtttgaagatctgttatttcagtggttaatcccagtgacttcattaaaattgcagctagaagttctgttactcactagtacttttgtcttttctgtctctctctgtctccctctttctctctctctctctgtgtatatgtatatatatatttctgttgttttgagacagtcttgctgtgttgcccaggctggcctcaaactcctggggtcaagggatcctcccacctcagcctcccaagtagctgggactacagacacgcaccactgtgcctggcttaaaatttttcctgtcctgtcaggcacgttaggaacacatgtgatcacttaaaccatgcttgttccattactatggttcatcacgggagaagtgcaaaggctgtgacttcttattggtgtcttatctctacagcagaggagtactgcaattcagctttctctgggtattgttaagcattggcattaggccatgcttataagtgcatccttgcttttgctatctttggagaacttggtgtttatgttaattttagccactcagaaaagatcaaaattagactgaacagtgtttactctgtattggtagctatgacatggaggcaggagaataaagtatgggattggaagtttttttcattcaggtattcctaatgcaccaggttctaaaagtagcttctaggagacatctgtattgagcatcttggcagttagtggttattgtgtcagccatcaacttgcttctttttgtataggaaaatataaagcaaggaagtctgtgtcaaatgctaaccatgactccgattttccccccaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatggtaaatctcttggtctatttggcatgtgaacttttttttttttttttttttttttgagatggagtcttgctttgtcgcccaggctggagtgcagtggtgtgatctccgctcacttcaagctctgcctcccagtttcacgccattctcctgcctcagcctcctgagtagctgggactacaggcgcctgccaccatacctggctaattttttgtattttcagtagagacggtgtttcaccgtgttagtcaggatgttcttgatctcctgacctcgtgatctgcccacctcagcctcccaaagtgctgggattacaggtgtgagccactgcacctggctggcatgtgaacttttaaaacagcaactgggaagctttggcaatagactttcaagtattgccttctcattgaagggagtgcaaagtctgactttctcttattgctctcatgacctggcagcagagaagaagcagcttcaattgcagttgagtgtaccctagtgacctaccttaactgttctcagcattcactttattgctggaaaacggaaaaaaaacagtctttttggaaagttagattaggaatatgggaaaggggaaagaggaatgcgtacagtcaagtcaagagtttgaatgtaactgtatgtttgccttttgccatagggtcaatacacctaagaaacaaggaggactgggacccatgaacattcctttggtatcagacccgaagcgcaccattgctcaggattatggggtcttaaaggctgatgaaggcatctcgttcaggtatgtcatcaggacaagtatccagttggctgaaagccttttatttggagagatctagagccctgatctgtagagactccttgtcatttcattcctttatgcaggggcctcctcactaaggccaggccagtaggagtgtggagaccagtccatttccttcaggcttcaagcctctgtattctaacaaagcacatctctaaacctgtattgcttttcctttcatctcttttcccaggggcctttttatcattgatgataagggtattcttcggcagatcactgtaaatgacctccctgttggccgctctgtggatgagactttgagactagttcaggccttccagttcactgacaaacatggggaaggtaagccatctgtctgataacaggacaacagagtggtggtatgaaggggtgggttgccccttcacacctgtgggtgtttctcgttaggtggaatgagagacttggaaaaagacacgtagacaaagtatagagaaagaaataagggggcccaggggaccagtgttcagcatacagaggatcccgccggcctctgagttcccttagtatttattgatcattcttgggtgtttctcggagagggggatgtggcagggtcataggataatagtggagagaaggtcagcagataaacacgtgaacaaaggtctctgcatcatgaacaaggtaaagaattaagtgctgtgctttagatgtgcatacacataaacatctcaatgccttaaagagcagtattgctgcccgcatgtcccacctccacccctgaggcggttttcccctgtctcagtagatggaacatacaattgggttttacactgagacattccattgcccagggactggctggagacagatgccttcctcttgtctcaactgcaaagaggcgttccttcctcttttactaatcctccttagcacagggtgtcaggctgggggaccccggtcaggtctttcccttcccacgaggccatatttcagactatcacatggggagaaaccttggacaatacctgggtttcctaggcagaggtccctgtggccttccgcagtgtttgtgtccccggatacttgagattagggagtggtgatgactcttaaaacgagcatgctgccttcaagcatttgttttaacaaagcatatcttgcacagcccttaatccatttaaccctgagttgacacagcacatgtttcagggagcacagggttggggataaggttacagattaacagcatctcaaggcagaagaatttttcttagtacagaacaaaatggagtctcctctgtctacttctttctacacagagacagtaacaatctgatctctcttttccccacagtggtagaatgggaaagatagtaggaacagaagctaccaaataagaaaatgggtatctctcttcataaattgaagcccctggattacagtgtgttgtgagggtgagggtaatggaaaagcttgggaaggagaatataaaggctttttattcaaagtatacatactcctctcttctgtcctgctcatttagaatcagtcactcccaaagatctaacttactgaatgtaggatgatctcacagatgtattagggcaaaacaaaatggttgggaatcacctctagagataaagcatgccattttttaaataactttattgagagaagaggttaatccatatagttcatatttttatttatttatttattttttgcaagatggagtcttgctctgttgcccaggctggagtgcagtggcgcagtcttggctcactgcaacctccgcctcccctgagccattgcgcccagcccagactagctttctaaggcctatttcagctctgatcttgtaatttaaaggaaatgaagttattagagtctggattagtggtgtatgtttgggaagacccaaaggtgctagcttggctagcaccaagtaatctttttacagggattagagtctgattatatagggatcagtgagcactgataaccaagaggtaccctttgcagaaggatgtgtgggcagttagcctggacagatgacacatggctcagctgacacctgctgagactgcccccttgtgggagatgaggttcagcattaagaaggaggcagcagtggcaaagtaggccctttaactggactttcctaggaacctacatataggttagtctcctgaacccaggctttcataactcagaagcttgcttcttcagactctgttggtctctgctgcttcccatcccactggaacatgtacagcctcttaaataggtaccatttaagagccaatgaatgccaaacactttttttttttgagacagagtcttgttttgtcgcccagactggagtgcagtggtgtgatctcagctcactgcagcctccacctcctgggttcaagtgattctcttgcctcagcctcctgagtagctaggactacaggggtccaccaccacgccccactatttttgtatagtcccagctactcgggaggctgaggcaggagaatggcatgaaccccggaggtggagcttgcagtgagctgagatcgcgccactgcactccagcctgggcgacaatgtgagactgtctcaaaaattagccaggtgtggtggtgggcgcctgtaatcctagctatttgggaggctgatgcaggagaatcgcttgaacccgggagaccgaggttgcagtgagacggaggtggagattgcgccaccgtactccagcctgggcaacagagggagactccatctcaaaaaaaaaaaaaaaaaaaaaaaaaaagaaaaataagagattagtccccttgcctcattttcttcaggctagcctgaggcacattcttaggcattgtcaggaaaaggttgaaggctgtgctttctgtataaatctatgaaaaatttcaaactctgccttttgcttaccaaggggtagatggcagttacttaatgaaacaagcgggggcttctgttaagttcttgatcctttataaggttcaggctatccagtttggtagagttagaagaatgctgagaaggcagactgagtttgctgtcttcagagctctgaagggctgtcagaaacagtttagtgttaagggtttacatagtcctatgtgtgtcgtttatttagcttttttttccccttaaggattagagagtgttggcaaattatttaaactttgcctttttttgtggaaaatttaaatttcaagtgctacatgaataaattaggcatgatagtatcttaaggctgtggtgatgattatatgtttgtaaaatggttagctcatactaaaagggtgaatgatctaagactgattgcaggggtaggtttcctggtatctgagtgttcaggtgcagaactggttttgtccataggagaatggtggtgcataccattgagaaggttattaattagtggtgcctttctcttgcagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtcttt

SEQ ID NO: 37031 - DNA, 8275 bp, Homo sapiens
ggaggctgagacttcgagagggacttagagaaggcagacgcatcccgaactcgctggaggacaaggtgaggggcgttgatattggggttttatggaggtcagacagtggttccagacccctcgaacccatagccaggcagatgagcaattcttactgcaccactgcagctgaagcagaggtgacctggagtggggtgtaggcaatgaggacgactgagaaagtagtaggctgtacagactgggagcagagactagcggagggaggaggggagaaaaacggggaaccaggaatgttgggagggggacgaggaatacaaggagggaggggaacactgagggggagtgaagatccagagaagagaatcggggatgcagagagggattaaggaatactgaggggcagggtgtgcaaacgtaacacggaggaggatgtaagaaatgggaagaaggaattctggagtaaataggaaatgtgaggtaggaatagggagtagggagccaggctaagggaatacggaggggggcataaggaatgaggagcagggagcgggggaggggcagacaggctgggacggaggccccctagggaggcggaaaggggcgggaccacttccggcctagagaggggagggcagtctccgagtttcggaggggcttggagtgagtggacgcactcgggaattgtaggaggacgaggtgagcagccgggtcggcttttggatgagagccccgctaggggtcggccccaccctctgggatctggagaaaacctgccttaaggaccggatcgtaccggatccatccggctgggaagggaggggactggacccggtttggccgggcccaagatggaatcactagctcagtatttatttgaggagggggtgtaatagggaaggggcggaaccaagatgcgcctgtttggaggggggcgtgttaggaagaagggcggggccaagagacactggactctgtagggcgtgagtaggggaggggccgggtccaccagacactgcgacaattttggaggaaggcttgttgggcagggggcgggaccgaatggtactgcggacctggagaggggcgtgtgttggggcagagtgccagactgagaccacgaccattgcgcatgcgcactatgtttcgctagaaaggggcgtgttgagaagggccagcactgagaagagccagctgctgaatgcgcatgtgcacggtggacatcaaagaaagggctcgtgctgggaaagcgggcggggctgagagcggccctgcagccgacgcgcatgcgctctatcgacctgcggctgggtggggggtgcactgggaaaaggggcggggtcctcagagctgccgcgctggcacatcttcctggagaaggggagggtgcggctgcagagaattgagacttagaagctttgaattcctgtatctgagaacggagtcgttgggggtggtggagggggttggaattggggacctacggaaggtgaggatcagcctccaggcacaacaggggagaggacgttcagtgggcttcaacttgacccaggccttctccccttcaggctcagctcttgccaggccaaattgagacatgtctgacacaagcgagagtggtgcaggtctaactcgcttccaggtaaggcctctttctgtcctttccccagctgcttttcctctccagcccttgttgctgcccccaagtcccttggctcttcccctcccatccttgtccttctccacctactttcctgcctgggtgtccccctgcccagtggagggagggagagaaggtgggcgggcccctcttctgccatcagttcttgctcagaggaaagggaggccttgttgggctgaggtggtcagagcacaccgcaggtaggagtcagtacaggtcagagaagtgtggccttggaattttggagccatttgcttagttgggggtgaggagaaggtctatgaacttccctgcttcctcttgcaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtaagacctctgcagtcaccacccttggttttctactcctctctcagttgattcatttgttctacaaacatttagaaagatccctgtgctcatcagggctgtggggggcactgagagtaatgtgatgtaattcctgtcttcagagagcttgcagactgatggggaggtgcaatctgaatgtaatgcagtttatgtttacatagtagctgccctgtattaggccttgagctaagcacatttatgcaggttatctcattaaatcttgaaagtaattctcatagccccaattttatggagaaggaagctgagttccagagaggtgaagcggcttgtctaggatggttcaagcagagccagtagtgggcacagaaagagaagaagactcagcctccacccacccttggtttgctcctggcctgctaggcagatgaaacacctgcttggaagtcagtgagaaacaaatccagggttcagcatggccaacatctattgagtcaggctgttactacaggggtgggattagcgggtgcttcctggaagagatagggagaggaaaaggaccacttgcttcatctggtgacgttgagcttcctctctgttgatgcaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggtaagaactctgtcgtttttattctgccttttctactgccttggctgtccttttctttgccatcgtctcaagttttctgcaaacttgttttggtctttccatctttttctactctgccaggcaaatgatttggtgaagtaccttttggctaaagaccagacgaagattcccatcaagcgctcgggtaaagtcctaccaatcctccctctgccctgagctctgccctccattgcccttacaccattgtgctggggatatcccctgctcttatgcttatgtctctgtcctcccaaagttctgatttggcagtgctagcatctctgttgataagcacagaaccgggttatgccacccttggtgtggttggcaaagagtctatagcttgggcatcagggccacctggcatctcttcagtcaggtgctcacaacactctccccttgcagacatgctgaaggacatcatcaaagaatacactgatgtgtaccccgaaatcattgaacgagcaggctattccttggagaaggtgaaggggcagccctgggggatgggcacagtggggaagccttgaattgaacaaaaatgtacaagtcccttctcgggaaccaaagagacctgctaatccagctccatcgctatgctgaggggcagacagtggcctagggaggggtgtagattagcgatgggtcacacagcaagtcaatggtaaaagtgcagctaggacccaagacacccaacttaatcctggcttctgtccgtccatggcagctcctgccatgtatttgagatttcacctctccctttcattccccattctctgtctccctagagtcccactcaccacaaagatgatgatgacaatagtacatttgcagcgtgtttaccgggtgccaggcacttagctatgtactttgtgcgtattatctcactgatttctcacacatgcgaaactcctaggtacatagggagctgcagcatgccccggaagctgaattttgtcatctcacaagctgttctccccatccacaggtatttgggattcaattgaaggaaattgataagaatgaccacttgtacattcttctcagcaccttagagcccactgatgcaggcatactgggaacgtaagctgggaaagggctgaggtgtggggggcttctgctttggccatgtgctgctactcctcctttgtcctacttcccccatcctcttagagagtcaggaaagacagggtctcaaaagccccgtcccagttcctatgcatagttggagccctgcttacagtggtggcacctgattatgattgactggagggtgtaggagcctggagtgggacattcctgctgtcaggtttgctgtctctgtagaagcttcccaggaaagcaggcctgtcgttgcttgcctcttcctactgggtgcctggcctggctttggcagagtggttctcaaggagggcttcctggtgtgggtggatcaggatgcatgaagcgcaggagtgtcagtggggctgaaggttctgggacagaaagaagggactcacattgactgagtgcttgtgttgtaccaggttggcagccattcttccatcttcttggaaacccagggaagggaaaatatgattttttctattttactgaagagtagactgaggcttgcaagtctaagtgccttgccaagggtggcatagagctggaagcagagactgggtagaattctgtatctgaggaatctgggagaggctagcctagtgagttggctggtgtgtctgttgcagatggctgctgaacataaacctctctgtcctgttatttctctaggactaaggactcacccaagctgggtctgctcatggtgcttcttagcatcatcttcatgaatggaaatcggtccagtgagggtgagtggctgggcttgcagctgaatgggtggctgtggtctagattccatgtgttcaatttctgtccctgtctcctcttgcctcccctcgcagctgtcatctgggaggtgctgcgcaagttggggctgcgccctgggtatgattgggctctctcagcgcttgctgtccgtgttgtcctttggcaagagaggacggtcctaggattgcatcagtctggtggtctggtggagcgggtggggtgctggactgggtagagggcccagggttctgacctgggtggatgatgggtgaatggtcctgaactctctgctccctctctcagtgtctcttgggcttctatggagcttccctcttgtgctggaaacctcttttccatcttggaaatgcctctgcccacatctgggaagtgccatagccttgagtgaatttatttgtttatttatttttctttttcttctctcaggatacatcattcactctttggggacgtgaagaagctcatcactgatgagtttgtgaagcagaagtaagtatctctgtctggtgttcatgtgtcccatgcatttggcctatttcagaactgagtgataaagccgtggtgcatggatgcatgtgtctatgtgtgtatgtatttgcatatttgcatgtatgcaggtgggattattccttgggcggtgatgggaaacaggagcagcacatgtttcctgatctgttacatatacctcaacatttgtcttgagaccagttctgcaagggagggattatcattaccatcattgtacgtatgcagaaactgaggtttagagaggtgaagtcatttggtcagggttacacaggtagcaagtagaagagttatgtttagaacttggctccaaagccttagttctttttattctgctaactagagcttcatagaaattaatttccgtaaagaaatgacatagaatggtagcttcaggcaaccaggtaccatgctggggagttgacttgtacatctcatttcattttcataactaccctgcagctgtcatcccatccccgttttacagttgagggacctggggctccgagaagggagatctgagcatggcccacagctggtatgggcctggagcccagtcctcttgaatttctggccaaagctcacctatccttggtccttggaggacatgcaaacactcacacagccacacgcatgtgcacacagaaacacacacaaagggtcaggaattcagcatgtgtgaagcatgctgctattggctgttcttcctctgtagtctttctggtcattttctgtggtggacctttctgggcttggccaggctgaggccaagacacttgcagtggggtgtgctcagagcagggggcccaaagaatggctcctctgtttacaacacacccaacaggaatctggggtcattgtgatgagggcgtcaaacttgtggcttccctatgaacaaacgtcccccaacacctctatgtggcttctgggcaagaccagtgggacagggctcaatattggaagaaagactgtagtaattagtggatgatgttgccatctggagcctgtccagtctatgcatgggtaggccatgaatggtcttagaaataaaggctttgaacctctctttccaaggtacctggactatgccagagtccccaatagcaatccccctgaatatgagttcttctggggcctgcgctcttactatgagaccagcaagatgaaagtcctcaagtttgcctgcaaggtaattggagagctccttgagcttggcaagtcaagagcatggggtgcccctggctggggcaggctgtgtgcagagcagcctgcagttcaaatctgaatgttttggtgcttctgttaattgtcaaaacactgtaacaggcactttatctgaatcatttaagccttacaacctgatatgtcattgccctgttacagatgagaaaaccgaggcccagaaaggttggtaggtgacatgtccaaagtcatggggctaggaagtgtcagagcagggatggaatattaggtgcataattactggtaatactgtattattactattatctttttatactaagcatgtagcatagtgcctagcataaaggtagatgcttaatcctcttatgctccttctgatggttatttacatagtaatactgtattattactatggcttaatccctctatgctccttctgatggttatttttgtttcaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtatctgccttggtttcagtggggacatctggggcttatggggctgggatgaggagctggatgattctaggaaggcccaagttggagaatgatgtggagagtgtgccaagacactgcttttggcattttattcctttctgtttgctggatgtcaattgacccttttattttctcttacttgtgttttcagatattgttaatcctgccagtctttctcttcaagccagggtgcatcctcagaaacctactcaacacagcactctaggcagccactatcaatcaattgaagttgacactctgcattaaatctatttgccatttc

SEQ ID NO: 37032 - DNA, 54394 bp, Homo sapiens
gagaagggaccttcaggtccaggcaaagggggaacttctgtcgtgggaacgaaaaagaaagaggatttacagggtggggggacagaggggcagcaggaaccagaagggagacagtggcggtcgcggcggggccgatccgagagttccccttagagaacggagctcacgggcggggaggcctcacctgctagtaggacgcagaaagacagaaggcgaaggagaccccgacttcccgggtcagccccagagccaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaaggtagtggagaataaaagggggaacatggaggttggatgtcaggagcggcgctgacaccggggaagagaaaatgggtagaggtgttggtcgaaatgggcccaccagacggacccggaggaagacggagggtgggagagaggttgggcctggctagcggttctccagtcccctcttctttggtgtgtccttgggcttcgatttacctataaagtggctcccacactgcaggggattccttagaccccctccctattctttcttccccctttctctcttggctgtgctcccgatttgtgttgttctgctccaaaggccctgtgatctgttggctttttgatgactgtgttatatggagtggccctgggaactgagtctcgatctctgttactcgcacccgagtcagtagcctttttggagacgagtagtggcaacctcacttaaggaggccttggctgcagcatctcaacatcagtgcctccattcggctttatttactacccggaaatagtacttgaggcttataaccccaataaagtctcaacttgatagagttgccagataaaatgcaggatacccagttaaatttgaatttcaggtaaacaatgaatagttttttagtctgtcgttgcttaccagaagttcaaatttatctggaaatctcgtatttttatttgctaagtacggcagctctagagctcgagtgtgggtcgttgggggtggagggcaaatactgagatcgcagtattagcctcagaacgttagaatgtgaaagtcagagaagtaaggtctccgaagacctggaaaaaatagtatctagaatatttagtgagatgcagcgtaacaaagtggttaggaacttggtctttgaagtcagatgggcttgccttggaatcctgagacatccactaacaagctgtgacttggatgacttacttaatgtctctaagtctgtatttcctcatctgtaaaatcgtcttttatagagagtattaaaatgagaaagtatatggagtgtatttattacagcgcctggtgtagactcagtagctcaaaaactggaggttgttatcaatgtgtgaatatattctgagcagtttctaagtctcttgggaaacttgaccttgaaagatgggtaccattaagaatttctgagacctgtataggtgaaatgtgaaatgggtcttcataatctttcagttttcttttctgctcctaatttcttgctgggcagtacagaaggaaaaacaaagatgtcataatatttgagggcaaacatccattgttgagtgtacttatatatcataattaaaaaaaagaacctaatggaaaaatagacaatttagaagaaaaattgtaaatgttcaataaataattaaaatagttccacctcactagtaatgaaagaaatgcaagaaaaaaaaagttaagttacttttttggggggagggtcttagatttataaaacaaaacaacaaatagctgatagcagcctgtgtgcaaaatgggcacctccataaacttcatgagactgtatattgatacagtgtttttacatttaaactatatgtactaaaatgttaagtgcacatattctattcctgagcaatctcacaggtctttagcctagggcagtaataatgcaaataggctagattatgtgtagaagtatcttcagtaggctcttctgatagccaaaaattggcggacaaaatgcctgttagaataatataagtgtagtacatttgtcccttgtagttaaaaagaatgaggttatgtttatatgtacttccatgagatccatattatatagttaagtgaggaagaagtttgcagaacaacatcataacgtgatccccactttcataaaatactaaagcctatgtctatgtgtaactgcattaaaaatctgaaaggatacacttcaaactgttagtagttgttacctctggggacttccatttccagtcatgatagaataacaagagccagatttaccttcccaccttaactatacaactgaacaaaatgtatgaaacaaaggttcatacattgctcacagatgttgggcaacaggcagtgcaggaaaataattctccagagaaggcaaataaacaaggtgagtcctgtgattgtcgtagattactgcctagagagtttttaggcttcagtgaagaggggaatcccttggtctttctgaggagacataaatttagagtgtggggaagcaaagatggctagattttgttgggcaaaataccggagaagagggggctgcagagagagagcactagagatctgcaggatgtcttctcaggtctttgtttgagtactgatctgcatgtgagaaaactattcaaaacctgaaaaaggaccactggaaaggagaaggcagagcaatccccagagttcacactagtgaactgggactagtttgtgttcctacttgccagaaaggaaagacttcctaatattacagggcttcaaatagagacctcagatggctattgctttaatagtggttccagattaagcctagaatgaaggctgctgtagcccctctgtaataaaacctaaaagcaagccttgaaaggatcaactgattccaagtaacttaattgtatcctagagcaaagcccaagaatatgtaaaggaatatgacaaaaatctagtaccaaacataaaattcacgatgtctggcatccagtaaaaaatcatcaagcatgtcgaatgaatgaacctaggattaaccttgatgtttctttttcttatcagaattgacagaaggtgacatcatggggcttagttagctcattgtatcattttctatttttttcagggctcagctttcaccccaaaagaccttggatcctgactagtttacataatggggtcatccagttatgggactatcggatgtgcactctcattgacaagtttgatgaacatgatggtgagatatttctaggaggaagttaaaggagtataagtatttataatatcctggggtattttaagccttgtttgacatggattcctctatgattaaagaatgtggaaatgatagaactgaaaaatcctgaataggaatcaccttagagattagaaaggatagctctgtctaacatacattgcctgccttctccaccaggtccagtgcgaggcattgacttccataagcagcagccactgttcgtctctggaggagatgactataagattaaggtacagagggtctgtcataactgagaataaaggaaagaggatgtgggaaggtttgggaatcatgaaaggaactgaaagacaggaaatttcattcatacagagctcaggcctttgacaacattatccggagaacttactcagcaaacatttattgaatgcttactgtgtaccagacactgttttctttttagggaattcaaaaataaataagaaatggcttctgttttcaaggagcttttattctaatacagaagataaacatatatccaagtaatagcatgtacagtttggtaagcaatataatagagagatattcacagtgaaataggaaagagcagtataggtgcaaagacaaaaagcatgacacagctagatacagggcagctgttattggttttgtatggagaaaacctggagaaatggtgagagaaggggcagaagatgagaggggccagatcatggagtacctgtttgtggcgctcaggagtttagatgttatcatgcagataactaggagccatttgaggaacttaaatacaggagtgataccagatttatatgtttttaaaatgattacttggtggtaattaaagaaaagattggatgatttgggcaagacaggaggcaaaaataccagttaggaaacctgagcttaggtagtagcatttgaaatggagagaaggagatggatgtgagaatttaaggaaatgaatcagtgtgtctgttgggtgatggccaataaggagaaataaatgagatggccaataaggagaaataagggccaataaggagaaataaatgagctgactttcaggcttctagtttaggtcactgggtaaagggggtgtcattaactaggaaaggaaaatcaggaggagatagttttctggagtggaagagaatggataatgaattccatcttgtctctggtgattttgagggacctaagggacagtctagttgaggtgtctgtgctagaaatatatttgtgatttgtcgtcatgaagggaggagccaaaggagaagcagtagaagatattgctcaaggagtacgttgaataagaagacagaccatcatttaagggagagagaggaagtagagttagtatgggaaacagtgattcgaggggttcgagatgaaccaagagggagaagaagcctcttggatgccaaggaagaagagaattttgggaaggagaaagtgttcagaataagatcaagattgagaaataacctttgaattgcttaatttggaaggccttagtgtgaaatgaggaagcagacagaatataggcaattctttaaagacaactgactatcataatagcaaaagttagagccagagactagcaacctataaaaataaatcaaaatttcctctgtttacttcctttagttgttttcattaagtctatgtgtcaaaccgaaccagtgaaatttaattcataaaaaggtaaagtcttttcataagcaacttcaagaagttatatattgtgattataccgcagaacttaggtgatgggagtaaagagtgacagctgcctacagagaaaagagctattagaattataggaaggacatttctttctgttttctagtttttaggcaccacatcctggggcaatcaaaactcaaaccacctgacagatctcaaaagcccataaggatatcacctcattatagtatttttgtatttgttatttatagtgatgaacattgagtatcaagaatggttaacttgggattcttataatctgtttaaaaaggaaaaactgggtgttaattaagaaaaagttttcccaaaatgactaatattttggaaaagaaattatcttccacttatgaaatgtccagaataggtaaatctatagagacagaaagtaggttagtgattgtctagggttggaggggttgggaggaaatgagaagtgacagctaatgggtatgaatttcttaggggagtgaataaaaatgttctaaaatggatggttgcacaactgtgaatatattaaaagccattgagttttatactttatatgaataaattgtatggtatttgaactgtatctcaataaagctgttattaaaacaaaggaattctttattagctggtaggtgtgtagtgctatcatttggtgggtttttttggtttgttttttgtttgtttgtttgtttgtttgtttgttttttgcgatggagtcttgttctgttgcccaggctggagtgcagtggcgtgatctcggctcactgcagcctccacctcccgggttcaagtggttctcctgcctcagcctcccgagtagctggaattacaggcatgcgccaccaagcccggctaattttgtatttttagtagagatggggtttctccatgttggtcaggctggtcttgaactcccgacctcgggtcgtcttcctgcctcggcctcccaaagtgctgggattacaggcgtgagccaccgcacccggcccattcggtggttttaattaatttctctgatgactaataaacttgaacatttttccataaaaagggggattatctagaaaagtcatgtctgtggaccatcttattgcttgctatatccagataaatgtagcattagttataatcctcgttgacaaagagtaagacaaggagcccagcaaatggtcagagtattcatctaaaacccctataagtttttaaggatttacagttttggagcttgacttaggccattaaaggagtcaagacattttgaaactagaaatatgaaagtttaaaacactgaactctataaggggaaaaaagtcagttaaagaatagtgtttatggtatggtctaatttttatgtgaaactctactgtgtacatgtgtatttatatgtagctgattgaatagatagaggcaaaggtattggaataccttaacttttcatgttattcttatttccatacataatgcttactgagcacttacctaatgtcaggcactgtgttaggtggtaagggtatagtgttgagcatgatggacaagaaccctgcctttaaggaactcagcattcttgtttggaagatcatacttttggattgtctggacttgttataggaaatgaaatttttataatttactgaagaaaagttaaaaattagaaatagtaacaagctggcccagattgattataaacaaatattaaaaagaaatttaaaaaaattaaataagaagaaaaatgcatctggtctcttatttttgtacattttaggggattttctgaatgaggaagataagctattttatatttatgatcctggttttcatgtcttcagttgtgttcattgatgcctagtactttggtagttgactcaacttcacatctgaatatgatattgtttctctgcttagctcaggcttactgagcaatgtagtattttccatgtaataagttaaggtctgtttgcttgacaggtgagtacagaccacacatgtatgggcgttgtttgccatcaagttaggagcctaagaagctgatgccctatattattgtttcccttggagtcatggtatctatctgtcctacttttttttttttttttgagaccgagcctctctctgtcgcccaggctggagtgcagtggagcgatctcaactcactgcaaacgccgcctcccaggttcaagtgatcctgctgccgcagcctcccaagtagctgggatcacatccggctaatttttttttgtatttttgtagagacagggtttccccatgttggccaggccggtcccaaactcctgacctcaggtgatccccctgccttgacctcccaaagtgctgggattacaggtatgagccatcgtgcccagcctgtcatactttttaaaagtgatgggtaaagcacttaaggggtctatattcaagccaagagcacaattttgcagtagaaaaaagagttgcaaatcaagccctggataaatatctcctgctattaaatgcagatggcttcttcccaaagaaagaaaaactttttttttttttttttttttttgagactgagtctcgctctgttacccaggctggagtacaatggcatgatttcggctcactgcaacctcttgtatcctgagttcaagcgattctcctgcctcagcctcccgagtagctgggactacaggcacatgccaccacgcctggctaattttttgtatttttagtagagacagggtttcactatgttagccaggatggtctcgatctcctgaccttgtgatccacccgcctcgacctcccaaagtgctgggattacaggcatgagtgaccacgcccagcctgaaaaacttcaataattttatctttagcttttccctaatcctaccccaaccccatgttgtttatctgacctatattttcattcttgttcttttcccctcaaatcttaaacaaggctttctaccaaggttcctacctatttagaaatgccaaaatacaaataatgtatataaatctatatttatatacatatttctatctctgtaaagatatcaatttctctgagccttttagaggctcaataactatttctgtttcttagtttgatttgtctttgcaggtttggaattacaagcttcggcgctgtcttttcacattgcttgggcacttagattatattcgcaccacgttttttcatcatgtaagtagtcatggtggcgctagttttggagcattcttagtttccccatagtaatctttatttgatccttgagaacccatgttttaataatagagttgtttttggagtggctcttctacaatctgtgtggtattgtcctttctgctttttttctttctgcaaaaggaagcacttgggattatactgaatttaattttattggattcagtggattctatgggaagtcattgtttctctgtagggaaaagtagggatttgatttcagatttgctgaaccaaaaaacaaaagtttgccagctaatcccatgtagggtattattagtaagtagtaggtgtgtctggaagaaggtcagactaagatgccattttgatcagctaacaaacgtttcgaagtattaacaatcatacccctctatcctaggatttttgggtctggtggaggctgttcccttagccaggcttactactttctttgatctgccaggtaacatagtagatttagatagtgaggtgcagattacagactcccaacctctgaatccagttgcaccctgacaggatctccttatagttctgtgtattagcattaacttacactattctttgattgccagtaaattaagtctctttaattaagttagaaagaatatgatgaaataaacaatttactggttgagtatatattatttctttttttaattaaaaaattctaggataggagagaatgagaaaattacagcttaaacatttgagaatgataaccactcaataagataacttattaagtaggaattatttgtcattgccataaaggacttcctgaagacccttgcctagaacaagttgccatctacctggaaagttacgaaagaccttattttctttcattttaccagctcactaaatatgtgtgtgccttatacttgctaagctttgtgctaaatactgaaggtagagatactatctctattgaaaatagaaataccatctattttcagtgtttaacacaaagcttagcaagtgtagtaagaaggaagtgtaaataagaaatacttccttttctcaacaatcttatagactccaaaaaggctaaattgtctttacatgttactttctgctttgcttgctgagacctgggaattttttgaaactggacagaaagaagtcagacaataaaataatattcccatcctagagttaaaggtagaagagtctttcacaggatcttaatttacatgattaactgtatataaatacacacacacacacacacacatatagaagtaaatgtaaatgtatgtttcactatctgcctctgagaatgtattgtgcctctaactggcttccattcttaagtcttataggtgaaagtgccgaagttgagaaaagctgttagagtggtagagaaaaggagacagctaacctgatagcaaaagcagcagcccctttgctaatgtagctgagccgttaagcaatgcagttctttagagaaaaatgattacaagaacctgatagaacagatttgtttaatgtttaaagcctttgtctggaatatctttcaggaatatccctggattctgagtgcctccgatgatcagaccatccgagtgtggaactggcaatctagaacctgtgtttggtaaagcaggaggcagagggctcgaaaagagtcttcatttttcctagtttttcataatgagcttctcttagaacaatcttctcccttctcaaatggactatgtcggctgattaattactgattgtatttgtaggatgcttttaagtgcaaaataataaatgtagaggcaatcccatatatgaatctggacttccaataatttcttaccaggaagagaagtcatatagccttttagaacaagaacttttagctggttttcaattattttcccataaaacctgagtcaaggtctagacctttgtcttattttgtgtttggagctggagctttacatagaactttccatgaagagttagggaccatttaaagtgatggccttggcccggcgccatggctcatgcctgtaatcccagcactttgggaggccaaggcaggcaaatcacctgaggttagaagttcgagaccagcctggccaagatggtgaaaccccgtctctactaaaaatacaaaaataagctggacgcggtggcgtgtgcctatagtcccagctactcgggaggctgaggcggagaatcgcttgaactggggaggcagaggttgcagtgagccaagattgcgccactgcactccagcctgggcaacagagtgaaattccatctcaaaaaaataataacaataaaaaataaagtgatggcctttaaaagggataccctactaaaatctcacagataatttacagtatggattactgagattacatttattttgatattttaaaatatttttgagagaagagctatgtaatcttagtcctcctgaaattagtaatatttaaatactaaagcattagaggcaagaagagaactattgttaaaatagctgactgggcttattattattagttcagaattggtaggatgacctgcctttgtctccataaaagtaaaactggataagcatttattgaatatggagaaaggtatttagtttaggagtctgttgacttccacctctaatttggtattgtcttttttttttcttgcagtgtgttaacagggcacaaccattatgtgatgtgtgctcagttccaccccacagaagacttggtagtatcagccagcctggaccagactgtgcgcgtttgggatatttctggtgagctgcccaagttcagaggacaacctggtcatctctggtgcaaaactgcaattgcttaaaatagtgaggagagttgacttagaactggaaaatttagaatattctgttttataatagcatctttgtttctgaggttgttgaatttgctttgatggttcttcatattggaagtcttctctaagaaaagaggtaactctagaaaattcatttgatttgaagaaattttaactttctagttacatcagcttttgttaaaatctatttactgttgcaacatttgattaagaatcatgctttccactcaaataagaaaaaatacatctatgacaaaaagaaattttgagaatagattaatacagggaaacaagactcttggaccctatcgctttatttaaaaatagtaaaatctctctattacgtttcttctagtgcggggagcatggttgggttctaggagttggtgacttttatgtccagaataccttttttttttttctgagagggagtcttgctttgttgcccaggctggagcgcagtggtgtgatgatcttggctcactgcaacctccacctcccgggttcaagcaattctccctcagcctcctgagtagctgggactacagatgcatgtgaccacacctggctaatttttgtatcttaattagagatggggtttcaccatattggccaggctggtctcaaactcctgaccttgtgatctgcctgcctcggcctcccaaagtactgggactacaggtgtgagccaccgtggctggcctgtttttttttttttttttgagatggagtctcactctgtctcacccatgctgaaatgcagtggcgcaatctcggctcgctacaacctctgcctcccggattcaagcgtttcttgtgcctcataagtaactgagattacaggtgcacgccaccacgcacagctaatttttgtatttttagtagagacagggtttcaccatgttagccaggctggtctcgaactcctgacctcaggtgattctcctgcctcagcctcccaaagtgctgggattacagacatgagcccctgtgcctagcccagaataccttttaatggacagatttaggactagaaattaaataatttatagattatggatagttgggataattcctccttttacagtttacatatctttattttgagacaaggatttaaatgtttagtcttatatagaggagatctaagaaagtgctacctagagaatttaaatgtagagaatggactgtacctgtgagacctatggaagcgcttcatgttggaatagggaaatcaaacactaaatgctgtagttctctgaccagttagtatttgttgtttctttctttctttttttttaacttttatttatttatttttgccatgtgccaccatgcccagctaatttttgtatttttagtagagacagggtttcaccatgttggccaggctggtctcgagctcctgatctcaggtgatccacccacctttgcctcccagagtgctgagattataggcgcgagccaccatgcccagcctgttgtttctttgtattcatttccttagaaattcttggagatttgagttctttgaaatgtcagtgactggactacaaaacatgtttcattctatgaaaggaaggcccccctcatagatctttgtttggttctttgtaataaaggagtcatcctctgcattgtacagctgaggtgataactattcccaactccattgtggcatgggggactggggcaataatggcacttgttcttatagaccattaatgaacagcaagctgaaaatttggattctgagatacagcatttggaatactgcaatagcagtttaggttaatgtagcatagaaacaagacaagaggagatggggacaattgtagagtagaacctctagataatgctgtctttgtagttttcaaaggcatagaatgaaagggaggagtataaacaagaggtattggagatagggcagttgtattctctttccctagggctttgccattgcagtttttcatcagactgacaaggttttttgaagtacacccagatgtgaccagccatgccaacaggaggagctagacacaggcactgtgaacctgtgtcctctcctcactgccagtaccagggagcttagcatctactctcccagtaaccttgctatggctttccatggtttttcactgtgcacacattcaaagcactctctctgtctcaggatataggagcctgatgggcttggatcccaattcatgctattccagctgatcaggggcaatttttttttggggggggtggcggtggggacagagtctcactgttacccaggctggagtgcagtggcatgatctcagctcactacaacctccacctcctgggttcaagcaattatcctgcctcagtcttccaagtagctgggactacaagggcatgccaccatgcccagctaatttttgtgtgtttttagtagagacagggtttcactattttggccaggctagtctcgaactcctgacctcaagtgatccagctgcctcagcctcccaaagtgctgggattacaagcacgagccactgcccctggccggcaattattcagaatatcctttgtcaacctggattctgtgagagaattaagtgctatagaaagtactttcagtggctgttttcgtagttcttctaagaatggtatatagctaatgctattctagttcatagagaatttgttacatacctaaactgatgcctttcgggcattaaaacttaattcttttccagaacgccgggttgagaagggctccactgtaaaagtaatgtttgtgccacctgatgccagccttgcatgttccctgcagtctagccaatgcagtttgggggcagtcaggtggttggattcttggtggtcatgaaatgctcaaggcatgaaatacttttctttaccttttgcagacagagaacatttttacatcaaaattaagggccctagatcagagaagagagggagtgtgaccccatggggtttatacttgctcttgaatgtgtgaagtgcatggattactatgtaataaccttgcaattgctatactttatttatgtgatagtaagaattttgtgctagcttgctgtactaatgttaatgctctttttaccatttctaagtgttgttctttacccacaactcttgacttccagtaaccccttaaccagagtggaaggagatgctttggtatttaacaaagtgcaagaagcttttgggttagacttttatactttccttctctagaaatcagcatattctttttcagcagggttcttttttgctattgggttcaaataagtctgaaaacaggaagaggaattagctttccgatctgttaaagaccagtgcttatatttctgaaagggagaagttagttctgaatgagagtatgaatactcccaaatttagaggactagttctaatttttttgactatttttttttgaaagggacactctctgagttagttaagcagtaagagaatatagagatctttaaaggaaaacctatctcttggtacctctcccatagggattgaaccccacagggcttagcttaacctgaatcttttgtgttaccctggcaaaaactatttgtttaaaagggaatgtatttacaaacctacatataaaaggttactttcttaacttgagcttctaagtaaactgacagttaaattattttaatatgcttatacctttgcatgtcaagcccatgtaattcaggctcagtctctgaaaaggctactaaaaaagtattaatttgctgccaaatcctgttatcatccctctctttttcctgctttccctggtccgtattgggaggtgtgcatcaaactggtccattctgagagtgtcctctcctccctctggatttgggtagctgctgtagaaattttccatctgtcgttcagtcctagcgagcggcttgttgaaggctcaaatatttcttctctgagtatcttttcactgcctgtcaccattcatctgtctgtttttgcccttccccttttcccggatcattacacgcaaatgcaacaaagccttccattctgtcatacggctttccttttaatgtgtttgttgaagcttattggaggtgaagtttctcacagctgtctatctttgtattttcctttgaatctgtttcatataccagactcgttagaaaaagttgacagatcttattaaagggacaagtgaaataagtgaaaggaggcatcccagcgataaagtatttatgagcctttgggagagtatattgtaaaacatcagctttatttctctctacctactggctaaatgctcatcttggacagaggacaagataattaaaattgttgtggccttctaagctcttgcttctccagtgttaacatgtaggtgccaccataacagaagagatatattataattttaaaacaataaatataaatgcagttattaaacttaagttcttatattttcctacagatggcaaagtttaggcttaaaatgacttaggttttctttcctttttttgagacggagtttcactctgttgcccaggctggagtgcagtggcgggatctcagctcatcgcagcctccgtctcccgggttcaagtgattctcctgcctcagcctcccaggtagctgggattacaggcatgcaccaccacacccagctaatttttgtatttttagtagagacagggtttcaccatttgagccaggctggtctcaaactcctgacctcagttgttccacctgccttggcctcccaaagtgctgggattacaggtgtgagccaccgtgcccagcctcctttttttttaatttgagacggagtttcgttctttcgcccaggctggagtaaagtggtgcaatcttggctcactgcaacctccgcgctgcgccccccccagccccgccccccgggttcaagcaattcccctgcctcagcctccctagcagctgggattacaggcatgcgccgtcatgcccgactaatttttgtatgtttagtagagacggggttttgccatgttagccaggcagacctcaaactcctgacctgcggtggttcacctgtctcagcctcccaaagtgctaggattacaggcgtgagccactgcgcccagcctttaggttttattttcaatgagagtttttattttccattacacataactgtctttttaaaaaatatttacaagtgctaggtaatttcatcttccactattcccccaaaatacttcaaaatataggattttagtctcaattctttttttctcatctacaaactgttataattttacctgcttgttcattccaaaggtttgttatcagagtccagttacataacatactctctgaaaaccacaaagtactttccgaatgtgagatagtagcagtgctatcataattttggttctgactatagcacaaatagcttttaaagatagatttacttgagccatatatgtgggtcctctacaaataagactattattattctggtgtctttttccatcgtttttaagttacaggataattcctcccagtaaaactagcctccaaaggttttaatggcaaaatccaagtattcaaatctataatcagccttttaagcaggaacttaaaatgacatgacagttttaattatcttgttcttcgtccaagagtcaagtagtaggcatgagtacactttttacatggcttatggttttacgttatcttctaccaaacagctgttttgtacttaataggcctagtttctgtaacccatttggaacttcccccatcagctgtcgaaaggcttcaagttgagaaacactgcactgtggcttcttcaaatggcttttcttttttgagatagggtctcaatgtcacccaggctggagtgcagtggcgccatcatggctcactgcagcctcgacttcctgggctcaagccatccccctatctctcagcctcccaagtagctgggactacaggctcgcgccactgcacctagctaatttttatattttttggagagacggggttttgccatgttgctcaggctgatctttaactcttgggctcaagcgatccacctgccttagcctcccaaagtgctaggattataggcgtgaaccaccacgccaacctcaaatggctttcctttaaaatttcttgagcctagtccgaagatagtgagttatctcagttgattgttcacagtcagttacagattgaactccttgttccactcttttccccattctcactactgcacttgactattctttaaaaaaaagaaaaaaatttctgaaatgatcggggaaaagctgctataaattttatgaagttgagagtagaaattgaatgtttaccatttggggccacatttcaagaacactgaagaatggaaagtgggcattaactgaagcagacacctcttgaggtaagatttgtggaagaagaggttaaagtgtgccagaaatttgggttaccctcctctagaaagaaattccagtaatggatctgtttaagtgttaagggagcagaagagaagacggtgaatgtacttcaatattttgaacatttttagaaataggaattcttgagtctcttttctttcttcagtcttttccatttctttttcttttctttttcactgtaatttctgtgtttctgatactgtgctgttttagataatattatgtttacatctttcatcccactccttatcccttcaaaggtctgaggaaaaaaaacctgtcccctggtgcggtggaatcggatgtgagaggaataactggggttgatctatttggaactacagatgcagtggtgaagcatgtactagaggtacttatctttatagccaggggctgaatatgggctgtcatcttgggaaagtcacagtatgttgttcatttattcattccttcaacaaatatttacagagtgcttattaagtgccaggcactgtttgaggtactagaaatcaaattgtgcgtgaaccaacagagaaatgaagcttatgtgccacctgagggagagtcttattaccttataaacccagtgggaaagggagaaagccaggcgtagacctcatcaccatcccaaagcagagcccattctcaagctttctgtaaggcagggcagcaggaaatttaatcggagttatcgagaaccagccatgtgtaacttttgtgcaggtgggaaaacagaaaagcataagggaaagaaactagtttttgttctaaaaaattatctaatcttcatagctacccactgaagtagatattattatccctatttagcagacaaaaaaaaaaaagagatttagagaaattaagtggtctaccaaaatctacatatatctagtaaataaatgtaagaaataagatttgaatttcgatctgactccaaaacccaggtgcttttcgctgcatcatgatacatctcaataatactgctaattcaaaactgccttatccaggattctgtcacaatataccatataactgtataaatagggtatacagtatcttaaaatcagcagttcttaaactttttggtctgaagatctctttatactcttaaaatttattgaggaccccaaagagtttttgtttatgtgggttatatctgtcaattttttaccacattttagattaaaacaacttttaaaaacatgaaatatatcagcacacattctattagctgtcagagcgatgatatcacatatcatgtgctgggaaactctattgtatacttacgaaagaataagaatgaagaagataaataggctgggtgcagtgggtcacacctgtaatctcagcactttgggagaccgaggccagaggattacttgaggccaggagtttgaaaccagcctaggcaacatagcaagaccttgtctctaccaaaaaaaaaaaaaaaaaaaattagctgggcgtggtggtgctcacttgtagtcctttgggaggccgaggtaggagaatcacttgatcctggaagtttgagacttcagggagcaattaatatgattgcaccactacactccagcctggatgacacagcaagacctcatcttaaaaaaaaaaaaaaaaaaaaaaagaatgaagaagacaaagtcttagtaatattatgaaaatagtttttaccttgcaaacttcttaaaataatcttggagctccttcaagaccagactgagatttctgcattaagttataaaagttttcgggcgggcgcagtggctcacgcctgtaatcccagcactgtgggaggccgaggcaagtgaatcatgaggccgggagttcaagaccagcctggccaagatggtgaaaccccatctctactaaaaatacaaaaaaattagccgggtatggtggtgggtgcctgtaatcccagctacttgggaggctgaggcagagaattacttgaacccgggaggcagaggttgcagtgagctgagatcgtgccactgcactccagcctgggtgacagagcgagactccgtctaaaaacaataaaaaataaaaaataaaatttgtctggagatattaataattatttgtagaaataagataaaaataggcaagtaaaaaacaaagcagaatatcctaaatgcaaatgaggctgagtttaggggttagaaatatgtatttggaaattcacatgagaatttggggtaatattggaggacagacatggtaattctgatgctcaaaattttagagcagcgtagtctcttgaatctgttcacatgaagaataaatcagagacattttttacaacgagtagcttgattcattggtttgctttgagtaatgactataaagatgttttagaagaaccactcttttctacagggtcacgatcgtggagtaaactgggctgccttccaccccactatgccccttattgtatctggggcagatgatcgtcaagtgaagatctggcgcatgaatggtgagtgaaccggttacattatcgccatatctaagaaactgccagccagcaaggtaaagtagccaggtcttctggactctgacctatttttctaccttaggtgattaattaatgctaatcccaggagcatagaaattattttacaaataaaatatatcatctttacaatttttatgtgtacagttaagtggtaataaatatatttatattctgttttcctccatttcctccttcaccctccttcccattctactctcgatcttaataatatccactttttagcttccacatgtgagtgagaacatgccatatttgtctctttgttcttcccttaacataatggcctccagttccatccattttgctgcaaataacaggatttcattcttttttatagctgaataatattccattgtgtgtgtgtgtgtgtgtgtgtgtgtgcacgtgcgcgtatgtaattttctttattcatcccttgatgagcacttaagttgattccgtattttggctattgtaaatagtgctgcaataaacaaacatggggatgcagataccgctttgatatatttatttcctttatttggatatatagccagtagtggaattgctggataatatgttagttctatttttagttttttgaggaacctccatactattctccattgtgactatactaatttacattcccaccaacagtgcaggagggttcccctttctccatacccttgccagcatctgttattgcctgtctttttgatacaagccattttacctgtggtgaaatgatatctcattgtggatttgattcgcatgtctttttttctatatatatgtatatatatttcagcctctgtgttaaggacacattgatttgcatttctctgataattattgatgagcattttgcccagacaatgtcctgggacatttccccaatgttttcttctagtagtttcatagtttctggtcttagatttaagtctttaatccttttttgatttgatttttgtgtgtggtgagagataggagtttcattcttctgcatatagttacccagttttcccaacactttattgtatgttcttggcacctttgttaaacatgagttagctatagatttgtggatttatatctgggtcctctgttctgttccattggtttatgtgtctgtttctgtgccagtaccacagtgttttggttactctagctttgtagcaaattttgaagtcaggtagtgtgatgcctccatctttgttctttttgctcagaattgctttggctatttggggtcttttgtgctgccatataaattttaggattttttttctgtttctgtgaagaatgtctttgatattttgatggggaatacaataaatctgtaaattactttaggtagtaatttaccctatcatttttacaatattctttcaacccacaagcatggactatctttccatttttgggggtcctcttcaacttttttcatcagagttttatagttttccttgtatggccctttcacttctttggttagagtgattcctgggcattttatattttttgtagttactataaatgggatttcttgattttttttcagattattcactattggcatatataaatgctactgatattttgagacaggatctcgctctattgcccaggctggagtacagtggctcgatcttggcttactgaaacctccccctcccaggttcaagtgattctcatacttcagcgtctcgagtagctgggactacaggtgcacaccaccacacctggctaatttttgtactttttttagagacgaggtttcaccatgttggccaagctggtctcgaactcttgacctcaagtgatctgcccaccttggcctcccaaagtgctgggtttataggcatgagccactgcacctggtcatgctactgatttttgtatgttgattttgtatcccgcagctggactgaatttatcattttggttgagtcttaggtttttctaagtatatgataatgtcatctgtgaacaagggtaatttttccaatttgtttgtcctttatttgtttctcatacctacttgacctggccaggacttctagtgttttgtcgaataaaagtggtaaaagtgggcatccttgccttctggtccgtagagaaaaggccttcaattttttcccattaagtgtaatattagttgtaagtttatcatatatggcctttattgttttgaggtatgctctttctctacccatgttgataataacttttgttataaagggatgttgaattttatccaatgttttttcagcatctgcttaactatcatatggtttttatttttgattttgttaatgtgatatatcatgtttattgatgtatattgaaccattcttgcatccctgaaatgaatcccacttgatcttagtaaatgatcttatcagtatactattgaatttggtttgctaatattttgttgaggatttttgcatctatgttcatcagtgatatcggcctgtagttttctctttttgtggtgtccttgcctggttttgttatcagagtaatgctggcctcatagaatgagtttgaaaatattccctcctcttccttttttttttttttttttttttttaagagtttgaataggattggcattaattctttaaatgtttggtagaattcagcagtaaagcagtcaggtcctgggcttttctttgatgggagaatttttattaaggctttgatctaggcactggtttttagaagtttttctattttatcgtggttcaatcttttttttttttttttttttttttgagttggagtctcgctgtgttgcctaggctggagtgcagcagggcaatcttagctcactgcagcctccacctcctgggttcaaacaattctcctgcctcagcctcccaagtagctgggactacaggctgtgccaccatacccagctaatttttatgtttttagtagagacagggttttgccatgttgtccaggctggtcttgaactcctgacctcaagtgatccacctgtctccacctcccaaagtgctgggattacagacgtgggccaccatccctggcctcgtggttcaatctttgtaggttgtatgtgtctaggaatatatccatttcttgtaagttttctagtatgttggcatgtcattctcgtaatagtttctaatgattctttgtatttctgaggtctcagttgttatgtttcctttctcatttctgattttatttatttggatcttctctcctttttccttagttggtctagctaacagtttgttgatactatcttttcaaaaagcaagtgtttcgtttcattgatagtctgtattttttttagtctcaattttatttctgctctgatctttattgtttgttttcttctactaatttagggtttggcttgttttttattatctaggtccttgaggtgtatcattagattgttcatttggagtctttcctttttttttttttttttttgacataggtgtttatgttataaacttcattcttagtactgcttttgtcatatcccataaattttgttacattgtattgccattttcattcgtttcaagcaatttttaaatttccttcttaatttcttcattgatccattagtctttcaggaacatgttgtttaacttacatgtgtttgtattttctgaggttcctcttgttattgatttctagttctattgtgttcagaaaagatacttaatataatttctattttttacaattttttcaagcttgttttgtggcctaaagtatagtttattctggagagtgttccatgtgctgatgaaaagaatattctgtagccgttgggtgaaatgttctgtaaattgcagttaggcctattagatctagtatgtagtttaactccactgtttctttgttgatttactgtatggatgatctgtctgtttttgagagtggggtattagctctcctactattatcatattgtagtctacctctccttttggatctattagtgtttgctttatatacttgggagctttggtgttgggtgcacagatacttataattgttatttcctcttgctgaattgacccctttatcattatatagtgaccttctttgtctctttttacaatcttaggtttggtagtctgttttatctcatgtaagtatagctacgcctgctcttttctggtttccagtttcatggaatatctcccactccttcgttttcagtctatgtgtgtctgtataggtaaatgggtttcttgagggcagcatatagttaggtcttctctctttatccgtttagccactctatgccttttaattgaagaattgagagcatttacattcagtgatattattgataagcaaggacttattactgctgttttttgcttgttttctggttttgttttgtttttttttgaggcttctctcttccttttcttactgtcttcttttgtggttaagtgattttctttggtaatatgtcttaatttgatgctttttatttttagtgagtatatattaatagtttttgtgctgtaattaccatgagattcacaaaaaaaaatcttatagatagaataaggtattttaaagagatgacagcttattttatatcacaaacacaagaacaaaaacaaaggctaaaacacactcagaaattatacatttaactccatttctgttcctgcctttttgactatctctttaacatgttgctatagctattattgcttttgatatatttgtcttttgggcttcatagtaaagttataagtggattgtgtaccaccattatagtaatatagtcttctgggtttgtctatgaacttaattttacatcttgggttttatatcttgaaaagttttctttttgcacattagtgttttttttttttttttgtttttttttttttttttttttttacaaatattgtttattttaatgaagctggtacagacaatgtccatttaaaacccatatcccaggccaaaaagtacaaataaaatcaaaaagagcagtgttctgttgtattcatttctgcatgtatagctttattaattgctaatgaaaattagaacttttctgggatcttctgacaagatttttaaaaaatcttaaaatgccttttcttcaatgaagccatctttggagttagtcattactctctccttatcagttatcttgacttcaacccgatattcctcttcttttggtccagaccctcaaatttaagagtagcttgaagttaaggaaaggtcatttttccacagtttcagttctctgaaacacttccatctcccactgaaagtcacagtccaggagtgaagtaatcacatgctagaacatcagggccaattcgcaagttattatgaacgcttgcattggtcaatcttatttatcaccacaagcctgaaaatgcaatgtcctgaaaaaggtgggctctctgtgcacacgtaatttttaaaaaggagagggtaatatgaaggggactgaggcttgatcaccaaaaatcagcacaatgaaaataaacaataatgaataatgagcactagaattcagattaccagatgtttcaaagagatggggtgccagttttcaattccgtttttaacaccacattacaaaagaactatttttaaaaatgagaaaggattgagggaaaagaaaaaaaataaaaagaatatctaaactgttgaatgaccccccatttgttcctgataaacttcaatcacatcttcttcctccattcccagttcttttggagtatgattatcagcaattctctgaccctcaaagagaaacctgaatgaattcattggaacgccctgtctttgacagtatgattctttgagtttcttgagatgtgttgtcattttcactttgaagtgaatctcactgctatcctgtccaatgactttgagtttaatatattcaccttccttcttatcccccaagtcctcagttgaaggttttgcctcctggtcagacatgatgacagtggcttcacccgggggtctccgcacagcagcggcctcgggtaagcagaacctcactccggggtttacaaatccttctcccttccccacagcacaacaccgcagctgcagtaacttccgctaccacattagtgtttttttctttcagatcgaagaactacttttaacacttactgtaagatggatctggtggtggtaaattctcaccttttgtttgtatgggaaatactatccttcatatttggaaaataaaataatcttgctgggtacagtattcttagatgtcaggttttttctttgagcacttggaaaatgtcattcctctctctcttggcctgtatggtttgcattgaaacatctattgccagacaaattggagctcctttgtgtgttctttgcttcttttctgttgtgtattttaggatcctttctttgtccttgacttttgagagtttgacttttatatgccttagggtagtcttacttgggttggacctgtttggtgttctcaggccttcctgtacctggatatttcttcctcaagttttggaaaattttctgtaattatttctttgaataagctttctacgcttgctcttgcttagctccctcttgaaaaccaatcattctttttttttttttttgagacagaattttgctcttgttggccaggctggagtgcaatggtgcgatctcagctcaccatgacctccgcctcccgagttcaagtgattctcctccctcagcctcccgagtagctgggattataggcatgcaccaccacacccggctaattttgtatttttagtagagacagggtttctccatgttggttagggtggttgcaaactcctgaccttagatgatccgcccacctcagcctcccaaagtgctatgattacaggcatgagccaccacgccagccaattgttcttaaatttggtcttttgaggcaattttctgtatcttgtagtcttgtaggtagtctttgttccttttcattctttttattttttcctctgacttctttttttttcaagacagggtcttgctctgtcacccaggctggagtgcaatggtacaatctcagctcactgcaacctccacctcccgggttcaagtgattctcctgcctcagcctcccaagtagctggtattacaggcatccaccaccaggtctggctaattttggtatttttagtagaaacagggtttcactatgtcggccaggctggtctcgaactcctgaccttgtgatccacccacctcggcctcccaaagtgctgggattataggtgtgagccaccatgcccagcctgactgtgtatttttcaaacagccagtcttcgagctcactgatttttttcctccacttggtccagtctgctattcagagtctctaatgagctcttcatttcagcaaatgtgtttctgtttcaagatttctgtttgatttgttttcattgtttcaatctctttgttaaacttctctggtaaatttcttaattgtttttcagccatctcttggcgataacagggtttcctttaaactaccagttttaattcttggtcagagatcacaaattgctgtcattttagggtcagtcattgtatttttgctttgtccttgtggggaggttatggttccctgtttgctattgtttattttgggtatacacctatgtctttgtattgaaagattagttacttattccagttttctctgtttggcttgctttggtttttattggatatatttgcttagcaaatctgtactgctaggtcacttcctcctctttggctttaggtgacaccttaagtccgggttcaccttggctttagtaaatgaccagagcattgtctgtcctgaatggggaggtcccaaagggattatcccagctgtgtgtcaaggctggctagaggttcgtgtatgggcagacctgtggaatatacttcctgcaatgcagtgctgctgagcagccactctgatttggcatctcctttggccaagtaacagagcagagtttctggggctgggtgtgatagtcttgcctccccgctttctctctgcctgtcctcagggatatttcccctttcaggcagtcgtgatgcttcccatgggttaagtcaaggttagatctcctgccagggcacccaggaagatggggaaggtagttgacctcctcagtctcactttttccagtgtagaaaccatgagttgggggagggccattgcagatgtggaaatcagatgctcttaccatctgctcagagttttttcatctctctgtggccccaggaactgtctcattgtcatatttgagttctgggttgttgctgatgaaaatctcagcactgtatatttgttttgggttttctgtggaggggagtgaagccagcttgcttctataccactgttttgaaactgaaagtattccttctttcccttttttcctgtggtggtacccttattttgaggagtatgaacatagaattcatccattcatttgacaaatatttattgagtacctcctttgtactagactttgtttaaggctctggagatacagcggtgactaaaacagataaggcccctgtctgaaggagctcatatttgttctaaaatggcaactcctaaagtggcaggtccctgaaaaaaagaaaaaataacaaaaattgaaaggccaactaggacagttgttatcaggacagataaaacaggataaagggatggagaatgatgaaaaagaggtgtttgtttttttgagacagggtcttgctctgttgcccagcctggagtttggtggtgcattcacggctcactgccgtcttgaccttttgggcttgggcgatcctccccctcagcctcctgagtagctgggactacaaacgtgcgccacaacacccagttaatttttgtattttttgtagagatggggttttttaccatgttgcccaggctgatctcgaactcctaggctcaagtgatccccctaccttagcctcccaaagttctgggattacaggtgtgagccaccatgtctggccaagagaagaggttttataatcaataagagggtcagaatgaaagaaccaagacatgtaaagattaagagacttaaatgaagaagattgccatattagaaagaagttggcaatttagcattctgtaatagtacttagttcttgatgaagaggatgtcatatctccaaatcctaaagttatagtagtagggaattgtgatgacctaattctttttgtccttcagaatcaaaggcatgggaggttgatacctgccggggccattacaacaatgtatcttgtgccgtcttccaccctcgccaagagttgatcctcagcaattctgaggacaagagtattcgagtctgggatatgtctaagcggtaaggtagtcctcagtgttgtgtgaactttctcttactctctcttttaaaattagattggaatacttctttatgtctctcatcatcttcagcatgtagacaaatcaaatcatatattatgaaaatttgaagagacctagagatcagtcaacatttacaaattttccatcaaatagaaatctccatgtatattattttttgcctctaaatttaaacatgttttcttcttccccctttccccagttctgtagctagagaagtaagaaatgcggaatgaggccgggcgcggtggctcatgcctgtaatcccagcacttgggaggctgaggcgggtggatcacgaggtcaggagattgagaccatcctggctaacacaatgaaaccccgtctctactaaaaatacaaaaaattagccgggcgtggtggcgggcgcctgtagtcccagctactcaggaggctgaggcagaagaatggcatgaacctgggaggtggagcttgcagtgagccgagatcgcgccactgcactccagcctgggcaacagagcgagactccgtctcaaaaaaaaaaaaatgcagaatgaaagccataaaattatgctgaaaaggggaaatctatatatcataataatatggtcagttttgaagtctcctctttttgttccttggtagaatttatcacgactactgttacttaggatatgcagtttactctccctgatttacattttaatcagcttgctggcttaccatttaatattcttgtgtaggatgggctgaagattcctaggaaattaatgtttttctttttgtgtaccttttctaggactggggttcagactttccgcagagaccatgatcgtttctgggtcctagctgctcaccctaaccttaacctctttgcagcaggtaagggccattttctctcttttttctttgcttaattcaaagtttataagtcttgaaagtgattattagctttgtctctagtaaatgtatagtaggatgacaagaagaagaaggactctcagagccacttagttgaagcttttctcctttttttcttccactttatatgtacgtaaaatgatgtgtggtgaaaaatgctttgaagaaaaattaaaggtaaggcagatagagacagatgagtatggggactgctgctttatattgggtggttcagaaaagtgaaagggtatgaggcaatgggaacagcaaatgcagagactgtgttgtgagaggtgcttagcatgtcaccatcacatgctaaggaacaccaaagaggccagttggagcacagtgagtaagggactgagtaacaggtgaggtctggccagatcgtgtattgccttctatgccatggttagaacttaagattttattctgaatacatggaaagccattggaaggttttgggcaggaaagtgacatgatctggtttatatttggagagcagacagtaggagaacaagagtggaagggttttctaagggatgatggtgctagtagggaaagagcaaaacattttaaaaaacagaatcacaaagggtttttaacatccattttttcagtaaatacttcttatactctttttatatgctagagactggggaaggatggaaattataatttctgccttcagggaattcatgttacaatgtgggtgatagacctaaatgattacagtgcaggatgataagtactgtaatggaggtttgtacaaagcattaggggaacacagaaaagggcagtgtggatagtgacactaagtgtggcagtgtgaatagtattaggaaaggattcacagagaattatttaaataaagattccaagaattgtgagaatttaggcaaataagggatgcattcaggtgtcttgtcttacagatataatcttcatccttacgtatctccaatttccaggtttttttcttgcctacagcttaattttttctcctcctctccctgtcccccaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggaggtaaatcggacttgtttctttcctccaaaccctctcatctgtcaccctgatacaactcccacaaacaagactcttcttttctttctttcatttatttattttatttatttaatttttttttgagacggagtctcgctttgtcgcccaggctggagtgcagtggcgcgatctcggctcactgcaagctccgcctcccgggttcacaccattctcctgcctcagcctcccaagtactgggactacaggcgcccgccaccacgcctggctaattttttgtattttttagtagagacggtttcaccatgttagccaggatggtctcaatctcctgacctcatgatctgcctggcttggcctcccaaagtgctgggattacaggcgtgagccaccgcgcccagcctatttatttatttttaaattttttttttttgagatggagtctcactctgtcacccaggctggagcgcagtgatgcaacctcagctcactgcaacctccacctcctgggttcaagcaattctcctgcctcagtctcccaagtagctgggattacaggtgtgcaccaccacacctggctaattttgtattttgagtagagacggggtttcgctgtgttggtcaggctggcctcgaactcctgaccttgtgatccgcccacctcggcctcccaaagttctgggattgcaggcgtgagccaccgcacccaaccaagactcttcttttaaatgacattttggatctcgtattctgtcacagatggaatccccattagatgagcccgctcagtttaaacccaatgagtgagggaggcaaggaagtggtcatgagtagaatgatagttcccttcttgagaatgctagtgaccttgtggatggaaaatcattctgccacaatttgctgggtctcttgcaagccagaggaagtttcttgatagagaatggcccaaactggtaacagaacttttcgcctttgtttggcatttcttttctttaactctcccttgccttccagcaaaaagtgcacaactctgaaccagaatatatgtccctggaaactcttaattctgaagatacaataacctctgggatgcctggcaaaaggacctgtccttttgaaaagccagctgcatcagcatgctgaaacattcatggtggcaaaatttggaatgaggttttgataaccaccctttagcatcattacaataaaaaaatgggtttatgtgaatactccaagggacaggagaaaccagccagagacaaatcacattatgttactctgtggtgtccactgcaattacgtgtaggaatttgtatccaagcagaaccagtcccactcactacagtgagtgttaaccctacctaccttctgttgaataatttgacttctactatggcttactttttaaaactgtttgttcaaagctgagctagggaagttgccaagccttaaaggaagagaatacaatatttattcattttattcctgattataaaagtgatgagtatatagtgtaaagattggataagtaggaggtgtgggggtgattcctttcttccttctattcttatgcctcttccctgttttctcctttttctatatatatctctagtggttccaagtttccagtattcaatatgtcatacaatccagcagaaaatgcagtcctgctttgtacagtaagtaacctgtggagccctcctaggttctcctcattttccataggtctctttcttatgcccttagggaatctttaatggcttcttagaaactatttaatggtcattttgtgagagctgacacagtgatcactcagagactcaaatcaggtaggtttcagttgtcgtaaacatattgagcatttgtgaactgcctatctttcctaaagctgaacttaatggagcatcagaatgaatgacccagatcactagaaataatttgagagaatgtttagactatatatatatatttcctatggaaagaaaatgtttaccttgatcccttcctttgggtgaaaatagaagaactattattttgagaggaagttcatatcagtggggttggcttcagagtcatcaatgactcctctctgtttcttgcaacagaatttgcaaaaaaaaaaaaaaaagaaatgacattctaattttagtgccctcgtggccaagttaaaaggaatgaagttaaatgtctttcctcatataactatattgtctaatctgttcttctttaatatctagtagtcccatactctgagttttcttgagtgttttttcttttcttctttttccaataaacatttgcattcctatagtgtcttttctttgatgtcttttttttttcctttccagaggttgagtactcagttgatgagtcctcagggtggggtaccagaatatcagggtcctagtctgttaatttgtggagtagagagcatttcttactttcattcagataatatctgcatctttggaggataaagaaaataaagtgacatcagtgctgatgtgtttggcaaagagccctataactcatagatgtagaaacagtcaaatgccctctgggtgaagggtaagaaaagtatggtttcagattggtgtctgtgcaatggaactgttttctctgtcagagtaaattggaaaactggtatcttgggtgcttctcactaacattttaatttccccttttcttctacagagagctagcaatctagagaatagtacctatgacctgtacaccatccctaaagatgctgactcccagaatcctgatggtaagtgttctttttgtctaccccactctgcttccagctctcctcacccgcatcataactcctcttcaagtttttcacattccatccccaagccatggccacatcactcatgtctgttggcaggtgctgctgacaattgcatcagaggcgaccatggtgtgaaatattcatgttcctcctccattttattaccccagctagatatatatattttataatttggttattagaaactctccattctctctttcagcacagcatgttatcctagtttattgtcagttgatatgactttcaccctggtagtttcatttatttaaaaatgtggttccaatcttataatgcctcatcctgggactagggatttatactgtcctatccacatccagatccgatttgcttccttttgcatgtcaaaaagatgaggctgctaacagccccacaccccacctgggatcccaggatccagctgagactcctgcctacctcttccattaccactatcccttgttgatgtccttgtgattagaacttgctgacaaaacattctcagaatggatttgactattgcctatggtcttttgggtgcacttcttccagcgggtttatggctagtaccaggtcagagatttattctgcagatccccactcttactggcatattttaatgatattttagaccccatcaacagattcctaagaaataatttgctagctctgtttcttttgtgggtgcccctgggttattattgttgctaatcgatctcctctcttttaaatgtgttcatagtgagagaaagaaaagatatttgtatttggtatccataagtcaaagtctcccttataaattagtcagttaagccatttctgactaaatcttatggtttggtacctcccaactagctctttgcttttttttttccccatctgtgtttacaattaatagaatttaaaatattttgttttgttttattaccacttttattttctgtacttcattttttgagggagataataataaaggagcagcccagtggtgggcaacagagatgggcttgaataatgcagattcctggcccctggaaaacgggagtgttggttttgataataattagtttcataaattgcctgccactccagatgccaggggcaagactggccagcatgttctctccagttttctgctggtctaataggtaaaagagtattttgatgcacccttctgtttatccttctacaagtttcccagagaatggagtgtccatttcaaaattctaataagccactgaactgaggaacattttgtaactctcttcagggtgataagaatggtcagttgacatttacagagcaacaacttggttctaaataccgcccagcaccaagctctcctgtcaagatttagttgggagtgctctgcctcaccctgccctactaggaagtctgcatttgcatgttaaaagcagcagagagcagctgcatcctgtggagggggtcctatgacacaggcttgctttgccgcagcttggccagggaggccctgctcgttagcttgatggagtgtgctgtctcccaagatgggcggcccttctgccagtacatgatgttggctgaaatgcaaccacttggcctagagaaaagagccttggcaggggtggtggttggtgtttggaggggactggtggggaaaagtcactcaataatagccccaggttatggctgaattagttaggaagcagctcaactggcaaagccaagatggcatccagcaagactggcagctccatggcacccgactatgtcacctgccagtgactcaccacatgctcccaccctttggttttgttcttctcagcgcctgaagggaaacgatcctcaggcctgacagccgtttgggtcgctcgaaatcggtttgctgtcctagatcggatgcattcggtgagttaagactaaaagcagaaactaatttggggagtgtggtggcagtggcctgtgtattgcaaaataaagaccattgttttttctgttctcccccgggcagccgtgattctcatgtattggctgtacctctgtctctagccctacactaagccctcttgggggaatggcattaaaactgatttgattgggttgatgatcgccgtggctctgggtttaagaaccaagctaaagtcactcttgactacaggagcccaaaacgcatcaaatctgaagtgagtgggctggatgaggaaatttccctccttctgctgcctccattgttacttgaaatgtaataggtccagcacaagataaagcactctgaagaaaatatttaacaaaatttaagccccagaaacagtgttttctctctctcattcattgagaaattcagactttagttgggacttctcaggatgttttagttggaggagaaaaaataatgtattaaggcccttagagaagatcttggttggcatggtctgtctgcagtggtaattgacatggacaggacaaaaaatacttagttaattgaagctaaggaacaattgctgaggaacatcatcagttgtcatcatcatctatacacatttcttctcttaaccccatctttaatacttattgcagcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggtaacatatcaggtgcccctaagcagacagccctgtagttggggagagtggacatctttagtgggaaccttttttccccaagtgagtttgtcttgtggcttggccacttcttgtgctccaagactctttatagtaacttttcccttctgtgatcactctccattcttcacgtccacactagcattacagtgagattcttggttatttatctgtttttacagtacttacctgaacaaagcgtgttctccgagcttagaatgagagagagacagagattaataacatagttcctacatttaagggagcttgcagtccagtggtgaaaacagacatacacagattccctaataatacaaggaaatgagggagagggggttgaggaaggggtaagtgcacaatgtgagccaaaatgtttaagtcactgagctactatgtaggaattacattaagtattttatgtaattagaattacattaagaaattggggtttacattaattagagggtgcaattgatgtagatcaaagcctgagacaagggaaatagatccattcatgtttgcacatctctatctatctcaggactctggcatctgtgaagatttctaaagtgaaatacgttatctggtcagcagacatgtcacatgtagcactactagccaaacacggtgagtcttcattatatccaccctgatttagagaccattcccttccaccccgatccctgccagtctacggcacttaccctatccaacagaacactcatgccctttgcctcttacagccattgtgatctgtaaccgcaaactggatgctttatgtaacattcatgagaacattcgtgtcaagagtggggcctgggatgagagtggggtatttatctataccacaagcaaccacatcaaatatgctgtcaccactgggtaagttaattatctgggatacagaatgggagaagacagcttcctgaaatcactgtcttgtcttgagatgtaactgaagtcctccatgaattttcttcatggaaaagccttacctggcatatatgtgcaaggggcatcagaacattcttttttcaacttttttaaaattgagaaatctaaaacaaatatagacaattacattaaaaaaaaatagaataacaaataagttatgtagtgaacatcagcataactaccacccaagtcaaaaaatagaacagttccggcaccccagaagccctttgccacgtggtcacaaccctccctgtttccaccaacagtaacattctagtttttacagtaatttcttccttgcttttctttgtaattttactgccctgtgtttcttaatatgatttagttttgcctggttttgccttcatataaatgaaatcatactgaatatattatttcatattttgcccaatattttgtttgtaagattcatccatcttgtagctccaatgtatttattttcatttttgtataattatatgattatgccacagtttgtcagttctactcttaaggaatatttgagtgaattctagtttttggcttgtatgaacaatgctcttaaacattcttttttacctgttttctggggtacatgtacatacatttctctagagtgtatccccagaatagaattgctaggccatggattatgcatatcttcacatttattaggcaatgtgaaactgcttttcttttttttctgaaacggagtctcgcccaggctggagtgcagtggtgtgaccttggctcactgcaacctccgcctcctgggttcaagtgattctcctgcctcagcctcccgagtagctgggattacaggcacacaccaccacacccagctaatttttgtatttttagtagagacagggtttcaccatgttggccaggctggttttgagctcttgaccttgtgatctgcccaccttggccccccaaagtgctgggattacaggcgtgagccaccgcgcccagctgtgaaactgcttttcaaagtgattgtaccaatttgcatgcccaccagcttggtataaaaatttccttttgggttgggcgtggtggctcacgtctgtaatcccagcactttgggaggctgaggcaggcagatcactggaggtcaggagttcaagaccagcctgagcaacatggagaaaccctctctcctaaaaataaaaaaaaattagctgggtgtggtggtggtgcctgtaatcccagctactccggaggctgaggcaggagaatcacttgaacccaggaggcaaaggctgcagtgatccatggtcgtaccattgcactccagcctgggcaacgagcgaaactctgtctcaaaaaaaaaagaacaaaaaatttcctttcttgtcttcttgacaagtttggtgagacttatttttgtccatctgatggatgcgtaatggtatctccttgtaattttgttttgctgttctctgtttcctaatgagattgagcaccttttcatctggccatccagtaggatttcctcttatgtgaattctgttcaaatctttaatctattttatattatctttcttttttgcatgtcagtcctttgtcagagctacatgttgcaaatattagtatctcctcttttgtagcatgtcttctgattttctttatggtatcctttaatgaacagtcttaatttcaatgtagttgagtttatgaatctttatcttttatggatattaggtttcatcctatttttaaaatatttattgactcccaaatcataaagccattcttctgtattcttctgtaaaaacattgtaactttgctttttatatctaggtctataatctacctgacattgatagttatgtatggtgtgaggtatagaaagctcaatcccactttttccataaggacactcaattgcccagcagcattattgaaaagaccgttctttctccattgttctgcagtctcgtctttgttatacataaatcatgttttcaaatgtggtctgtctatctctgctctaattccacactgtcttaaataatgtagctttatgataaatcttcacatctggtacaacttttcctttgatcctattttgtttattttttaaaagtcgttagggtattttcaagtaaattttgccttctcacgtaagttttgttgttgttgttgttgctgttttgagatggagtctcactctgttgcccaggctggagtacagtggcgtaatcttggctcactgcaacctctgcttcccaggttcaagtgattctcctgtctcccaggttcaagtgattctcctgcctcagcctcctgagtagctggtattataggcgcatgccaccacacccagctaatacttgtattttgagtagagatggggtttcaccatattggccaggctggtctcgaactcctgacctcaagccatcctcccacatcagcttcccaaagtgctgggattgcaggcattagccaccatgcccggcccttcatataagtttttaaagtaacttgtgaaattccgggcccagcacggtcgctcacgcctgtaatcccagcactttgggaggctgaggcgggtggatcacgaggtcaggagatcgagaccatcctggctaacacggtgaaaccccatctctactaaaaatacaaaaagctagctgggcgtggtggtgggcgcctgtagtcccagctgctcaggaggctgatgcaggagaatggcatgaacctgggaggcggaggttgcagtgagctgagatcgcgccactgcactccaacctgggcgacagagtgagactccatctcaaaaaaaaaaaaaaaaaaaaaaagtaacttgtgaaattccacacaaaaaaagtttgtggtttcgtttggaattgcattaattctctacatcagttgggggataactgtcatctttacagtccttacagtgttcagtttcctaatctgtgaacttggtatagcagctcttcattcatttaggtcttctgaaacatccttcaataaagttttatagttttctctatagagatcttgcatttctttggttagatttattagacacttgatggttttaaaattctgtttgtaaatggataatatctatttaaaattttaattttctaattttgttgatatttagaaatacagttaattcaatttaaatacaataaaatcaatttaaaattgattttaggaatcttgctagactcttatcaattccaggatttatttctatttcctttacaaataatcatagtatctgtgggtaatgacaatttagtttctctttcaagtacttatatattactatatttttcttgcttactgcactgactaggatctccagcaatgtggaattaacatgatgacagcaaacattcttgtcttattcctaacttaaagggtgaactttcagtgtgttagaattatgtgagcttacagtagatttttaaaatgtatatcccttttctatgaaggaattttgctatttctttttgctaagagtttttttttttaccttggtaaaattcaacatttaccaacctaaatgttgaatttatttatttatatctatttattaaattaatgtaatttaactatttttggcagagagtctcactctgttgcccattgtgtagtggcacaatcttggctcactgcaacctctgcctcctgggctcaagttatcctcccagctcagcctcccaagtagctgagactacaggcatatgccaccatgcccagctcatttttgttttttttgtagtgatggggtttcaccatgttgctcaggctggtcttgaactcctgggctcaagcagtcggcctgccgtggcctcccagagtgttgagattacaggcatgagccaccatgcccggcctaaatattgaattttattaaataacttttctgcatatacaggttgagtgtcccttacttgacatgcttgaaaccagaattattttatatttctgatttttttctgattttggaatatttgtgttactgattgaacatcccacatccaaaaatctgaaatccatactgctccaatgaacatttcctttgagtgtcacttcagtgctcagttttggattttggagcatttcagatttcctgtttgggatgctcagccagcattggggtagtcatacaatttttctcctttcattgattaatgtagtgaattaaattgatttttttttattttttattttttttgagacagagtctcaccccaggctggagtacagtggcatgacctcagctcactgcaacctccacctcccgggttcaagcacctcagctcactgcaacctccacctcccgggttcaagcaattcttgtgcatcagtctcccaagtagctgggattataggcatgagccattacgcctggctaattttgaatttttaatagagatgaggttttgccgtgttgttcaggttggtcttgaactcctgacctcaggtgatccgcctgcctcagcctcccaaagtgctgggattacaggcatgagccactgtgcccagctgattttttataaatgttaaatcaacactatattcctgatgtaaacctaacttggtcttgatatttttacccttttcaaatattgctagctttaggttgctaatattttacttatgttttcacatatttataagtgagattacctgtaattttcccttttcttactgtccttgttaggttttagtatcaaggttgtgtgaatttcataaagcaaagtaatgtattttttctgttccctcaatgagtttgcatacaactggaattaattcttccttgaatattggttagaatttgcccttgaagtcatatggacataggactttctctatgggaggattttaaaaatctgattcagtttatttagccattataggactataggtgttttctatttatttttgattcaactttggcaaattttattttttaggagtttgatccttctatttatttatttatttatttatttatttatttatttatttatttattttgagtcggagtctcactcccagtctcacccaggctggagtgcaatggtacgacctcggctcacggcaacctccgtctctcgggttcaagtgactctcctgcctcagccttccgagtagttgggattacagacatgcaccaccactcctggctaatttttgtatttttagtagagacggggtttcaccatgttggccaggctggtcttgaactcctggcttcatgtgatctacccgcctcggcctcccaaagtgctgggattatagatgtgagccactgtacctggccagtttgattctcttaaaaagttacatctttattctgcaagatctgtagtgatatcccctttttcattcctattgttttcttttctctgaattaccctcatgagaggcttatcaattttattcaagttttgctttcattgaacttctctactgtagtttttgttttttatttaatttctactattggcttcattattttcttctaagtactttctttggcttaaaaagaacagtaaattttttgagatgactgcttgttaattttcagtttctcctaatatatgcatgtagaacccaataatttttaatatttcttctaatgcagtctgtaaattatctgttaaatgttgcattagctatattgacaaacttcaatttgcaatctatttattattattcagttcaaaatactttgttttttattatttctttatcagaactcttcacatctacctctcttctactttcagttatagattataaaggagttacctgtccataatcacctactgattatatatcagaacttaagatttaacttttaggtctgattcctatagccacatctgttactcatcttctaggataatagcatataaagatcgtgccatctaccccatcgtagaaagaatatgataaatttggcatttagttctgctcttttttgaatcacttcccatctatatcattgttcaaatggcacttgacaaaagaccgtttcctaggtttgttccgtttcttcacaggatggattttccctctcacttactgaaagctgtgccctctgttcttagggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtatgaagtgaggatgcaaactagagtattaagagaggcagcactctttttttttttcttttcctgtaagtgatgtctacttcttgcccgactccaccccaaatgtctaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgaggtgagaggaatatggtcatcagccccatattgtcttagaggtgagagagttagagtgccattgggagggcattattctgggcttgcttctttagccagaataatgaaatttgggattttttttagttgttacattgagccatcttcctgttgctatttgcccatctctacttttacctgcctctgcttctgccaccgcatttctatttttgtcaacctcaattagtgtgaattcagtaacttctaggataaaagcaagatggcatggaatttgaaaatcttattatttccttgacacttgatcttgctgactggctacttagatgaaagagtacctactaagcgttggggcctagaatgtataggcattgttttctaaggcgaaaagagcttatgaaaacgttttccagttctgaacttcttcctagtagtatttcttctgtctttgctaaagcccctgtggatcttcaaacctggcaggtgggaagtaaggtagctaagcaagaactggctctatggaatcagcaactgctaggtggttttgttgtaaaagtaaatttctgaggaggaggaggaggataatgcgatgtaattatttccatctctgtatccaaaggggtcctatgtgttcactggattttctttttttttttttcttttttttgaggcggagtctcgctcttgttgcccaggctggagtgcaatggcatgatctcggctcactgcaacctccgcctcctgggtccaagcgattctcctgcctcagcttcccgagtaggtgggactacaggcgtgcaccatgattcccagctaattttttttgtatttttagtagagacagggtttcaccatgttggccaggatggtctcgagctcttgacctcgggatccgcctgccttggcctcccaaagtgctgggattacagatgtgagccaccgcacccagccgattttcaatggaattagactaaaagctaggagtaattgaaagtataggaagttcttcaggaaatctatatagatgcagatgctttgcagagtccttggttttgagtcacattgtccttcaacctgttaacacgaccctggggattctttagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattggtgaggccctcaaactaaggatgggaagaggggttcttgggggaaggaggaaggtgaattaaggagaaagagaacttaagagaaaagacctaacttggtgtctcttacttggtgcagctgagatcagaaaggacatgagtggccactatcagaatgccctatacctgggtgatgtgtcagagcgtgtgcggatcctgaagaactgtggacagagtaagtatccgagacttgccagctttttcagggtctgaggaagtatttttctgtttttgttgagttaatctgtgtatagtggtgagggatttctctttattgtgcatttttttaggagagacaacatgctcctactgtgcttagaagattttcttcaaagccaaagggaggtgcagccagaatattcagtccagccaaacacccttaggagaatagttattcatgggggagataggaggttttaaaaggtcttgagtggacgccctagtaaatgcacttggttggatgccattagaattttattctttattttcagtttggaggtttcactcatttattcatgtatatagtcaagggatattttttgagaacccactatataccaagcattatattagcatttaagatacattaggaaacaagcaaggtgaaagatgaggtttggaccaaggcgctattagtggaggggtgagcagtggtcagattcaggatatattttaaggtagaaacaacatgatttattgcggtaactagatttgagatgtaacagagaggagtcagggatatccaaggttctcagcacggatggatacgtctcaaagataagcagctatattagttctctatttctgtgtaacaaattatccccaaatttagtagtttaaaaccacaaacatttattatttcacaatttgtggcatggcttagctaggtgcctccggcttaggatctctcatgaggctacagtcaaagtgttggccagaactgcagatatctgaagactcaccggggagagaatctacttctgcactcactcaatggccattggcagcccccatgtccttgctccctgttgtctaagaaacatcactttcttttcgtgttgacctctccataggagtttgtaacgtggtagctagtttcccttacagcaagtgagcaaaagagggcaccccaagatagaagccacaatctttgtaaccagatctaggaagtaacatcccatcacatctgccatgttccatccattagaagctatttaataaatccagcccacacttaagaggtgggtattttgcaacaacttgaataccaggagtcagggattactggggggccatttcagaggttgcttaccacagcagcatgcatttggaaatgtacctataccacaaagtctgttttctctacagagtccctggcctatctcacagctgctacccatggcttagatgaagaagctgagagcctaaaggagacatttgacccagagaaggagacagtgagtctttatttacataattgtctcttattacaggattaactctaggatcttagaacaatttaaaattatgaatgtcactctcccacctggttaccaggagaggcagagaaacaaatgagatcaaaggaggctccataactttccttacgtgacttccaagtgctatttgtttttagcctcttttcttctactattcagatcccagacattgaccctaatgccaagctgctccagccacctgcacctatcatgccattggataccaattggcctttattgactgtatccaaaggattttttgaaggcaccattgccagcaaaggtaagtacctatttctcccatagcacttttgttgtttgttttgtgaagaactgtcctagagaataccattagcatttagtttaacttgtcctttttttctgcatggagcctaatggaatattgaaatgccagtcatttatggtgcagtcttaaaaacttaagatagcattttcaggtcattaaagaaaatttggaaaatagggagaaaaaaagggatccctctactaccatcaataacttcggttaatattttggtgtattttcttaggttttactatatatgtagtcatgttctttgttcagtattttatcattcatgacatacaatcttaaaggtactaattcaactacctgtaattccggtatgtgggtataggcagatgtgtgctatcaccctccaccacttccacccttaacctcctcctgttttctgggtctcctagttcatttcccgtgagtaagagcctaaacagactcttgagcattttgtgccaaaccccactcttttctccacctcctctatctaccctatgcctgatgccctgtacacattgtagtggtggtagcttagcaaagcgctcaggaagaaattcaagagttggtagccaaaggctggtaagtacaaattatttaagagccagtttttggtagcaggaaggccagttccttccatctgtcttctattccctccctctgtgaaagctactgcaagttagcataacatatataccacaaaaataaataatacacaaaaataaatagtaagtaggcagaagcttggcacctgtttttgaaaggatttaacctgcctacagaaaaggccgtatctcagacttgctggactataaccagttccgttctgttccttccctctgtagggaagggaggagcactggctgctgacattgacattgacactgttggtacagagggctggggagaggatgcagagctgcagttggatgaaggtaaaagtgctgttttaagactgttctggggtgatggacaccttggattgggactgggttgtgggtagctctgcagacttccaggccatgaaacgaactaggattgattttacttcctttggctaagattatgccactgcccaaatctgttttgagcttgaattttccttacagatgggtttgtggaggctacagaaggtttgggggatgatgctcttggcaagggacaggaagaaggaggtggctgggatgtagaagaagatctggagctccctcctgagctggtatgtggaatttgtacccttagaaggttctctccgtatctccctgtggaagccagaggccttattgtcccctaccactatcctcaggtctcctatcctatcccctaccactatcctaaggtcagcccttctgggaaggggactagaccctcctagtctgatgcttatctcccatttgaaagaaggaagatggctgggcacggtgactcatgcctgtaatcccagcactttgggaggctaaggcaggacaattgcttgagcccaggagttcaagaccagcctgggcaccatagcaagaccctgtctctattttaaaaagtaaaagaagcaggaagaacgagagagtcaaagttagtggccttgtcacttccatctatcctgatatgctccaagaggagaggatgtaggacttatctctaatctgatgcttaactcccatttgaaagaaagaagaatgaggtaatcagcgttctgccagcagcagcttatgagaaggtagcaagctgtttcatctgaattggagtttttgatatgtcattttgtcactggtgaggtggctcctattttggcagccttctcccacaactatcacccctcttcctcagtgggggcagggaacaatgtaaatggttgtgttctagattcaacagaacaaagtgcttgaatggcttaaaaaattactcaatttggctgggcacagtggctcacgcctgtaatgctagcactttgggaggctgagccaggcagatcacttgaactcaggagttggagaccagcctgggcaacatggcaaaaccccatctctacaaaaaaatacaaaaattagccaggtgtggtgactcatgcctgcagtcccagctactcgggaagctgaggttggaggattgcttgagcatgggaggcagaggttgcagtgtgccgagatcatgcctctgtactccagtctaggtgacagagtgtgaccctgtctcaaaaaaaaaaaaaaaattactcaatactcaatttttgtttttcccctaggatatatcccctggggcagctggtggggctgaagatggtttctttgtgcccccaaccaagggaacaagtccaactcaggtaagcgggaagaaacctagcacggcagggatgagtggctaatacttgattggtatataacaggtgttggctacttttctactatagttacagaggagaatagagaagggacaaagtttcacttggcttgggtttttttgtttcttgttagatctggtgtaataactctcagcttccagttgatcacatcctggcaggctctttcgaaacagccatgcgggtaagtaaccttggcttttcctcttgagtgtgcctagcccagggtccccgggagatggttgactcattttaatcaagggaaattatcctacccataaggggaaaggtgtatatttttcatgaaaactctttatctttgttaagtacacttgccttcctgttatctgccttccacttggcctagtaatctcttagggcatatccttcagtcatcttccacccatttatagcttgctttctggctcatatcagtgagataagtacccctttccaagcagaggtctgttttgaacactaagccagtattgttataataacaacaataatgataacactgcaataactgctaacgtttatttaatgttcactgtgtgccaggcactatcctaaatactttaataggtatcattaaatgaggtaggtcttacaattaagtgtattttactgatgaggaaacgtgaacagagaaattaattaccttgcccaaggaaaagtagctttttatgcagcagggccaaaatccttgtttctttccttctgttccagctccttcatgaccaagtaggggtaatccagtttggcccctacaagcaactgttcctacagacatacgcccgaggccgcacaacctatcaggctctgccctgcctaccctccatgtatggctatcctaatcgcaactggtaaggcccttttctctttgctttcatctgttccaagttgtggtcgatatttcagatggtagcctcagtgacatagtcagaattctctcagagctagggtttcccagtagaaaaagatctttggtttgttactctatggggttggtttacacctgctgtcatcctcttccccagctactttaacaggagacaggagggtagctatgaggatgtttgccagaaaaggaaattgggtcctagttgcctactgactatcctgtcttcttcctacttttccctttccaggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggtaggagggtctagccgctgtcccagttctgggcacttccacattcttgtctctgtatcctgaccttctgccccctctacaggcccagcagctcatcaccatttgccgtgagtacattgtgggtttgtccgtggagacagaaaggaagaagctgcccaaagagactctagaacagcagaagcgcatctgtgaggtaagatctataggaccctgagcacaacagagacgtccttcccttcacccttcactaggtttgaattctttaatttcaaacccagatctgagtggggatgaagagaaatttaggcccttcatttctatgaggggaggatacatttcttcatcctacttcctcatctcaccagtcctccatacctaggaggtagaagacctctcagctttatagcccatcatcctattttgtgttgtgttttttatgcatgtgtagcagcttagaaatgacttctaccaggtgtagcatcaacctggcatgtgttcctttttctgtccaccagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacaggtagatggaactccttcagtgaccatagggaagccagatcagctcttacatggagggagcagaccaaggtccttgcctctgaaacaaagcaataaataacaacattcaacaaaaagccaacagaatgctaccctctgtttacttcctgacttggtgtttcctttgttcctggaaaattaatagtttattgagacatggcactcgtctaagagtgccgtgcaacctagaatagctccactgcagctgaaagtaaccccagtcctgtccttaagctccagatatcccatcacaaccaccacaaagcttcacatacacatctcattacttgtgtcctccaaatgcattctttttgggtgatggaagtctgttttaaccctttctaggacctgaccctgataatctctagagttggtggaggaatgtgggtctagattatggagccacttttgtattgagaaggggaaagtttgatacaataggaatggtgattgttaacccttcacatacatccagtacagaggttgggacctcttttcacgcagtacagttgtgtctcacatcaacggaactaccaaaccatggtgttgggatcctttgaggtgttgtctgcagccttctgtcctcctaaatactccttccttcccctagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtaagtactgtcctcaataaatatatctaggatattgagcgaaggggaaaaagaaagaaacatggtggtcctttttttcttcttgtgcttgtcccctgctccctgaggcagtgacactggagaaagctagagcatctccccactgctcttggccagtcagtgatgaacaccccaatacctgtctactgtgcccattgaggggtatagggaatacattttctagggttctcaatcttacaaatctctaacttgttcctttgtttgtttttccacaggtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttgac

SEQ ID NO: 37033 - DNA, 4644 bp, Homo sapiens
ctcattgaactcgcctgcagctcttgggttttttgtggcttccttcgttattggagccaggcctacaccccaggtaaaacctctgctcaagagttgggttgtgggtctgggagcgtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcaggacggaaatgtagggagtgggccgcagtggccccaggggaggctgggagacgcccggcggccgcgtggcgggggagggttgctgcatcggtttgcctggcgcgcggggaagtggagccagcgttttctttcacccagttccctgcttagtccagtcccaccgtggttcttcagagctgttcttggcgtgcttccagtatgggggtacattccggagtagttaaaagcccgttgactcccgggggcactggcacctggcgagggaggggaacagacagtgctcagttcggggtaagaccacgtgttgagcaacgccccacgccgtctgggtagatgggtccttcatctagggcgtgctctgctgcggttggcacggcaacctggactgcagcactagttctggacctcgcgcgtgcttagacaggaggtgatgggcactattacctcttggcagtggccatacgtttttcctggttaagtgttctgttaagggatgagggaaatattttgattaattgaatttttaaaccagatttttctttttttcagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttggtgagttcctaattttaaatgacagaacaaatataacagggctaggaagcacaaaagtttatgaaacgtgaggagggaactttttgattttagaaaaactgagctgagagacttgttatcaagtctgttataaaacaggttgtagaaacctttcaggctgaaatctggataacgtaggaggttgaagtttgaacctttgctacctatatggtagttgaattcacctacctatgaactgttaggtatttgagtaatcatggacttgagttttatcagaagagctatgaaattgaaagtgttttcatttgacaccttttacagatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaaggtgaggttggtttttcagtatggggtgcattccggagtagttaaaagcccgatgactcccgggggcactggcacctggcgagggaggggaacagatggggctcagctcagggttaagaccacgtgcccaacagtgccctaggctctctaggtagatgggtctgtcaacaccagaaaccagtgaatcttgacaattacacagtaatttacattttggtggggggggtgctccagctgttctttcaccagcattaatccatttgctggagtttgcatatatgtaagtataatagttaccaatctgtggtcttttccttattcctagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggtatgtaccatttgtgatgcaagttcggattattttaagattaatttgatccatcgtaaatttaaatgagattgtttttaacggcaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcaggtaacaatggtatctcaattaaccctaaaggcaggcaggcccaaggtgactcgctgtgatgagtgattgttaaacattcgtagtttccaccaaaagcttggctaatgatggcaacaccttccttggatgtctgagcgagtgatagttaaaacaggagctatgtactgggttttcttttaacttcttttaacgttaactttttgtttgctagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtatgtttctgtacttctcttgtttggcttactgataacagataaagggaagtcttgactgactcgctatgatgatggattccaaaaccattcgtagtttccaccagaaagtcttatgttggccagttccttccttggatgtttgagcgaccattcttccttagcaggaccctagcactgtcacagacctggagtccattgtagtaatttgttttatttcctaccaaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggtaaggaggcactgtcatctggtcttgacagggataatggtatttcaattgagttactggtgcctaagggcgtctagctaagagaaactagagttacacatacacaggtaatttaaggcttttacttagagttaatttctttcctaggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcaggtttgtgttttttttttttttttttcctcccccactcaatggaggggaaggggatggtaaaccaagcttgagctggatttcagtgtagggtcacaatgatgaatggtccaaaacattcgcggtttccaccagaattcaaggtgttggcaactaccttccttggatgtctgagtgacccaagatgttaaggaagaataaggccctattttaatgttggtagtggccctcttgtaagagtttgcgccagacttttagtatcagattgcgtcagggagaaagaagggttattaacattaaaagaacttgcagtaattcctttttctcttcctcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccat

SEQ ID NO: 37034 - DNA, 39464 bp, Homo sapiens
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagcacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgccccccgatctccttgcccgccgccgcctcccggagcagcatggacggcgcgggggctgaggaggtgctggcacctctgaggctagcagtgcgccagcaggtaccggtgttttgcgctctccgctaagcctccggctctcctcccagggccttcttctggtcatccttccctcctccccggggaactgtcctcctcttcggttacccctttctttcccttcatcctctggcgtcttcttcgcctcccccactttggtcccaagtcccccgtgcgtcagccacctcctctcccgcggacctccgtcctcctctctttttggatgactccctggaacccctccgacttcctgcgtccctctccggctccgttctcccttccccattctgtcacagcccgcgtctcctctatttccagtggggctgggatctgtgaccctttggttgtcctcgcctcctaactgaataaccttaacttcagttttccaggctctgctgtactctttgtgcaccctgggtggaaagcctcctaattctttcagtggtcaatgatgagccgaaaaactgccggttctttcgtcttacggccaggccctttaatctttaggatgctttgatagtgtttcccccttaacatcttccttcattcagtgcttagtttagcggaatgattggctgagaaaatagaattgaaatgtggatgtggggaggtgtcgaacttttctattaatgctgtgaactcatcatcctttgctcttgtcatcttttctggcttctgaaaaggccgtttggaaccagtgagccctcagatcgtaaacctgggaaactaagtgttgcggagtgaagtcagccatccttagtatggaatattttgacatttgattttcccgaaggtgagggaaggtttcatgggctgaaggacttggtgatttaatatagacctccttttcctagggcactgccatagagtttagaatttagagatatcaaggaaaagattatttcagatgattcccatatgcaattagggagagccagagcttgcagtaggaccccggagatcatgacttagtagtaaacaccaaacgggtttctcctgcatgggcgcctgatgcaataatttgccttagctacagagggtggaaccctatctcggaaataattcattggggcatagctgccgcaaattcagccactttgccatctgtcctcttcgctggtttgagcctgaccgattttaataaatagcctttcattttgaaatatcaccacgggcttaacttttttcttcatgattggtgtcagaacaccgattgcatattctgtctccctccacccaccttccactccacaaataaaattaggtgtggttcctttgtcttttcttaacttgccattttaaaaaatatccttccctttagaaggaagcatacaactaatttggagaaaaaaaaaaaccaccacacccaaacccctccctctgccacgttagcctggaactgcagtgaaaatcatccatcggtagttaagacaggatctagttaactaaagtaaactttgatcgcggcagctttccgatgctactaactactgtcttgtgtattgtttatgttgtcttgattattgttttgtactttaagatattttccgaatatacgagttagttgatttaagttagtttggatatttttttctaattttccaagaacacacatatatcagttagttaattgtgtgaattactgagtcctatgtcagctgaaaaataatttaaagatgatctaattttacccattttttgtatatggggaaatgagacacactgtcacccctatccattttggataactccattgtgaagtgcaattgaaaacctttccggagtgggatttttacttaatgactggtcttgttagtagcacatgtttcatagaaatttgttaatctggaaaatgaatgaagtgagtttgtcactttaagaaaacaacggttagtatttgtggccaataataaaattcaaactttggggaaattttagaatttgggaagactcgtatcttttgctgtgagcttggcagcttcacagtccttaaagatatctgtgatgagatgagtggtgatattaacaaacgtggatttttttttgatagtatttggataatctgcgtaactcagtgaaccagtgttttccaggtgaccaatgcatgatgttatgaaatcaggtattggtgaaagagccattcaaagcttaagatacattaatagatttattctgacagtacaaaaaattcattgctatagtttctgagttagaaataaccttgaagaagctaccacttgtcagagttttgaggtagtatcaaagaatatccacaattatccgaaacggcttttaaaattatttttccttttccacctacatatgtctttcttcatatactttacccagaacgtcatattacaaaagaagcagactttccacattggtcttttaggatttttcacagattaaggttaccaaaatagtaagtgccaaactcaaaatttaaaaacccatgaggaaacaagccaccttgagtgagacttaggggaaatgataatagaattagatcctccaaaagtattagaataatcacatatttttaaaatgcttaagataatttttaaaataaaagaagtactcaaaaacatgagcaaagaacaagagactaccaaaaacaatcacacagtgtgaaaatgaagcacatattgtatggaaatggatcactgaaattagaaactctgttgggtgcccaagggctatatcaatttaacaactttaattactcagctgaaagtttttcatcctatataggtaatattttgtttgtttactcagatgacctattccaccatattactataaatatggaattagtataagttgttggaagttaataaaataattcagaaatattagcaaggaaaaaattccaactgtaaagagaaaggcaaaggaagatgagccagcagtgactgagaagaatggtcagagaagtgggaggaaaactgaataatgtttttatttttttttgtaagcgagaggagagagatttaagaaggtggtcaatttattggttcttctgtgttctcagtacaaatcttgctctttcctactttttaatcaatgcttttgtctcctcctttttcacccctctatacccaaaggaaaaaattcaccatgtgagcagttatttgttaacttgcccgtgtgttcttctagattattaaatgaagagggcagagaccttgattcataatgatcactcacataataaacatttgaattgcatcattctttttttttttttttttttttttcattttgagacggagtctcactttgtcacccaggctggagtgtagtagcatgatcttagctcagtgcaacctccgccttccgggttcaagtgattctcctgcctcagcctcccaagtggctgggattacaggtgcccaccaccacggccggctaatttttgtattttcagtagcgatggtgtatcaccatgttggccaggatggtctgaaactcctgatctcagatggtgaggagggcctttcaaagtgctggtattacaggcgtgagccaccacgcttggcctgaattgcatcattcttacatagactttttaaaaggcacgcttaaaaacacattcctaacatttcttaacttctgaaaccaatcctgaatataaattctctttcttggctagggagatcttgtgcgaaaactcaaagaagataaagcaccccaagtagacgtagacaaagcagtggctgagctcaaagcccgcaagagggttctggaagcaaaggtgagtcctgggatgctaaaataggaacataagtaggtataggattgttcatctttaatttctttggatgggagagacctagaaaagtttctgaacaagtatcatttggtttatctgtttatccataatgccgccttctcctttccctctacctggtagactcctcatcctttcaaaatgcaactcaaaatgtcaactttttaataaagccttcctgaccctgcaaatgctggactcaatacgctatatgaatttccatggaaaggattgtgctcttctttacgacttctcttatgcctgaaaataatgatttttgtttgtttgtttgttttaaggaaaaggtctgtttatttgatacctgctcccagacctttcaaacaatagatctcccatcaccaaacttaagttgttttggggttttaaagtaaccattttgctatagcaatccactgacaattcaaatattgctttatattgcttatcagtatctacatcaaagtaaacttagtcttgttttttttttgagatggagtctcgccctgttgcccaggctggagtgcaatggtgcgatctcagctcactgcaacctctgcctcccgggttcaagtgattctcctgcctcagcctcccaagtagctgggattacaggtgcccaccaccaagcccagctaatttttgtatttttagtagagacagtgttttgccatgttggccaggctgggcttgaactcctgacctcaggtgatccacccacttcggcctcccaaagtactgggattacaggtgtgagccaccgcacctggtcaagcttagtcttgtaatcttggaaatgatcatatattttcctaaatgattaagtaaagatatcttttatattactcaaagggaaaaaaagacctatggcttctattgtttttaacctatcaaaatcttgtctgtttgataaattttatatttaattctggtgaggaataaactaaattcagatatataagttcagattcccacccacccctccactcactcactttttatttaatctctaacaggagctggcgttacagcccaaagatgatattgtagaccgagcaaaaatggaagataccctgaagaggaggtttttctatgatcaagcttttgctatttatggaggtaagggattaatgacaaaaagaactattgtgttgttagtggctctaatattatacttaaatcaagaacatggcttgcctgttggtatccacttgtatcaggccacaaagcagaggatggatgttttgcttttgtttgcttggagtcaccatttggtgtgatacctgttatttttctccactgcatttattcctggacagcactttttttgattaggatgtagggaattgttggaggcccatgtatgtatttgatgtgtctgtgtactcatgtactctttttaaaatgcaatggagactgaagagtaacagagggccattgtagtactggctaactatactatgccccttcacacaggggcagtgataaaacagtccttagattattctttatggtcatctgccaggagaaaacattcttcccagggatgtagataaatcactgtgaatgccatatgaaggtatataggcaaatacaattcactgatgaaatgtaaaactatatttttcatagtcaacggattattacaacaacattagacatatagtactttgccactgaaagttgacttgagtttggctaagtggatctgtaaatgtttacccttttgaggttaaatagtgcctcaaatacccaggaaaaaattagagaattggatgctaaaattatagatcattgttatcagatgtggtgagaaattattttgtaatttttacggcagaaaactgtaatctgctttttcattctgttctctaagggggaacttttgttgtagattttgggctagtcctacttgaaattacaaatatagaattagtaaatggcgtaagagcttttttattttacttccatcagctagctgaaagtaaggttcttcagtattgagggatttgcattgttgacttgaatacacttttagggagtataggtatcagtttctcatgtctccttgccttcatttgttcagagtaacaaggtaaagtatgtgttttcctctcatattctataggtgttagtggtctgtatgactttgggccagttggctgtgctttgaagaacaatattattcagacctggaggcagcactttatccaagaggaacagatcctggagatcgattgcaccatgctcacccctgagccagttttaaagtgagatcttactttggagtgggggtatcctactttaaataaaataacttattaaattatttaatatacttatctaaataacttcctgattataaagaactactcatttcatgtagaaaatctgaaaaatatggaaaagcaaagaaatgtataccttctgctcacagatagctatgttaagatgattgtgtttgtccttcctgttttttctgtacgtccctatgtatttcagtgttagcagtacactgcttattttcatgtaatattgatgaacatatactcatatcattaactattcatctaaagcatttttaatgatagcatagtattctgttttatggaagtgccataatatgttagtttgtgccatattgaaagcattaaagtgtttctcatttttgactgcaccgaatatcttgatagatggatttttgggtatatccttgattatttccttaatacaagttctgagcaaaggtatacttgtagagattttcagttaaatactatttgttttaaagtttcaatgcagaaacttagattattcctaccaacgttattgaaagtagggcagaatttcctttttttgtgtgtgtgagatggagtcttgctctgtcgcccaagctggaatgcagtggcttgatctcggctcactgcaagctctgcctcccaggttcacgccattctcctgcctcagcctcccaagtagctgggactacaggcacccaccaccacgtctggctaattttttttttgtatttttagtacagacggggtttcaccatgttagccagggtggtctcgatctcctgacctcgtgatccgcccgcctcggcctcccaaagtagggcagaatttcagaatgtgaaactgaaaggaattcttttatttatttatttattttttgagatggagtctcgctctgtcccccaggctggagtgcagtggggcgatctctgctcactgcaagctccgcctctcgggttcacgccattctcttgcctcagcctccagagcagctgggactacaggcacctgccaccgtgcctggctaatttttttgtatttttagtagagacggggtttcaccatggtctcgatctcctgacctcgtgatccgcctgcctcggcctcccaaagtgctgggattacaggcgtgagccactgcgcccggcctgaaagaggaattcttgccattttgtaactcgtcattattcatttaaggttgactggtggagagctaatttttactattggcatccgttaggttctcttaataatttcagccaatgaagaggaggaattctgaatgatggctctataagatcaggactacctatcattttagctacttgttccaccaataggaactttgtagagataataccaatgtcagtacaggtttcagtggcagaaaacacttcccttaaggttcaatgtctatactgagctgccatgaattcttaactagtcaaattcccagtgattttggcctttgcttagatcactaataataatggcataggcatggattaattgatcctgaagaatagtacagactttatgacaacttgtagaaaagaattgtctttttattgtctagttaatgtcttctttcttatgggaaggaagaatgtgggagagggtgagaaatagatttgaggaagaattttctctggcatccattactgtcatggatacatcattactatagatatgggagcttccatctttgagatggatataaatattgatggggaattatcttataaggtaatatctatgtgtaatttgtatgagaatgacaaattgggttggcatttgttaatttaggacctctggccatgtagacaaatttgctgacttcatggtgaaagacgtaaaaaatggagaatgttttcgtgctgaccatctattaaaaggtgaggttcttcatctccttcaggtaggattgatcaaaataaaaggtttaaactttctctcagatgtctttcattaaattttttattgaggcataacattcaaagagcaaagtgcacagatcttaagtatatagatcaagtcctttattttttaaaaaagttatatgtagataattagttatatacagataatttttctaattagcaaatgaatcaagacaataccatgactgctgttgtaaaatcaactgtgggattcatgtaaattaagaactttatgcttggatttactttttaattgtctagcattgaaactgaaaagtgcattgtcctttttcccattgattgatatatgtcaacactgttcttacagctcatttacagaaattgatgtctgataagaagtgttctgtcgaaaagaaatcagaaatggaaagtgttttggcccaggtgagtactctagagatgttatcagagtaacctaggtggtcgctgtccttctttcagtgtttaatgactgttgcatttcccattatgctgaccctggccacattgtaatgaagcagaggttaattctgtcctgtatagcgtctctttttttgcatttttattttcttctctcttttgtgactaaccctttatttcagcccaaactaacaagtccgtgttaataggcattcaatttgtctgaccttggaaactacttttctggatttaatagctaaaaccacaggagtgactgatgatgggtagtgttcagcactggtgtggagacttcggggcagataacttgatgagcactttctcactggctacttgatctgcctctgcttggaccctgatttcatgctattattcttagaacctcatgagcaggtcctgacttttctgtccttgcttttctcagtttgcctataggcctaaagttttataatttgtataatatttaagctgacaaattttagagaagacaaaaaagagaccacagagataatttattctgaccttttaccaattgcaggaatactttctatattagaagtagttcttatccttttgttgggtcacagaccaccctaagaatgtgatcaaaactgcacgtctccctgggaagatgcatgtgctcatgtatatatgttgctggtgtctcacctcatctgttggctattccgtttaggcaaagtacatttctccaacaccatgtttagtcatgaggtctactgaggctcacctcttaaattttatttacttccttgggcaaaaaacaaaaaaccaatactgtgattatacctattttctttacaccgatctctctctctctctctgcctgaatatagaactccctaatatgttgtttttcatgggaattactggatacttttccactgttgtcctaattttttttttagcatgctttttttctctgtgatagttaactttccaacatagctaaaataatttctccttcttcatttacattgaaaactttcttaatttggctgttgaatcatctgctgatttattttgatacttgtggagtgtaattttatcccttgcttgaagctcattgttttagtaattactcatggtttagaaaattatttcttacattttgatactgttgaagccacacgttcatctcattttcttatccaaaggcatgccctttattagaaaaaatggaaaatgcctctaagtatccctaaaattttccattcagaattttagatttactgaggttttgtgtatatgtttttgatcttaacagtattattcatttccaagtacgttgtcagagttgggaagtaactagttgatttgacaagtcaatttattgtttgagcattggccttctctcttatttcagatctgtgttctaggagagcaatttgttttttgacttgccatatcagatgcatgtacagctgtcaatataatcttcaatgaaaagtaagggacccatgggaaatggtgtagcactcagaaatggccctggtggattcactggctgaaagcccatctgttgcttaagcacagagtagcgttttctgcaccttagtgtctgactccttttcagctttatgaagcatcattgtttctttaaaaggccctgattcaccttctgtggtaggaagacctctactcctattatgtggatttaacagctcagaacgaattcttttgtttctcttctctgtctgtttttgtggcccatctctggatgttccagttttaaaaaccatttttaacttgtttatgaaaaattcaaaacatacaaaattttatatgttaaataaaaacataataaacaattatgtacctatcaccctgcttcactgttagatttttttgtatctattcccctctcactttcctgacttctttcccctaattctttgtgtgtggtagggtggggacagagccccactctgtagcccaggctggagtggaggggcacgaacatggctcactgcagccaggacctcctgagctcaagaatcctcctgtctgggcctcccaaagtgctaggattacacatgtgagccatggtgcccagcctgaatttttttgaagcagatctcaaacattattttattatacctgtaaatttttcattatctatctctaaaagagaaaaatcctttaaaaataaaggatttaaaaaatccttttcaatcctcttaccttgggaaatgttaataatttaatatcatcaaatatttgatcagtgttcatgttttctaggctgtcttaaatgtttccagtttttaaaatttgaattgggatccagataaagtctatactttgtgataggttgatatgtttcttatatctcttccaatctgtatggccttccttcattcccttttccctccccgcattttcattaaaatttttttcaagaagctgagtcatttgttccttactgttttctactgtctggatttggctaattacgttattgtagtgaggttacacatgttcatctttttctctattagatttagaagcttgaccaggtatttttggcgagacatttggttaagtggtgttatggacttctgtccagagctacatagtacctggttagctcttctgtgggctgtggccattgatgtccattgtttagatgcattaactgatgaggggatttcaaaatggtgatttttgtcattgttattcttttttttttttttttttagctagactatttctatatgaaaaaactttctatcaactatttgatttaactgagacacgatttgtaaagaaaggtgagaataagtgcttcatccattctcccaccccttgtctttttaaacctgttttccattagttggttccctaacatccttcagaaatgcacgagttcctgcctgccttttcgttttttcctcctactgttgtgaactttagattcaaatatttgatattcagtcagttgcagttatcttattggtggttaaattgtccagtctttggtgactaggagttctctgctgagtccttttgacacagcccttgtagtctctgaaaacttcctttaatatgacaagatattgccatctcatcttatacatttcctgtcccagacttggaatcagacatttctccaaggagccctggtacttggtacttattagtggggatggtattgatcactaattataaaccttgtcagtgatctgagctaggaagttgatattttttaaaagataaacttttcatgagttaatatagatacttaatagttaacttaaagttaggtttatagggtttttactatattaatcttaaatctctctcctttacccttaccaaaaatcgcagttctcagcaacaaaacataatgattgatgtgccttatctcccactgtatacgttaacagtctcagaatgacaataccaacaccaccatcagcaatatgaatgttgaaaacagttaaaaacacttttattgttcttttctttagggatatgccagcactgtgtagtcttacagtctgataactgtatttaaagtcacttggagtcattctctctgtgtggttatgccatcagctagatatgcagttagtccatatatttcattttattttcagtattcagggtttcctttttaaaaatttgttttataatcatatagcacaatagcaaagacttggaaccaacccaaatgtccatcaatgatagactggattaagaaaatgtggcacatatataccatggaatactatgcattcataaaaaaggatgagttcatgtcctttgtagggacatggatgaagctggaaacaattattctcagcaaactctgacaaggacagaaaaccaaacactgcatgttctcactcataggtgggaattgaacaatgagaacacatggacacagggtggggaacatcatacacctgggcctgtcggggggtgggaggctgggggagggatagcattaggagaaatacctaatgtaaatgacgagttgatgggtgcagcaaaccaacatggcacatgtatacttatgtatcaaacctgcatgttgtgcacatgtacactagaacttaaagtataataaaaaagttaaaatttgttttataatcatataaagcattttttatacctctaaaggcaaatctaaaaaacaaggtatatttagtctactatctttctcttccctttaccttccgtccttctgcttccctgcttcctgagcagtttttaacttaaaacaacttccttttttaaaaaaatagaatataaacaaagacatatagatatttgtatgccctcctttctagataaatggttgcattccatacacacttttctccattgtggttttcttcacataacaaaatatttcagagattggtccctcatagtatatagagattgcctccttccattttatagctacataattgggcattgtgtggatatattttacataaccagttgtccactgctggacatttaggttatttcccatctttaacattacagataatgctgcattgaataatcttgtgcttatatcttttcatgtttttgctattgtgtctttgggatagatgcctagaaatgggacaaaggataaatacaaatatagtaatgttagatattgccagattccctttcccaggggttttgctttctatctgtattggcagaatctttttcctcctgatttctttttaaattatgccttttattggaaaacactatatattcttgaattacctgggaaatagatgttcctcaggctctttaactttctactctagtaggaccagcttatatttatggtacccgtgtcttgaagttcactggaacagtttcctcattgatccagcctcttgggtaattgtataatgttattttgtggattcctcctagaaattctgtagaaatagagtctagaaggcttaatattttaaattgcacattcaaatctggaacatgttgttagtgtgagtgggttgcctttttatggagtggaaataccattggatttatgagggtagcaaatataattgctctttattgagtagttattatgtaccaggtcctgcctgtgctaaatactttacatgttttgtttaatcttcatcatattcctgcatagcaaggtagaagctgttctcccctgttcttagagaggttaggtaagaacttaatctttagtcacacaacccataagtggtgtagagttgggagatacgccaaggtctttctgaactcgaagcttcagttattatggccattaattgatttactgaattattttgtttctgttaggaaacttttaagttttaaatactgcttactattagatggtttgtcatagtcacttgaaattcttaaattggagggcatacatcattttacaggatttggcactgatgatcaatgtatagaatgtgcaatacactggaaaatgctgaggtgaataagatacagcttctgtcttctaggcgcttaatatctaatgggaaaggaaagttcaatgcacatttaattactccattgaggagagggtggtggctattaatagtatatttgcttgactggatctttaaaatacagagaaatgcagaaatgcaccttaaatatgttcagagtagtaaaattcagctttgaaaacttatttaggtaatttcagattcttgccaaccaataactattataattgaataagaggtattttgctttatctttcactttgaaacagtgactatatgagttttaggtcccagaaggatatttttttctctcttgataaatggaaagtgaataaattggttatggttttaatgtgggtgtcctgaaggttaggttaattgtgatgttcctgaattttgtgtgattgtagcagtggatggctagggttatatataatactttatatcttatgccttgttttctctgtcttttacactaatttctttatatgtcttttagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtatgtatcacttattgtttacctgtttatgtaatgaagtttttaaaattgcttatattaaaaggtaaatatcaatgttatgaaggaaaaatttttaaaaagtgatatacagaagtacagatgaatgtattatggagaaataatggcagaaataaatcttttaaaaaattctttctgaatataatttcttttttggcatatatgtatttttttggcataaaataaagtctctgatcactatatcttctagttatagctgcatagggtagaagggacagttgaagaatggttttaaaagccgttgaacttattgctgaaggatattttagaaaccatttagtttagcatgctactgtccaacggaactttctgcagtgatggaaatgttctgtaatgtgtgttgtccagtatgattagctaccagccacatttggctcttgagcactcataatgggtccagttcttctgaggcactgaattttaaaatttatttcatcttaattgaaatttaaatagacatctgcctggtgtcctaccatattggacagcataggtatagcctgttgatttgaaagatgtggttttcatggataaagaatatctggttagtttacagtatgattcagaattggaatctttatcttctgattccttgtccactgtttaacagacttagccagtgttccatttcatagctttagatatttttctatgatagggtaagagagtaagtttttcctacatgagctagatagatcgtgtttcccagagtagggactgaagaataagaaaaattaattgtgacaaaatgtgttgcagttaattattctaatgagacatcaggttgatttggaatatttcatggaaagaggccagtggcaagcctttcattttggccatatgtacagagtcataaaatgagacataacctgtgacccagacattccatttctgggaattgatctaaggaaataattcagaaggaaaggaaattatacttagaagaagtatataaattgaaagtagaaataacctattcagtaatttgagagtggttaaacaaattatggtaaagtggattagtttgggataatattctgtcactattaaatgtgagaaatttgtgccattatttagaaaatgggaagtataaaataggtaatacatgattttatacatactaactgtaaatatatgtataaactttacttacatttggatgaaatctggaaagggccataaaaatcaaaagagttggtctgttaagtaagaagagggtacaattttagggtttttagcccttggttttaaagttattttagtaaaatacttattctgaagtaggccattgggagcgtttccttagtggatgttttgcacagaatatcttctaggaaattgagagggcagtggttatagtagtgtatttgcttgactatatctttaaaatacagagaaatgcggaagcctctggttgaaaatataaaatactgcagataataaaatgatttgaaaaacattgaaaattacctggcttggtgaggtgatagtgataagtgagtgctgatgttaaatgtgagcctatactgatttctttttagcccctcagttaagttttaatatgtgggttaacagggctaaacataggcatgggtattattttccaaaggacctaagattgtcatctgcctccatgtacatgatgacttagaagacatcaggggtttaaggggcactatgggagaggtggtgttttttgtttgtttgttttgagatggagtttcgctcttgttgcccaggctggagtgcaatggcgtgatctcggctcactgcaacctctgcctcccaggttcaagcgattctcttgcctcagcctcctgagtagctgggattacaggcatgtgccaccacgcctggctaattttgtgtttttagtagagacagggtttctccatgttggtcaggctgatctcgaactcccaacctcaggtgatccgcccacttcagcctcccaaagtgctgggattacaggtgtgagcgactgcgcgcggcctgaggtggtgtttttaaatttatttttatttctgctttttgagaagtggggttttgactcactggtgtaattaaatgaaatggcattgccaaagtagtactgccacactaattacttaatacattttctaatacgtgctatgaaaatgtttgctaccgaggaaaatatttctaaaacttcattttagggcctgttcaactttgttgtgaaaatggtatatttaggacttttaggatttgtatctagaatttcaggattgttggaaaacataatttctttctttgtaacagactgacttacttaaatttataggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcaggtactgctcaggttactcttacaaattagtgaatgaccttggcattgcattgaaaatgaaagcttgctgttttgaagcaattctgcttcataatcctgattatgaatttatttttgttttctccaaaaatcatgttttacatttggaatctctaaatgtaatctccaggatgacaggcagttttgagtgacaaaagtgaacttgaagggaaaggaaggagggtggagactgtcttaagagtctcacctgctccaaaattacctttttccttgttcatcgtatattttgaggatggtaatatcttgattgtctaaaccaaggcaatactggcaatggtgatgtgtataaaagggtggggtcgggtgggggtagggtgaaagttgtggcaggaggattgttctagatatctagggcagacaacattgctgaagttggggtgaggatgtatcagtaaccaactggagttctggaaacaacctccgtccaggtatttggggggcctatatgacagaaaggccagcaagcaagcttaccctcatcactcacttggcctctattcaaatagcctacttttgtctgatctatccagggatgtgtgggaaggcatattggggctggtgagttctatatttctttagaaatttattatgactcagctgtttatgacttaagttttttgtgatttctatacgttattcctggtatcatctcttagagtaatacattccatataaaatacgaggtgtagctaaacataactttctaaggccccaaagtgttttcccagccccagcgcccacccatttcctgtcttctcttcttactcactgtaattacagacttgggtcataacatagcccagtcactgactctggatcaaagcatccacagcacctgcctcatcttgttagttcccatgatgccatctgggagaagatgcctatgttctgcgcaaactgtatctctaggccctacaggtttacggtttaggaaggagggacttacagaggaaagaatgtgcccaacttagagaaagttgggggaatgacccctctgagctttcatgtaaaaagaggaggtcatcagaaactttagccaggtatgatggcaatgacaaatttgtcagatttgagtctttgttttatttcccagtgtctgagtgtttttgtttttttgtttttcaccgtttcaatatctagcaagtatgccttcccaaactgaggaagctgcgtaaggctgaccttgtctgaagccagtgttacgaagagggtttacacagagtagctatgggaagattattgagaaggactgagaagtaaggcagtgtctggggcctgtgcagtaaaaaagtggtgagtagggaaaccagcttggaacttgggagtgatcccaggggttaactggtagaaaggctctggggcttctcaacagtggattctttggtcattttcacttcaaagtgtcatgtctgaattctggctagttttgttatgtcccttgcaagttcctgaccagaagtccactagttttttcatgagtcagcatcctcctggcttttgttccatggtaggactaggattggtttatttagtgttctgattcttcttgatggcagagttctctggtgattaatctttgcatagctgtatttccttttgtccttttgttagtttagaggtattagattgttcatatgaagatttttctaaaattttattttattttgattgacttatctgtcttcctagcctgtgtgtattttagttctctacagtttcaggtacagttgctgaactgagatacagttactcagaattctgatgattcctgcctcctatctatgagctgagattattgatgagtaaattttgtatgatttgtatgatttcaagtcacacagtgtggtgctttgatatgcttatacattgtgaaatgattaccacagtcaagctaattaacataattatcacctcacatagttactttttttttttttagtggtgagatctacttaacatctactctttgagcggatttcaggtatacagtgaatcattaactatagacacagtgctgagatttgtgacagaacagatggaaagactttggcagcagcattttggagattctaggcagggcccgtaatttatcctgtcccacattgtagatgttcagttgctgtcagcccaattataagctatgtgaggacaaacaccatgtttgtttctctcacatttatatgggcacagaagatgtttcctagttgttgaaagacaactaaaacataggtgcagcaggaccaaataagagacactattaaaaaataaaatttaaaaattaaacctcttggccgggcgcagtggctcacgcctgtaatcccagcactttgggaggcagaggcgggcggatcatgaggttcaggagattgaggccatcctggctaacacagtgaaaccctgcctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgagcgagactccgtctcaaaaaaaaaaaaaaaaaaattaaacctcttttgcagtgtatttcatgtatttttaggatccatttaagcaattttacattactcgtaaaacatctgagataatcatggaagcacaccagaaaatgtgatttttcttgaaagaagagagattgattttgactcataaaattaacttgaaacacttctcccgcaaatagctactaaattgcattcagagaaatctctttgggaaaccattactatgtgcacttcatcgttaggtaattagcttgatgttagcttgttcaattcatgccttatatcctttgccttgaataacactttatttaagaagctcttgctccaaagaaaccaactgtatgatgccattatcagtcatttacttttttgtagcagtaaaaaagaagaaatcaaactgctatgaaagctaaagaaccatttcatttcgcttttaatttcccattctttgaaatgggatgaagaaacttcatttagtgtatacttataaagacttgctaatgctttaaggaaaaccattttatctgcatgtcactattcaatatcttatttcttatttttcatgtgatttttgcgtatgttttcctaatttaaaaaactatattaatctgcctttaacaagttattttcagttaaaagtaataatctttttggatgtagctggagggaaggaattaatacttcagagaagttagatcatgtttattttaaatagtgagtaataaaattttcattaatgtgtttaaaaataaccttcacatgtaccccataaatttgtacaaatataatacatcaaaaaaataaaaataacaactacccagacaaatttaattcaaaatttttttggccattcccttaggaaaccaactttctgtttagtgaaaaagaccactatagtatggagcctttatcactagaatgcagttgaaaatagaggccttgttttttgtttgtttgttttttgtagttaaatatgcaggtttatcgcttacgtttttgctttcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacaggtaggattctggaggtaacttaacttagattgtgcctgttcagggtttgcagcaattagcaaattctatgtgttctgggtgacaagatattttattttggcagtcatttgcttttttacagtacttggttttgtacagaatttgttatacagtattattatagtaagagaaaaatcacctgaacatctcaatttgtgggccttggggctagcatgaaaaaaaatgtttagcagagcacttggaaaatagatcttggtttgcattgtgcctcaccaatctgactcaacagtatgtactactttgggggagacagcattggacccacagaaagcaagccatctgggtttcagactcttctgtattacccatagcagtggaataaggccttgcatataagcactttgtaaatatttgcctggagaagtgagtgcgtgaaaacttgccaacagtagctgctgtccactagtggaatgagttgcctcagggagcagtgagcttcctggccctgaaaatactcctggcaaggttggacgatagcttgtcagccactttgcagagaagacctctgcagtgtatggagatggggctagatgttttctaaggtccttgcaaacactaaaatgattacgtgtactctacggggttcacaaatttcagtgggtaaggatacattaaaatcccctcaacgtgtcattactttggttaattcagaggggaatgtctttgccattctttagtgtcaattatgaatattgtttttagtactgtagatttagaggtatgaggtactgggctgaatttttgctgacccagtaagtatgttggacagattttgaataactccattatcatcatcttgacattaacccattaaaaaataaccaagatctcattctgagtatttgaaattgttttgaaagcaagataaaatagtttgtgttgggtgtcaaatatttttcagtagagtgagtcaatggaaaccgatatcttggctttgaagagtattaatgtgtgttttcttttcttcctccatgcttgcttattggttggtttagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacgtaagtggagtgctgtttaccatgtgattttcacattgttaacttagaagcacaggtaccaaatgaatttttgtgcactttatgtcacagaggaacaaagggaaaagaaaagagatcttttcctgagcaaaacagaaaaagcagttgcctcctgcctttttataagtgtcctaaggagctcgttgtagtcttagatagctgagagacagagttagtgtatgatgggacagtgcggatgtgtacactgctgtacagtgtattggcagcattactggcaatatcctggagtggatctaagacacattggcctctccttcctggcaagagtcccagcaaacattggaaatggtggagaggttgaataaagaaagtcatagtgctcttagctcaatgagctatgtagtagctttggggaatatactagttgattctgatctctggcttaagaactaccttcctcaaatgttatgtatttaactcaaaattcacagacgatctccaggtaccctcctgcccctgtgccctgtcacccctccagcctccaccaccaaacatgaacatcagtattgaagcggagggacgaaaggcatttgcatataggagatgctgtctatattggtggcaggaggaaatgtggcatctaaaacaaggctgagagtcttttggcatttctcttattgggtgttagagaggcttcctcgcctacatagaaagagactttagtccaggggtcactggttccagtatacccttggttcagtttttacttttcagaatggctttctttttatggatttttaaaaattaaaaatcaaaattagtcatattttaaaaagtaatgactactttttttaaaacaaaaaggaaaaaataattctgaagactattatgtagaaaattaaacttccagttatatgcctctccccaggtgttttatgtctcttctctgtattgagcaaacattttctataaaggaccagatggtaaatatttttagctttatgagtctctgtcacataactttgttgttttttacagcttgtaaaaaacagcttttaaaaaatgtccaaactggctgggtgtggtggctcatgcttgtaatcctagcactttgggaggccgaggtgggaagattgcttgagctcagaaatttgagaccagcctgggcaacatagcaagaccctgtctctacaaaaaatacaaaaattagccaggtgtgatagcacgcccctgtagtttcagctacttgggaggctgaggtgggaagatcacatgagcccgggaggttgaggctgtagtgagccatgattgcaccactgaactcaagcctgggtgacagagtgaggccctgtctcaaacaaacagacgaaaaaagatcatgcttagctccatggtcttgggtatgtctgccttctctagatgatttttctacgtgttctaacacatgcatgcataaatgcataataatatgcatatgtttataaatggctattaatgatgttgtttttaatatattctttttcccttgtggaattagaaagaattactgtaatctgttaggattttcttagcaagcttgcttgacatatgtcaaaatgataatagtaattatttttaggattatgggtgatcattaatttctttacactttttagattttctgggacttctttttattttcagatcaaaccaataaaatgtttttccttttgtatgagaaaagattattacttttctttttgtttcatacccagctccttctcttagtttgctctgattctgatttcagattaaaccagatgttgttcttgctgtctcagttaagtaatttgcttaagtctcacagccagtgagtggtgaggctgggatataaacctggctgtctgacaccagactcatgctcttaacagttatgctgtactgctttataaaccccactggatgcctgctcgtccttatctaagtgccattgtgagggttagggatcagaaaatggaaagtcactggaaaacagggctaaatgaaacaagaagctccagagtcccagaggctcttaaggagaggggagaactcccttagagagtttaatactttttgtgtactttatatatttttttaataaaaaaatttaccgttgcagttaatgccacaccaattctctttccatccagagaagtaaccactatcccaatgttgttattctcaggcacgtttttgtaattttacctttcagtacataaatgttagttgacatctgcagtaaattataaccaccaaactatatggttaagaacataagtatacttaaccagtcgacatgtatagggaatgtcagattgccaggttacatgtttttaggctttgttctttaattccttttgttgttgttttgtgttggagtttctgagctcatatgagttttatatttgcttgctttattacagacaccccatgtgataacatgtgcttggaaagcttagtagttttttctttttttctttttttttttttttttttgagacagagtcttactctgtcacccaggctggagtgcagtggtgcactctcagctcactgcagcctctgcctcctgggttcaagcgattctcctgcctcggcctcccaaatagctgggattacagatacatggcactgcacccagctaatttttgtattttcatgaagacaggatttctccgtgttagccaggctggtcttgaacttctgacctcaggtgatccacccgccttagcctcccaaagtgctgggattagagacacgaaccactgtgtctggccaagcttagtagttttgatggttgaatttccccaaactctttggatcaagggcaaaaaaaaaaaatgaatcttcttgagaaggactaactaggtatctaccaaaataagctctttacaaactcttgttcttattgaaataacgggttcttaagagtttgtcatagttggggtttctataagaaagcaccacatacagagtggcttataaacaatggacattgatttctcaccgttctggaggctggaattgagagatcagggtgccagcatcgtctgatccttgtgagggccccattctcagtcgcatactgccaacttcttgttgtatcctcacatggtgaaagagggcaagagagctctctggggtcccaaattccagtgattagggctccatcctcatgacctaatcacctcccaaaggcacctcctcctaataccatcacattgggagttaggatttcaatatacgaattttgtcaaggacacaagcattcaattcattgcaggttctttgaaaataatttaaattttgctttttaaaagtatcttatgtgtgtatttataagaaagggaacctggcatcaatgtgatcataatgctcttatataattttattgtgtgacctgaactttacccactcttatactgagttttcttttgttcagtgaagaaagtgaattgaatccaaatgcccacatttatggccagctgaagtatgtgtttagtcagccatctgatatcaagttgtgagaacactaggtacttcatctaaagaatagtggtttctgccaaattcattttgatttctgttcacaaatttgaaccaaatttacaggctttgtctaggttcacatttaatttccataattaaattccagaatatgttagtttaccccacagactcagtataacaatataaatccatccagaaaggaagactactttgtgtacagtgtgaattatatatttttttctttctttttttttttttttttaagatagggtctcactgtgttgcccagattggtctcaaactcctggcctcaagtgatccttccacctcagcgtcccaagtacctgggattacaggcatgagccatcacacccagatcagtgtgaattatattttataggcttattagctgcctgatatatgaggctattcccatttcaaatatttatgaaatttgaatgaagattatatcatcgaattatcattgaatatatgaaaggtttataatctgcatgcatttgtgaatgaacccaatataagtaataataagtaagtaatgtttttattgattatatctttttagggttggattgagattgttggatgtgctgatcgttcctgttatgacctctcctgtcatgcacgagccaccaaagtcccacttgtagctgagaaacctctgaaagaacccatatcctttctggtcactccaaaaactcaggattcacatgtgaacatcttgctaatgaataagtccaagtctttaccttgttctatggataaatggagatgttttagacactgtagtaacgcttgtttaaacctattattttacctatccctttgttcctttcctattctctgtacttgtagtctgacgtgtgcccactcaatgtttggcctttaaaagaagcatatttagaaaaatgctctgaatatctttcagaacgttaatagtttttctcagctgtttccaaaacgcacttcacacctgcacctacctacgtgctctttaaataaagggtacctggtgaaagctttttccattaaaagatgagtgccatttgatagtagctgaaataataatttagctcacttggtctgaaaatcagcaaaatagaaattttctttctttagtaggcagtgaagttatgagctgatttcttaggggtaggtcagtgacaggaaatagatcttgttttgagcattttagaaatacttatcagaagttcttatgctatgggttgggtcattgctgattagataatatctcttttttctcactgtaactggaaaagtttctattgatggtgttaattttggatgagagttgtctgaatgattttgtggacaggtgtttcatcttgccttaaaatcagcataaacaggatctggagtactgatagagagctggcatggttttaagttgatgattgattgttctcaggctcattttctgaaatactgaggcagtgctgtagttttggattccttgactacttcatacaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaagggtaagatatcagatgtttactcttccatgggctccagtcagttgtgtcatctgccaggttctgaaaggatgagattaatttcttaagattttttgcaggtaagtactgtatcttggctgcatttaaaagactgtctttgccgagattttggcattatagcctgaaaaaagatttgaaatagaatatactttttttttttcctagtaactgtcttaaacaaagagacttgtccagccaggctgaggaaggaagggttagaaactacatctactatctctcaggtcacttctctctcctttttggaggtttagaatactctctgtaattgtttaagcatgaatataaacaatagagaaggccgggcacagtggctcatggctgtaatcccagcactttgggaggctgaggtgggcagatcacgaggtcaggagatcgagaccatcctggctaacacagtgaaaccccgtctctactaaaaatacaaaaaaattgtccgggcatggtggcgggcgcctgtagtcccagctactcaggaggctgaggcaggagaatggcgtgaacctgggaggcggagcttgcagtgagccaccatcgtgccactgcactccagcctgggcaacagagtgagactccgtctcaaaaaaaaaaaaacaaaaaaaaaaaatagagaaaagcctttaaagaaatacaacaaaatccagcactgaacagtgtaaaacttacaatatccagcaaacaataaaaattattatatatatgaaaaagcaggaaaatgagaagtaaagtcagtcaaaagaaacacccagaaaaaacaaacatgatgcagtaagtacataaggatgttaaagcacttattataaatatgcttcatgtactcaagggtgtaaaggaaaacattaacatgtgaggtgagaaatggaaaaatatatgtgtaatatggatataaacacatgttttttatatatataaacaacatgaaacatttagaggcaatatctcaaatgaaaatgtcactggatgggattaacagtagattaaacattacagaagaaaggtcattgaacttaaagacatagcaactatccaaaatgaagcatagaaaaaaatgagactgggaaaaagatgtccagtgggacaatatcaggcagtctaatgcatgtgtaattgagagtcctagagagggtgtatagaaaaaatattatacagtagctagaaaatttacaaatttgatgaaaacgctaaaactacagattcaagaagcttagccccaagcaggataaacacgaagatgaccacatgaagacccgtgagaatcaaatagctaaaaaccagggatgaagagaagaacctttaaagcagctagtggggaaaaagactcatcacataaaagcaaacaaagataagaatgattagaattcatatcaaaaactgcgcggatcacaatataatggaatgaaatcttttaaagtgctttaagacaaaattcctacacccagcaaaaatatctttcaaaaatgaagaggaagtactttaagaccaagcttgttcaacctgcggcctgcaggctgcatgtggcccaggatggcttttgatgctgcccaacacaaattcgtaaactttcaaaaaacattatgaggtttttttgcattttttttttcttagctcatcagctgtggttagtgttagtgtattttatgtgcagtccgagacagttctttctagtgtggcccagggaagccaaaagattgaacacctctgttttagacaatccggggctctgagagtgcattgccagcagacctccactatgagaattgttaaaggcacttcttcaggcagaagtatgaaagtttagatgtacccagaggacttgagagatctagaaatgataaatatgtgggtaaatagaaatggcattttctctgtcatctcttaatttctttaaaagataatggagtatttaaagtaatatggaatttataacatggaagtaaaatgtatgctatcagtagcacaaagggtgggagcaaagaattgggaatatactcttgtgaggtgtatacattatatgtgaaatggtgtaatattacttgaagataaactatgataagttaaaaaatggatagaatgaactctagagcaatcacctggaaaaaaaacacacacaaaaaaggggtgtaactaataaaccaatagtggagataaagtagaataagaaaaaatattccacaagaagatgggagaaaaggaaaaggaacaaagaacagatgggacaaagatgaactcttgcaagttgaagatacctgtttcagaaaaatttaaaaacatttctcgtcttccagaattaacatctatttatactaaaacaatatcaaatcccattaaaatggactaagttatattactagttaaatatcattatccataaacacagtttgctttattaattattctcaaataatggctgtctccttgtcaattacaactcttttttttttgagatggagtctcactctgtcacctaggctggagtgcagtggcgtgatctcagctcactgcaacctctgcttcccaggttcaagcaattctcctgcctcagcctcccgagtagctgggactacaggtgtgcaccaccacgcctagctaattttttgtatttttagtagagacggggtttcaccttgttgaccaggctggtcttgaactcctgacctcaggtgatccacctaccttgacctcccaaagtgctgggattacaggtgtgagccacctcgcctgacccaattgcaactcttttatagctgttaactatgatacacttagactgtgctcacagagagaatgcatgtgacactgtgtatgtaatggaaccttgaatgcatgcacacacagacttcagacagaatagtaaaaacggaagaattcagtgaacaccagtcagatgaggcatgagattatcacaggtggaaactagcaaaatacagttataacatatgccaactatccagcttctgagacaaccacatgagggctctctatcctagcactgaattgcttgggagggaggagaaatccaaatggatattcaaaatgtgaggaaatacctcctaagctgaaatacaggtattacatgaagctctttataaagatgaattcttataacctgaaactgaatgggcatatctcaggacacaaatacatggcagccagtgattttgagggggataatattttatattgccatatgaaacagaaacattaaacttcttttaaactgatcttcatcaacacaaatgtccaaatttattttgaaaatagtgtgggtattggattgtaaaattacttctgtaagatggcatgctggttcatttgtacatttgttgggacagtaatgagaacccttgtgtttttaccagcaggcctatttctgacaaagttgttattattctaaaactgaattttcaaaaagttgtttttggttttaccttgattcaaaaccaaaggaatttgtcattaagtcacttgtggagttttataaaactagtcaaaatttggtgtatgtcctcagagtactttttggtgccattgttagactaatgcttaatttggtgtttcttatgaaataatttaaatttgacatcacttattatatctggagagttgatcaagttataaaaagaaaaaacaacttagcaatctacaaaattcctttaaattaaggcacagggtgcctgtttgaactaatacaaaatgtgttttgtttcttcgtagggaattcacaattgaaactgaagggaaaacatttcagttaacaaaagacatgatcaatgtgaagagattccagaaaacactatatggtaaatttgtaaaaataataaacaaaaagtcactgctccttaaagcttttgttgttgtttgagacagggtcttgctctgtcacccaggctggagtgcagtggcacaacctctgcctccccggctcaagcgttcctccctcctgtctcagcctccgaattagctgggactacaggtgcaggctaccatatccaactaatttttgtattttttgtagagatgaggtttttgccatgttgcccaggctgatcttgaactcctaggctcaagcagtccacctgccttcgcgtcccaaagtgctgagattacaggcatgagtgaccacgcctggccctcattccctgtcttctttggcaaaataacttgttaaaaagtcatttaggggccgggcgtggtggcttacgcctgtaatcccagcactttgggaggccaaggcgggtagatcacgaggtcaggagttcaagatcaacctggccaacatggtgaaaccccgtctctactaaaaatacaaaaattagctaggcatggagacacgcacgtgtaatcccagctactcgggaggctgaggcaggagaatcccttgaacccgggaggtggaggttggagtgagccgagatcacgccattgcactccagcctgggcgacagtgcaagactccgtctcaaaaaaaaaaaaaaaagtaatttagaccagtgatgttgcatgcttttttaaaagttaagaagatgtttttttgtagaacaaattctgtgaattaggcaatgagtaatttggagcacgtatgaaggatgctgaagtttatttgtggctgaattgaaattcctggaaacggagtagtaatgggtgtttgagaagctactgccagtggaaagagtgagcatacctttccttttgttcttggcttgtcttgtagccaggcttcagtgagcagtgttaggagtaagcgggggcttctccatcacactctggggcttttccgtcacagtctggggctttatagccatgatcctggcagctggttcagagctgcacatcaccattactcagataccacagaaggatgggaggaaaatgccttgatcatgtttctaaagtattaactctttatcatagacaaacaggctctcttttcccatatgtgtgtgagttttggtaccaatgatctcatttcccaaaaaacataaactcttccaaagttatgaccagttatcttagacctggacattgcttagcagtgcttcttcctttccacataataagtaataattatcagtatatttcctgtgtataccacgggtgttgtcttacccacatgaagagctgtgagcccctgtaagatgtctttgatggagtgctgttctttgagcaaactctcccctaagggcgtcctgaccccagaaccttggtgatacaatgccagtaatttggttctgaacaagttcttatcaagataacaagctaaaaagttaaacaaatacaaaccatgtaatactttttgcatgtaggaattgtttttgtgaattttgccagctgtgttagattttaaattctagcaaaatcttattaaaagccttagattttttatgctttctgggtagccgaggcaggtaatagagataaagtgtagctgctgctattcgtagtttgctgactggtgaaggaatattctagtacctcaggtttcatttttacacagtataaacagaatttggtgaaaggttttttcactccagctttctcttcaaaggcatgtttcctatcagcaaatagtttttaggtatgttctagtttctttgttctgatatacagagataaaaatccatctagaatagagatatttttagtgctaagaatttttttcttttcttttctttttttttttttgagatgaagtctcgcccttgccttccaggctggagtgcaatggcacgatcttggttcactgcaacctccgcctcctgggttcaagcaattctcctgcctcagcctccggagtagctgggattacacgcacctgccaccatacccagttaatttttgtatttttagtagagacggggtttcaccatgttggtcaggctggtctcgaactcctgacctcagatgatccacctacctcagcctcccaaaatgctgggattacaggtgtgagccaccgcagctggtgaattgtttagagagaatctgaaatgcattatgtggtatttgagagaatgttattgaatttctatctctttttcagtggaagaagttgttccgaatgtaattgaaccttccttcggcctgggtaggatcatgtatacggtatttgaacatacattccatgtacgagaaggagatgaacagagaacagtaagttgttgtgtacagtgtgctgttatagtgtcagaaaataaaaattttctgaattacattgtgaagtacattaataagactctagaatggtcaattagttattactataatctagtgctattaacactcatctttgcttaagtatgtatagacaaaccagtttcctgtgttatcttatttgagctttaggttattctagaagctattgttttagttgcctggtgctctctattcttagactgaacctattactttggggaacaatctatattatgtcaatggaaggaatggtactttctggatatgctgtgtttcagaaaattgggaaggatgagataactcctagaatttagccagaccactaagctgtatctgtactctggtaaagtatcaaagggaaccctctcaaactgcatgaaattgtctggggtacttttggggtaaagatgtgaattcctaggttctactctggagatgctgattcactaggtctgagacccagggatctggggtttttttaaaaaaaataagaatcctgagtgatttcactgtgaaagcttgacagatcataaatgggataatagttgtctggggtatagcctttcctagcattcaagtattgctgaagatagaagtttataagaagtcttcatcagctcccacaaattttcttttcggtctgatgcttctgaatcactgctccttgccttcttcctctttatctccttgccttacttcaccatttttacctcacctctgcctgcagaagttacactcctgggcagattactaggaaagccaaccagaagaatggctagaaaggagaggttgtatatgtcaggttaattgaaagaaacagcgtcatccacttggccattctaaagcttgagtgtacgtaatgttagacatcaaccgtgtggttctttctaggacatttaacctcaaagaatgaactagtgagttctcggcaccagtactttagtctgacacactattgtaatacatagctaataaagttagtatggtactctctgccctaaagttgcatcttcatttcccaaccttgaaggagcagccctattcattcaacagattgtaagaacctgggctaggccccaggtgcgcaaacataaggcttggttctttttgagaaatgatgacaaacataactgcatgtgttctttttagatgtcaagtctgcttcaagctttgtctgcttatttttctaataaaaaggttttagaaaatcttttagctgttcctttgaatctaacaatattaatataactagagctttaatagaaatttcgtaagggctaaacaagaataaattagtcacagtgttttatgaattgcatgaattcccatcatgaagagaaatttgattaggctgtgggaagccaaaaatgtttctaaattattagcacctagttcctcaatccatttgcctataaatttggtataaaaacattgctagtgaaattttaaaaattatttttctataaaggcaggtccctgttactctcttatattaaatagaaatatcacaagatggaggaagggaatagaattctgaaccttctgtgatgtgagcagccatattggtggaatacaggccttacttagagtgggatattcattgcttggcaataaaggttaattgaactttgggtgagaggctaaactggaacctgtgtcattcattatttttatgggacaaatttattctgtgtttttgccttcaagtgaaccttttgtacaagtattaagaactgccttcagttcccatttccaacctaaagtggttgattggtttgccttccacagaatatttttattttcgcctttttttttttttttttttggtctcgctttgttgctcagctggagtgcagtggcacaatctcagctgactacagcctcaaacttctgggctcaagcaatcctcctgcttcagcctcccaagtagctgggaccacaggtgcgcctcacaatgcccagctaattttttagtttttgtagagatggggtcttgccatgttgccctggctggtcttgaattcctggggtcaagcaattcttctgcctcagcctcccaaagtgctgggattacaggcatgagccactgtgtccagccttatttttgctttctttgatttctgagttactcagaaactatttcagggcagtttaagaaggctgtactttttagtgtaggtatatggaacatctttttttgttttgtactatttcttttggacatatgtttgtgagctaattaaacttttctgtttcacttggtcactgaggttcataggtttttctcttaaaagacagaatgggctttggtttgggtcactgccacttgtttgaatatttaggtagtctccacagaaagtcttttatgtggaaccaaaaaattaccgtcttttatatacagtagctttcagaatgctttcacatcatttgacttttttagtaacgggcttgtgaagcaagcagagcaggtggtagagacctgctttttaggtggagaaactaaggttcagaaagagttcatgacttggcctaaattcggagctgaaaccaggtgtttctgatgctggttctgcttctcttttgccatactgcttttcatgtcatgttttctggcattttggtaatgacgttatgcttgaacacttgctgaatattaacctcttttggtttgggatattagcatttagatatttacaaattaacatatttggatttttttctttttaaatcatccagttcttcagtttccctgctgtagttgctccattcaaatgttccgtcctcccactgagccaaaaccaggagttcatgccatttgtcaaggaattatgtaagcaaattcaattgggtaaactccatgggaacaccatcaaggagactgaattttaggaaatgtatcatttatttcaataaaaatatagactgaataaagaatataaatgattttataaagagtacatgattttagcctgtactcttatttctaagcgagaggatatgcttgctcagatgttttattctggcatttgagtgaggcaaggtaggacccaagagtcagatttaaaaattatttacttctcatactgaccttggtgccaagttcatcgagggaacctgagtggagtgtagcaaccataatggatctacagccacagaatccacagccctgaaaggaatcctggtggtcatctggcacatccacttatttcagagctgggaaatggggagagtccattgacctgcttagagccataaaaatagaggtggtggagtcaggactcaccttctggccttggctcttggtcccatatttgttccccctatagctgtatcagatggaggtatgagtgaagatttggattcccgcaagggatttattaaactttagggatatttctttctcttgcaactcaacttgttgctttcttgtcttggtcccatttataagtctcctgagcttgtaagacagtagttagataacactgggcttaactccattgttttatttttaatttactttgtttattttggatagcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagaggtatctggccttctctttggcatttttagccttagaaatgtgtactgcttcttactgatttgtgttggattttgatgtgtttatgctccctttcctttttttttctttttaattttaatgaacggcttgtatcagacagagcccagattctcaagtcccccggtttaattatgaaaatatccattagcacttctctaatattttataaacatttgtgttgctccaggcttattctccagcagtttgcttttatacttgtttgtttattgggcaagagaaatatgatcctaagaatttgttgccatagttttattggtaggctttggagggttagacattttaatgttttatttttacagacgcgtatacatgtgtatgtataagcttttccgtgttcatatattcaaaacagtgaatcatgtttcagtagttttggtcaataggaaggcagtaatggagatggtagaagcacagaaggagaaggatgagtggtaagggaaaggaaagagtagctgctttaattgacatctgcctgcctaatttatcacctttgagcacatacatcaagtgcctgttctgtgcttagcttgatacagaagtaatagggaaaacagaagcaaaagactgcttttttttctgaaggagtttatagtctaatccagaagtcgtgaatttctagcttgactttttagagaccatctggctactctggagctgtgtccccatctgggtgtggttctcaaaagtgtggtccctagaccagcagcatcagtatcccctggaaatgtatgagataagcaaaacctccaccccagacctactgcatcataaactgggggtggagaggcagagggggcaggcagaactttcttagttttagcaagacctccagatgattctgacgtgcactcaagtttgagaaccattgctgtgtggcagccagtgtttggttttggctgaggaacagtagccttggtcagagctctccagtttgccagtcttatgtaattccctcacacgagttacttgactgagtcctgtttgttctaatagttaaatttaatacacatgaagtaacttcaagggacatggagatttagaaaagttaggaaaggctttgtggcagaattgagttgtctgggggaactggtgggcgttttgggctagaagagcatgaacccatgcctggcatgacattgtttggctctgtgtaaggtttcctgagttcaggatgaatcttcttcttaaaaatctgaacaagttggttgatacttggcttctctttccttgtctctagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaaactactcttatgtccactttacaaaagaaaacagcattgtgattactcccagggaccgtattttatcttcagtggctgcctgattttacccccacaattaaagttgaaggaatcctga

SEQ ID NO: 37035 - DNA, 17550 bp, Homo sapiens
accgagctccgtcgtctcgtttccggcggtcgcgcgctcttttctcgggacgggagaggccgtgtagcgtcgccgttactccgaggagataccagtcggtagagggtgagttttgggacgtcttggttcttgtttgggagggtagtgggatttcttggaacaatcagcgaaggaagaggctagggcgaagctaggtttggagggtggatggcgcttccgaggccccttgaggccttgtctctgccgccacactgccttctcagcccacccgcggggggccacctttctcaactcgcttcgcttcgggctttccccattttcgttcctgccctgtttctttgtgcaactcatctccgaatcttacccgtgtcagtaagttgccggcctctgagccgccctgggcccgacggtgtggggtctattatgagagatcgctgaagtcgtggttggttagaggaggaggcgctttgtcgggcgctcctcctctcggccccgcgaggccattaattcagaatgggcaagtggggcccctcaagcgatatttctttgtcaaaactcttagctggaaagttcctctgcatatccagagcccgccgctttcgtagtcagatttctgtatgccctttttctaaagtcctaaccgcctagctccttgacgcatttatatagcatcactttttaaaatgaaacttaaatttatggatttcgcatcgagtattttattttccagtttgagaaactcttaccataacctgacacgtttctttgtgtttttaacagagaagtcgaggttagagggaactgggaggcactttgctgtctgcaatcgaagttgaggtaggtgtaaggaagggatagggttgccagacaaaacaccgggcacccagttgaattagaatttcacctacacaaccaattatttttaagtatatgttgcatagttttcaattaaatttcaaatttaattgtgggttgtgtattttatttgctaaatctggcaactctagtgggggggccctggttatatttatactgtgtccttgtccaccttccttgttattaaatgaaaagtcctaagaaactcttagagaaggaccttagttcattttacagctttcaggctggccatccaggcagccatctcagtcttgtaaatttataccagatttagatttcagatatgtgtgatgtagtgtttggtcctctacctaaacatttgtttaactgtagcatgcccagtggttagagtctttctcaaccagcaatacgtgttttctctcaaaattcttcatcaggattattagtctcagggacacaagtagacagtaatctttgctgctgatcttcgtgctgtgttctcttttcagaggcccagtatttaggcgacagtgaatttattactctgaagagggttctgcacatatttccaaattatattggtggtcatcagaagtaggtgataggaagaaatacttctcaaggtacttgctacttggtgggcactgttataggtgctttattatgatagtcttcactagtgcattccatcctgggcctctccggggccaggggaagagagatgtttaacacctggaacccaagtaggaaaagatttgattctgatgcccaccttgccccatccccaactatttccagggtggactttagattttgtatgttttaacttcctgcttttatatcttattttttaaaacactattttctttttttgttgtttttttttaaaggtatctcatttgccatgaaactgctacacctgctcatggcgtttaaaatccttacaactttttgagaaaacgacgttgcactatgtggcaagagtcacaggatagattctatttttaagaatttatcctatggaaataattaaatggaaataaagctgaaagccagaagacatttactgcagcgttataataggaaaagccaaaaacaaccacctaaatgtcttatagtagggagtagtttagtaaagtagtacatcctggtgaactttatatagtcattaaaaattacaattatgttgacattagcagaaatgaggaaactctgaatatacaagggtgcattatcagttactgaaatgataatgtatgtctaaataagcaagaatggaaaattgtgggaggaatatttaatcatggatatgtccaaagatttagctatgagcattgattataatggtgaaaaattagaaacgacccaggtgtccaacacaatagggacttggttgacaactgaatgctgtgtccgttaacgtaaaagatttaatgacatgaaagctgtttatgatacatcataaagtggaaaaaacaggttacaaaatagtatttatcatatctcatttcaaatacataaattaatgactagaaggatataccaacatgttaacagtgactatttttagtggcaggtctatggatttttatatttgtatttttatttattttggtttttctaaattttctataatacattttgtaataagtatctgattgtaatttctgtttaaaaatttttaaataaaattttaagttgtaatttctgataccttataacattaatgagaaacaaaattgattaaatgatataaatgtgaaaatttaaatcttggctgaaatgtcagatgttgtgaggtttaccatctgcctccttctccctatccactttgccttcctcccccatttttatttattttcccatagcacttacctcttaagtactatataatttacttatatatattgtctctcactagaagcaagttctgtaggcaagaatctgctttgttcactaatccactgtaaccatctagaatagtgcctagcaaatggtaggcattcactgaatattttttgaatgaaatcgtgaattgaaaaattatcagtaacctaaaagcaatgcagttgttttcatttttgcctaccttctgttcccttgtctatattcacatctttaaaattagaaaaaacctttccccgttagaatatcagacatactcgtgtttatgtggtcttcataatttttaaggctgtgaacattctgttgtatagatgtaccgtactttcatgaaaaccattcccctaattttggaaatttaagtcatttttattgttttcttaccataaaggccattacaatgaacactttcacgggtgtagtttttaattttaaaattattaggataaatttccaggagtagaatttccaaattaaagactatgaattaacatcttgatagctcttgttactttttttcttactaaacttttggatacagaatttggtaattgcattaatgttttcagttttggtgggatgtgacattaaacagattaggaatgtttttatacacttgaaagtattcccgtatactcatcatcaaaatcaatagttaccaagcctttgtcgcatttctttcatctgagaaatataattttctgtgtttataattattttttgagacagactctcactttgttgcccaggctggagtgcagcggcactgtcttggcctactgcaacctccgcctctcaggttcaagtgatgctcctgcctcagcctcctgagtagctgggattacagatgcccaccaccatgcccagctaatttttgtgttttcggtagagacgggttttcaccatgttggtcaggctggtcttgaactcctgacctcaagcaatccaccctcctcggcctcccaaagtgctgggattaccagtgtgagccaccacgcctggcctattcatttatttttgagaccaagtctcactctgccgcctaggctggagtgcaatggcagcatctctgctcactgcaatctcgtcctccttggttcaagcaattctcctgcctcagcctcccaagtagctgggactacaggtgcaagctaccacacccggctaatttttttgtatttttagtagagacagggtttcaccatgttggccaggctggtctcgaactcctgacctcaggtgatctggcctgccttagtcccccaaagtgctgggattacaggcatgaaccactgcacccagcctatttttttctctattttttttgagacagggtctcattctgttgcctaggctggagtgcagtgttatgatttgcctcactgtaacctcctcttcgtgggttcaagtgattctccagcctcagcctcccaagtagctgggactacaggcatgagccactgcacctggcctcccctcccccctacccttttttttttttttttttttaaataaagaccgagtcttgctatgttgcccaggctggtctcaaactcctggggtcaagccatcttcctgcctcagcctcccaaagtgctgagattacaggcctgagccaccatgctggcttcatttttttttttttttttttatttcaacgtttgggagcacagagcacttgttttctttttaatcttatgttgatttttaaatgatagaatttaacattttattatttttatctttttttttttttttttttttcttgagacagggtctcattctccctgcccaggctggaatacaatggcgtgatcacagctcactgcagcctcagcctctcaagtagctgggactacatgagtgtgctatcatgcctgtctaatttttttaatacatattttttgtagaggtggggctcactatgttgcccaggctggtctctaactactgggcccaagcagtcctcctgcctagacctcccagattgctgggattacagatgtgagccactgtgcccagcctatttatcttttcttttttttttgagatggagtttcactcttgtgcaatggcacaatctcggctcacggcaacctccgcctcccaggttcaagtgattctcctggctcagcctcctgagtaactgggattacaggcatgtgccaccacaccccgctaatttttgtatttttagtagagatggggtttcaccatgttggtcaggctgttcttgcactcctgacctcagctaatccactggcctcagcctcctgaagtgctgggattacaggcatgagccatctcgcctggcctatctttttatgtttgcttttattgctttagtagtcatttgtctttccactgtaattaataaatatttagagtgtgtactgtatgccagtagtgagccagcattttcacatgtttattctcatagccactttgagagacaggtatttttatcatcccctttagaacagctgaagaaacaggtacagagtaatttactagtaagtagtacacaattgaggaacacaattcaaacctaaggatgcctaacctcacagcccatactagtaccactgttatttccacggtatgtactgtgggctaggattggtaggtaccagagaagataagactttactagtctttgtccttgtgataaccagaatctatttcgatcattttgtttttaaaatatgcttaaatgtgtgatggggcgagtttttaagagtagattttttggaaaagtagttttctattaatgtgtagtattgaactgggaagttccttaagcgattctagtgcaaacagttctcatccagtactcatttagtttttatgtgcagtataactgctgatgcctcgttgtttttaattttattattttttaaattttttaaaattttttattttattttattttcgagacagagtctagctctgttgcccaggctagagtgcagtggcgcaatctcggctcactgccagctccgcctcctgagttcacgccattctcttgcctcagcctcccgaatagccaggactacaggcgcctgccaccacgcccggctaattttttgtatttttagtagagacggggtttcaccatgttaggcaggatggtcttgatctcctgacctcgtgatctgcctgcctcagcctcccaaagtgctgggattacaggtgtgagccactgtgcctggccagatttttatttttattttttatttttttgagatagagtctttcttggttgcccaggctggagtgcagtggcacagtcatggcttattacagcctctaactcgtgggctcaagtgaacctccagctccagcctcctgagtagctgggactacggcaccactatgcctgggtagtgtttttttgttttgttttgttttttggagacggagtctcactctgtcaccaggctggagtacagtggcacgatctcagctcactgcaacctccacctcccaggttcaagccattcccctgtctcagcctcccaagtagctgggattacaggcgcccgctaccattcctgggtagttgtatttttagtatagatgtggtttcaccatgttggccaggcttgtctcgaacccctgacctggtgatccacccaccttggcctcccaaagtgctaggattacagtcttgagccacacgcccaacctgcctgggtcatttttaaatgttgttgtagagatgggggtctcacggtgttgtctaggctggtcttgaactcctgggctcaagtgatcctcccacctcagcctcccgagtacctagaaccacaggcgtgcgccaccacacccagctaatttttgtatttttttggtagaggtgaggtttcaccatgttgcccaggctggtctcaaactcctggactccagcagtcctcccacctccgcctcccaaagtgttgggattacaggcgtgagccactgcacccagcctttttatttattttttctttatttttttccttttttgtttgatttttactatattttgtaacctccagaacgcaagattttttttaacatagtttccatatgcagcactgatagatttttgaattgttcttctttgtcatggttgttcaaagtaacaaattgtttgcctctgacaaaagccagagcacttaaggtgatgaattacatataagtcatcaggaaggtggctgattgtgttattagtactgaatttatttattagtctactttttctttgtagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaagtgtgtatatgctaggtgatggagtagaaatggattccctctgggaatggtttcttggtttttagattagtttctcgggcttataagggaataggcctttatggcacacctttgttcttttttctctttacctcttaatacttacgatggaaaaggctgattctccggaaccaaggagcaaacatgtatgacagcagttgagtacaggttgctctgctgtgttgacacattctactgttaaacagatgtctgcatgttttacctcagcttggttcttagaggtagtcatcagatgactggtagttaaaaataatatagaaaagtctttaaggcttaaatggagaagtctggtactgaatactgtacttttagccttgagcctgtaccagctcattgtaaaaagtctttaagtatatgttcctgtttgagtaccaattgtgtgcctctaagactagaaccaatcccaactttgtttatttccagagattactataaagagttgctctttcctaactcatttcattctgttgcccccagcctgaaagaatgggaactgttaaggttatgaaaattggtgagagattaggaaaatggaacagttactttgttttttgtttttttttttgtttgtttattctcatctgaaggtacgttttgaatgttaaaatctgatgccttgtaacatagggctgcttccttgaattgcttaatttttctctttggccggtaacgcctatatttttctttctcttgcttagtccagcttggcttctggcccgtcgtagagctgttcagatgtcctctgcatactgctttcacattctaaggcacaatttactcataagtggttaggttgccttgggaaatggtgtttacattctctacaacaattaatgtttcctcatttatcagtggttataggtctttgaggatacgactataattctatttccccagtcttttaagtgactgtgtgtcttctctcagatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggtgagcaactgttggcttttgaggcatgtgctctaaaggtggggaagctggagaataatagatgtgcaaaaataggcagtggaaataattctcagatgatgtgttccttgaaagcttgatgaaacagaaccacaaaaatggcacattttaatttttcctcataagttttgtttcaaggataacaagttttttgcctaggatactggagctaaagtatgccctttggaactttttttttttttgagacggagtatcactcttgtggcccaggctggcgtgcagtggcatggtctcggctcactgcaacctccacctcccgggttcaagtgattctcctgcctcagcctcctgagtagctgggattacaggtgtctgtcaccacacccggctaatttttgtatttttggtagagacggggtttcactgttttggccaggctggtctcgagctcctgacctcaggagatccacccaccttggcctcccaaagtattggggttacagatgtgagccactgcacctggctggaacttttttgttttaattaggaaatttcaaacatatagaagtagacagaataataatgaacctgcacatatgcattgcatagcttcagtaattatcaagttgtggttaattttgttttatctgtaccctttccctattttgtccccccatgatcaagagatgggtatctcaccatgttgccttggctagacttgaattcctgagcttaagcaattctctgtcctcagcctcctgagtagctgggacaaaggcaacgcaccacggtgcctggtttatttgtatctttaaaaaactattttaaattgaattaaccaggcatggtatacgtctgtagtctaactactcaactaggctaagctgatagggctgattgagcctaggagtttgaggttacagtgagctatgctcatagcactgcacttcagcctgggtgatagagtgagacccagtctcttaaaaaaaaactaatgatggtaaaacatacataacataaaatttactatcttaaccgtttgtaagtgtagacattattttaaaatctggttcgatttagggaaagtatatgagaggaaaacatttctagacattatctacctccataaatggaagagaataatgtgacagcaggatcactggatggggtggtcagaactgattttcattccaatctgccaagtcatttttctctgggtatcaggtttctctttagtaatatgaaagggatcctgtcaaggttcctggttccaaagaggcttcttggaggatattcgtgattctggtacatacctagcaaaaattagactgagcatggtggctcatgcctgtaatcccagcactttttgggaggccaaggtgggcggatcacttgaggtcaggagtttgagaccagcctggccaacatggttaaaccccgtctctattaaaactacaaaaattagctggacatggtggtaagcgcctgtaatcccacctgctcaggaggctgaggcaggagaatcgcctgaacctgggaagcagaggttgcagtgagctgagattgctccactgcactccagtctgggcaacacagcaagactccgtctcgaaaaaaaaaactaaaatattctaggtggttttagggtggtctttgagtttttgttttcgtttttttgagacggagttttgctttgttgcccatgctggagtgcggtggcgtgatcttggctcactgcaacctccgcctcccgggttcaggcagttctcctgcctcagcctctggagtagctggaactaccagtgcgtgccactgcgcctggctaattttttgtattttagtagagaccaggtttcaccctgttggccaggatgatctcgatctcctgacctcgttatccacccgcctcggcctcccaaaattctgggattacaggcgtgagccaccgtacccggccaatggtctttgttttctggatgatctgttgtcattgggagaataatacctatgaaattgatgatcacctaagtgttattgacttctagaactacatgtgatttattgcaaggccatcagaagcaaactagggtggccaaagagctgaagcacacagttaagttctttcacttctgtttctttgtatggttgtttagtttttccggggagatattgaactatactgctttagactgttgatggctgctaaggtgttctttgtcaaactgagttattctgattttcctctgcttcctaggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacgtaagtgagggtcattttcagacgtagaccttagattgctaattccttccatggtctggagagttagcctctagtaaccacttttctatgtttaaagacttttggtcagcctggcatggtggctgactcctgtaatcccagcactttgggaggccggggcaggcggatcacctgaggtcaggagttggagaccagcctgaccaacatggtgaaaccctgtctctactaaaaatacaaaaaattagccaaacatggtggcgtgtgcctgtattcccagctacttgggaggctgaggcaggagaatcgcttgaacccaggaggcagaggttgcagcgagctgagatcacgccactgcactccagcctgggcaacagagtgaaactgcctcaaaaaaataaataaaagactgggcaaaacagcggctcacgcctgtaatcccagcaatttgggaggccgaggcgggcagatcatgagttgaggagatcaagaccatcctggccaacatgctgaaagcccgtctctactaaaaatacaaataaataaaataaaaataccaaaattagcgcacatgtagtcccagcaacttgggaggctgaggcaggagaatcacttgaacctggaaggcagaggttgcagtgagccgagattgtgccattgcactccagcctggcgatagagcaagactctgtctcaaaaaaaaaaaaaaaaaaaagacttttggcccaggcgggacagatcaccaggtcaggagatcgagaccatcctggctaacacggtgaaaccccgtctctactaaaaaatacaacaaattagccgggtgtggtggcgggcgcctgttgtcccagctactctggaggctgaggcaggagaatggcgtgaacctgggaggtggagcttgcagtgagccgagattgcgccactgcactccagcctgggcaagagaacaagactccgtctccaaaaaaaaagacttttggtattagcctgggcatggtggctcatgcctgtaataccaacacttcaggaggctgaggcgggtgaatcacgaggtcctgagtttgagaccagcctggccaaggtggtgaaaccccgtctctactaaaaatacaaaaagtagctggacgcggtggtgggcgcctgtgatcccagctactcgggaggctgaggcaggagaatcacttgaacccgggaggcagaggttgcagtgagccgacattgcaccactgcactctagcctgggcgacagaggaagactccgtttccaaaaaaaaagacttttggtactaagctttctcgtatgatttttctgtaatcttatattaatagacgtgggatgacgattatgaaaaataactttttagtcattcggtaggttgtcatgtagtcagtgttaagtctctctttactttgaagatttagagttctgaaaagttgatttgtgcctgcagtatctcttagtgtttaccacaagtcatttctcagagtgtctgtagatgtttaggctgtacttaagtactgcacctacctacttggaatatctttttgagactgtattcagagatctaagtcctgatttcgtcctgtcaaccccagattttcttttttctttttcttttctttttttttttttttttgagacagtctcactctgtagcccgggctagagtggtgcagtggcacaatctcggctcatttcaacctctgtctcccgggtccaagtgattctcctgcctcagcctcccaagtagctgggattacagacgtccgtagagtcagggtttcaccatgttggccaggcttgtcttgaactcctgacctcatgattcacccgcctcgtcctcccaaagtgctgggattacaggcgtgagccaccacccccagcccaaccccaaattttttataatgtcattaggtataaaaacttcagaagcctccaatcctgagccctagctaattcattgtgccagtgacatgtgtagagaagaagcctggtggggtatgatttgattaacactgaactttgttctttcttccagatttcctcgtcctgtgactgtggagcccatggaccagttagatgatgaagagggacttccagagaagctggttataaaaaaccagcaatttcacaagtatgcagtcttgatagatttccctattaggtgtttccttcttaagaaagcttataaagggatatgtaaaagaggcaggtctttgctgcacatgttcactggcagccattatcttggtcctcacaaggaatgcaattcttagctggggtaattctggacaaagttagtaacctaggaaccttgcctatagggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacagggtgagtctaggcctgtaagtcttaaagctgaaaggacaaaatgacatttttaaatgggtttctttgtatcaattaacagaagggcctacatctctgcttttatacttagtttgcgttgattttggtagataaataggcttggagatgtggcagagatactggattctgtggagaaggaaatgataggtataacttcattttggaatctggacaccacaggtggttccaaaggaattagatcctctttgctttctggatctttatttgaagaaagtcattagatctatatgaagacaatgaggaatattcttagtctgttgtttttttagatttgatgaggcgccaagaagaacttcggaggatggaagagctgcacaaccaagaggtgcaaaaacgaaagcaactggagctcaggtaacttttctcgaacactttttccctaacaactctaaaaggtaatgtctcactcctctttcctactgccatgctacctcgtgtatttataaatgtgttggcaaatatttcctggctgcttctcaggttctttctttggattggagatgttttagctgcccatggtcctagaagttacctgctaaaaagaaagcagctgaatgctggtctcatgaggtttctttgggggttgcctcagggctgggcacacttaacagtgagtttcctggtgaactgatagttttcagtaggccagtctccttggttgagtctcctgttaatctgctcaagttctgaaatgcctctgtcttaaatacattggtgactctctgtaggcaggaggaagagcgcaggcgccgtgaagaagagatgcggcggcagcaagaagaaatgatgcggcgacagcaggaaggattcaagggaaccttccctgatgcggtatatctcccatgtgcccgtgatgtaccagaccagtcctgataaactcaccatgaattgtctgctaggttaccggttatgaccaattttcccgtgttgtgaaataaccctttagaaaaaagaattcataagaaggagaggtaaggtttgaagaggagatcttgcctcacaagcaatataggatgaaaaactgggtctgctgtattctgtttagactcagtgactataggaagagatatgcaaccttggctagtcctctgctgtccttgcaattgtacaagttggagcttcagaagcaatctcttccccctttcacctctctgttgctaataggaggctctggcttacgtcctagtagctctgtgaccttgaatttgttgcacaactagcaagggttgtgctcctcagctttctcagtgctgtttggacgtgttatcactctatctacttcccttagtgtgtggtccttgatggattgtggtagaatgcactgctgtcttggactgtcttgagtattttttgtttttcagagagagcaggagattcggatgggtcagatggctatgggaggtaaggacttaggaggttaatggctctgatttccttttttgtttggtcttgggtgaactatgtagcttctgctgcctactttaagggggtgacatatatgtcttacttagcccagaggtcttgttgaattgtttcctttggcatagaaagagactaacaatctttatcccttgtgctgatcacactactctgccttaggtgctatgggcataaacaacagaggtgccatgccccctgctcctgtgccagctggtaccccagctcctccaggacctgccactatgatgccggatggaactttgggattggtaataaaactgcagtgccttaacagtaattctaaatggtggtaggaggagaacaggcattgctttcacagcccctgggggcctacctcagtttgctatagatagcagtctttttttttttggagacagagtttccctcttgttgcccaggctagagtgcaatggcatggtcttggctcactgcaacctccacctcccgggttcaagcgagtctcctgcctcagcctcccgagtagctgggactacaggtgcttgccaccatgcccggctaatttttgtatttttagtagagatggggttacaccatgttggccaggctggtctcgaactcctgacctcaggtgatccaccagcctcggcctcccaattttgtatttttattagagactgagtttgaccacgttggtcaggctgttcttgaactcctgacctcagataatctgcccgcctcggtttcccaaagtgctgggattactggcgtgagccaccaagcccggcccagatagcaatctttaggactgctggtatccattaaatgtaacctcaaggtctttatttttgaatcttgagcaaactcagtctctatacttaatctaggagttaagtaaatgccaccgtctgactggccagtctgattgactatgtttgttggagggaagtcaatgaaggctaggcattatcacataaaatagttgtgaatccaaatacttcatggctcatgcaatcctggggttgttttggttatggtgttaaaatgccaaaactggatagtttggttgtttctgtttttgtttttctttttttctttttctttttgagacagagttttgctcttgtcgcccaggctggagtgcagtggtgcaatcttggctccctgcaacctccgcctcccaggttcaagcgattctcctgcctcagcctcctgagtagctgggattacaggcatgcgccaccacttttggggttatccactagagttctaaacagacttagtcacccactcctacctaccatcaggagccttgaatagttgaatggaaatagcctccagtggagggactacagatgggtgggaagcttccaacaatggctctgttacagtgttgctctctttttctctttaagaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagcctttt

SEQ ID NO: 37036 - DNA, 31287 bp, Homo sapiens
gggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctgggtgagtgcgcggcgccggccggggacgcggctcgggcggggcggggggcgtctgcggcggccagagtcgccgcgggctctgggtcgcgctgcgagatgcctagacgaggaaggtggcccgggcgccgtcggagggcggagacgcgcgcctcgcagggccccgggctgcaggcggcttccgctgcgccgcacactcgccctacgcccgggctcggccgcgtgggcctctggtcctccgtgcgcctcaggccggctcttccccacgcggatcgccggccgcgcagctgcatggtggcgcgggggatgggctcgcgactcgccaagtaccctctagggtgatgccgggaaggccaccattactgctgttctacagaacgcggccctcttaaccctctccaccacctggctgtgtgggcgccgccgggagtgttcccccttccagatggggaaacggaggctccgagttagtcagctacccaaagttacacacagggagatctgatttgagccccagcagtccgactctagagaccctgtttttaattcctcttgcaggagactcgggggcccggccttctccccacctcagactacgctcccctacccctgtctcctgccacccctgggttgggtccgagtttggagcagggggctgctgagacgccaggcagcggcggggctgattgggggaagaggggaggagggcggtggcacgtgggtgcagaaccctgggatccattgtgaaaaggaggtctaagatttgacctggggcgggaggaggcggagggcaaggagactgagaaggctgagcgccggaaggacggagttccagggccctagcgccgggagtgacgtcctggggcagggccagccaccaggtgctgtatctcccaggcaggagctggcgtgcctaggccccaagatccttccctggccagcccttttggcccagaaggtggacacccaaggagcctcctctgtagcggagacagggataattaatgagggccaccgtgcatgcagctggaggtgtccagtggggtgggtgagggggtcagtcagtgaattacttcagagcctgcttcccgctctgtaaagcggggacagtaatggcacttaaccacgctgggtggtttcaaggactccagtgctctacttggaggctgctttgaggccacagtgccagcagtgctccgggctcatgacagggttgtgagggctgcgtgatggatgatttctcgggaccttcccaaacaagctctgtttcagacagacaagattctggcttctggccaatttcattcaggatatattattaagaagtaaatctgttcacctttctgggtggatacgcattcaccctttgtgcctctaagacaccctgttctcagaagggattagatgtctttcaaagcccttcccccacccactgccttgcacactttggacctgttagctctcctgggtttgtgtcagtcttaccacttatgtggggtatcccctgcctgggcagggacctggcttactctcagctcccctttcaccagcctggcacacggtagctctgcaggccttgtattgcttatttggtactgttggacctgctacctttggccgtttcagggggtctgaggtctagctggagagaggcagcaattacccaactaagtagtattgcacatctgagcatctttcagggctagataaaacatgcagatgtttacagggttcctgagctgccaagtaggtatctggtatgacacagcatcatcgtttgttgcatcctgagaataaccctgtgagatagattgtgttgtattcacattttatagacgggaacactgaggctagtgtgttaagttacttgcccaggctgggaattggtggccattccgtactgtctggttggggctcatgctgtcaggaatgcttcttggcagggcatggtggttcatgcctgtaatcacagcactttgggaggccaaggtgggaggattgcttgagcccaggagttccagaccaacctgggcaacacagtgagaccccatagcttaaaaaaaaaattttttttttgagatggagtcttgctctatcgcccaggctagagtgcagcagcacaatcttggctcactgcaacctctgcctcccaggttcaactgattctcctgccctagcctcctgagtagctgggactacaggcatccgccaccgcaccggctaatttttgtatttttagtagagatggggtttcaccatcttggccaggctggtctcttgacctcaggtgatccacccacctcggcctcccgaagtgctgggattacgagtgtgaaccactgcccccggccaaacattttttttaattggctaggtgtggtgatgtgtacctgtagtcccagctacatgggaggctgaggcagaggatcacttgagcccaggaagttgaggctgtagtgagccttgaacatgccacacactgcagcatgggtgacagagtgagactgtgtctcaaaagaaagaaagagagagagagagaaagaaagaaaggccaagaaaagaaaaatagttgggcatggtgttacatgtatgccagcactttgggaggccaaggcagaaggttcgcttgaggccaggagttcaagaccagcctgggtaacattagcaagaccctgtctccaaaaataaataatgtttcggccaggcgcagtgactcatccctttaatcccagcactttgggaggtgtaggcgagtggatcacctgaaggtcaggagatcgagaccagcttggccaacatggtgaaaccctgtccctactaaaaatacaaaaaattagctggacgtggtggcgggcgcctgtaatcccagctactcaggaggctgaggcaggagaatcacttgaacccgggaggcagaagttgcggtgagctgagattgcaccattgcactctggcctgggcaacaaaattgaaacttcttctcaaaaaaaaaaaagaatgcctcttgggcaagcagtctgtgccaggctggagaatggtgaaaaaggtgaaagggaaggccaggtacagccgcggtggatattagtcagtctgaaaggcacttggagagaaataagatttacaaatgtagggtgctccaaaagagtggaatgtcaagtgtgtctcctagttctttgttaggcaaagtctgatttcctcaccgccgttacccctccggaaacatactgtggtgtccgagagttacaccatgtttacattgtaatgtcttggagagggaagctcactgaactcaaaaaatatccatttgcaaaagaaaaaaaggatatgtaaaatacagtgactgtgtgtgtgtatgtatatgtttaaaatatgcaaaaaaggagggaaaacttatttttcagaaggaaataacgttgctatgcaacccatattttgaaagttgtgagccaagagtatgtgtgtgtttgcacccaaaagctaatcaaggaagacttgagacacaggtagtcttctgtttcttgtccccagatgtttatcttgaggcccactgttccctctctgcaatgaggcatagagtgaaggctcagtccggaagccctggcccaatctgggctgtagtcacagctaaagtgacagtttgtcagaatgtccccttttctgggggagctcacaggactttgatccagttctttttcttttgagatggagtttcactcttgttgcccaggctggagtgcaatggtgcgatcttggctcaccacaaactccgcctcccaggttcaagcaattctcctgcctcagcctcccaagtagctgggattacaggcatgcaccaccacgcccggctaattttgtatttttaccccgtagagacggggtttctccatgttgaggttggtcttgaactcctgacctcaggtgatccgcccgcctcggcctcccaaagtgctgggattataggcgtgagccaccgctcctggccccttttccttttttctttttttttaagacagggtcttgctgtgtcacccaccaggtctggagtacagaggcacagtcatggctccctgcagtcttgaactcctaggctatagcaatcctgcctcaccctcctgggtagctgggaccacagacatgtgctaccatgtctagctttggtccaatcttttgctggccacttactgagacaggatttgtacattctgtgaggacccaggctcgtttctcgatagctttcccattcctatgccattgctgacccgtgtgcagtgaacctcaccaggcccaggaagcagggacactggcctctgtcaggagttgggcctggaggtgaagggacagacctcacagaaggctctttgttgaggcagcgcccacagtggctagagcttctctggggtcatctccttccatgggctgaaggaattatggcaagggtccagctcatcctggctttaaaaaaacaaaaccccagtggccttgtcagaagtggcctggatgctgaggctggtggcaaagatttctcagttctcaccagggccagactgtggtgttatccaaacagtgcaagtgtcatctgaggactccatcacagtcaggcctgattcaaaagggaaggtggtctgtgctttcaacaagtccccccagggtttctgacccacagctttggggaggttaatgcctggccagtcctggctggtggacacaggagatgagtccaaccctggctctgttcctagtggctgtgcctttgtcagaaaggcccttccggccaggtgcggtggctcatgcctgtattcacagcactttgggaggccagggtgggaggattgcttgagcctgggagttcaggaccaaactgggcaacatagtgagacctcatctctacaaaaaaaagaaagagctgtgcatgtgcctgtagtcccagctacttgggaggctgaggtgtgaggatcacttgagcccaggagttcaaggctgcagtgagttatgatcatggctctgcactccagcctgggcaacagtgaaaccctggctcttaaaaaaacaaaacaaaacaaaaaaaccttcctatctcaggttctcagttgcccaggctagaatgctgtggcgtgatctctgctcactgcagcctccgcctcctgggctcaaatgatgccctcatctcagcctcacaagtagctgggaccacaggcatgagccactatgccttggctaatttttgtattttttgtagagttgaggttttgtcattttgcccaggctggtctcaaactcctgggcttaagcgatccacctgcctcagcttccctagagtactgggattacaggccattttctccatcttgaaaggagaggttcatggataggtggtttcaaactgggtgcctcaggagtagggctggggatggagtgagtgggctccggggtcccaccgcccgctgttgctgattttacatcctggtgctctttgtgcccttaaagtggctggggttgtatcccagtttacccagctctgacatccaggtgctttggctgaaggcttgagggcctcctggggtctctggccccatgtggctccgcctctctgggcctgtttctgtttttgggctgcctcaggacccatcctggccctgactgaggcaagagcatgaccgttgagattgccccagcagcagcatttcctcactcagtgtgaagacactggccaccctggggtggcttggttctctgcccgagtgacctctcctctgcagggctggtggtcggtgttttaagaaactggaagtgaagtacagcacctagttaggatctggctgagactttgtcgtggcttcctatggactctaactgatgtccggcccctgttgtggctctgacccctcaacattcattgtctcttgtggcaggcttgttgtcactgtcgcctagttccacaaaatcaggaactcccttcttgccacagaccagtttgccctgggtgctggggacacttctagaggtcagggacctgcacagagctaggtcctcaggcaggctctgctcctgccctgaatggagaggcaaggtaggggagagaggatgtgctgggagctggggtgagcccacctgcagatgggggttgctcagaagtcagttgcatttgtgcactgggtggaatctccgaggactacacagctggaagggaagtgtggacgcccaagaacttcctctactgagctctcctagcacctttttcttcatttatttgtttgtttgacagagtctcgctctgtcacccaggctggagtgcagtggggcggcgatcttggctcactgtaacctccacatcctaggttcaagcgattttctgcctcagtctcccaagtagctgggattacaggtgcatgccaccactgcccagctaatttttgcattttcagtagggatggggtttcaccatgttggccaggctggtcttgaattcctgacctcaggtgatcctcccgccagccttggcctcccaaagtgttgggattacaggcgtgagccactgctccaggccctttttcttttaaaaacaaatttttaggccaggtgtgatagctcacacctgtaatcccagcactttgggaggccaaggtgggtggatcatttgaggtcaggagttcgagacagcccagccaacatggtgaaaccctgtctctactaaaaaatacaaaaaaaatgagtcgggcatggtagcaggcacctgtaaccccagctactcgggaggctgaggcatgagaatcgcttgaacccgggaggcggaggttgcagtgagccaagattgtaccactgcactccagcctgggtgacagagtgagaacttgtctcaaataaataaataaataaaaataaaaacaaatttctagcagcttgattaaggtataattggcgtatcataacattgtaagtgattttaatgaatttgcagagatttactacaaaaatttaccacatctcctaaaagatctcttctggacatttgctgtcactccccatttccacccccagtcctgggcaaccactaatctaattttctgtctctaaatttaactcttctagacatttcatataaatgcaattatacagaatgagttcttttgggtctggcctcttagcataatttttagagggtcatccatgttgtaacatgaatcagtactttgttccttttttttggggggtggggggcagggtctccactgtgtcccgaagctggagtgcaatggcacagtcatggcacactgcagcctcaacctcccgggatcaagcagtcttcccagctcagcctcctaagtagctgggaggcactcaccaccatacacagctaattttaaaaattatttgtagagacagggtatgttgctgagcctggtctcaaattctgggctcaagtcctcttcctgccttggcctctcaaagtgctggaattaacaggcatgagccaccacgcccagcccttcatttctttttacggctgaatattccgttgtgtggacatagtgcattttgtttatccattcaccagtttttcttagcattttgctcttatcctagctctgctgctggcaggccgtgtgactttaggcaagtcactttctgtgaaccttagtggccccatcctccgaatgaagcatagtctaatatttactgagcaattgctaatttctatgcatggtgccacgttctgtacatacacactacatcatttagtcagattcttcttttacctccgttttatagtgaggaaactgaggctcaaagaggttacagccccaaggttactaggatacatcatgtattcatttgtgcactcagtttgtgcctggtactattcaagcctgtggatacaacagtgaaaggcccaaagctctgtcctcaaggagcttgtattgcagtagggtagacaggcaataaccacctaatgtcaggtggcaagcatgagtgaggggaagaagagctattttagacagtgtggtcagggagggcttcttggaagaggtgacatggggcagagatctgaagaaacaacctgaggtctggagccagaggttctttccgggcagaagccagctcgggtagttcagggcacaggaagagcaagaactgcttctgatgttcatttccaccctgacatcctgggattctctcctgagtattttttttttttttttttttttttgaggtggagtctgttgcctaggctggagtgcagtggtgcgatctcggctcactgcagcctctgcctcccaggttcaagcaattctcctgccttagcctcccatgtaaagtagctgggactagtggcccgcaccaccatgcccagctaatttttgtgtttttagtagaggcggggttttgccatgttggccaggccggtcttgaactcctgacctcaggtgcctcaggtgagccaccgcccctggcctcttctaaatttttttttttttttttttttgaggctgagtttcactcttgtctcccaggctggagtgcaatggtgagatctcagctcactgcaacctctgcctcccaggttcaagcgattctcctgcctcagtctcccaagtagctgggattacaggcacccaccaccatgcccaactaattattgtatttttagtagagacggggtttcaccttgttggccaagctggtctcagactcctgacctcaggtgatccacctgtctctgtctcccaaagtgctgggattataggcgtgagccacctgaatatttaaaaaaaaaaaagtatatgcataaagaagaagataaatgatgtactcttgtcataaataatgaacctgtgtgtagctgctcccaggattaagaactagtacattacagtgatttttggaactacagtgggtccctccatcctcatcttcccttcccctgagaaagaactataccctgaattttttgtttgttatcattctattgttttccttttttttttttttgagacggagttttgctcttgttgtccaggctggagtgcaatggcgccatctcggctcacttcaacctccgcctcccgggttcaaacgattctcctgtctcagcctcccgagtagctgggattacaggcatgtgccacatgcccggctaattttgtatttttagtagagatggggtttatccgtgttggtcaagctggtctcaaactcatgacctcaggtgatctgccctcctcggcctcccaaagtgctgggattacaggcttgagccaccgcacctggcctgttttccttgtagtatatacaaaaagacttgtacataaatcaatatggtcttctttgttaaacagatccttctgcactgtgcttttttcacactatatttgggagagaatattgataccggatttgtgaagtgtagctcgctcattcttactgctgtatagtatcccattatattaatatattccagttaacctcgtctattgataaacatataagtgagttccaggtcttgcaattgcaaacaatgcggggcagccctgtttgtgtttccttttttttgttgttgttgttgtttttttcctgagatggagtctcactctgtcaccgagtctagagtacaatggcacgatcttgattcactgcaacctcagcctcctgggttcaagtggttctcctgcctcagcttcccaagtagctgggattacgggtgcctgccaccatgcccagctaatttttgtatttgtagtagatacagggtttcaccatgttggccaggttggtctcgaactcctgacctcagttgatccacccacctcagcctcccagagtgctgggattacaggtgtgagccactgtgcccggcctgtttgtgtttcctgtagaatgtgtggaacatgtgagtacatttcactgtatgttcctactggtgaagttgctgggagttaagggatgtgcatcttcggctactgatctggtttatttttaatgcttgaaagattacttaggttctctatttcttcttgagtcagttttggtaaattattttcattattgttattattttttagacagagtctcactctgttgcccaggctggagtgcagtagcatgatctcggctcattgcaacccacgcctccggggttcaagctattctcctgcctcagcctcccaagtagctgggattataggcatgtgccaccacgcccggctaatttttgtatttttagtagagacggggtttcaccatgttggccaggctggtctttgagccgctgacctcaggtgatctgcctgccttggcctcccaaagtgctggaattacgggtgtgagctaccgcgcccaacctgacatccattatctcttgaaggagcccatctggagggtgagggagcctctctggccttttcttgcatagaaacctgtgagcaggtggagtgagcactaaagcgatgacagagattctcctggccaggggacatctggaagaatatatattgtcctggaggggagtggagagggggcttttttttttttttttttgagatggagtgttactcttgttgccaaggctggagtgcaatggtgcaatcttggctcactgcaacctctggctcccaggttcaagtgattctcctgcctcagcttcccgagtagctgggattacaggcgtccaccaccacacctggctaattttttggtatttttagtagagatggggttttaccatattggccaggctggtcttaaactcctgacctcaggtgatccgcctgccttgacctcccaaagtgctgggattacaggtgtgagccactgcccccagcctggagggggctttaagagactttctttgggcctagctctaagcttgccacaccaccgtcacaggttgaactaattggggttgtaagtggactgttttggtcaaggcagggtgtgttagttttttttttttttttttgaacagtcaagtgtgcttgttagccctgtttatcacagagtcagggtatacagtaagtaccctgtagcccctccaccgtgctcctcaccccatctctcgccagtgttcacccagagttgtcacacacagcaccacgggatggggcgtccacctgcagttgtgcaggcagtctggaatggcaggaaaaactctggccctgaggaggccacaggcttaaatgtatgcctttggccccaaaggcccgctaggaagttgagcttgaaagtaactgtctcctgtgtgctcagtgctttacagtgtgcagagcccggtctcaatccttggtgtatttctcccctcttgcctgcctgtggccagcaggagtgggtggtgtcaccatccctgcctgtagataagagctgcaggtgctgagagggttggcagtggtggcggctgctagagacctgggtactgtgcatgctgcgttatctcactgtgtctcccagacactctcccaagtgaagaagctgagccccgggttgacgaagcacttgttgaagtcacgaagcccaagtggcacagctcacctccccaacccaggatgctctgccgagggagagccccaaaagctctggggaagagtgcggggacacctggctcctaagcgttcttcttttgtgcgtgtttacttggtagaagtgaagagagtggccgcagcaggctggatgcagcctttggaaggaatgaaaggctgcaggcctagcaaggaaggcttaaaatcagctgcacgttctacttctcacccttggtcacctcgcagctgaccttcctctctccacgtttactctatctgggcctgggtgtgcttctgccacacacagaaagagcctgtgccacaccatttctccctggaaccccttctggtggccaatgggactgtcaccccggggtgtcgaggtggatggggcaggtggagccctgcacttaccgtccttgttcttccccggaacagtttggcccagtgtccacccacatccttctcccaccaaggatccctcctaatgggaccatggctttagaaacaggacccctcagggccggggctgcccttggaggtgggaaggacgagaggtcagcctgaggtgacctccagttgaagctggccctgggagcgtgggattagggtggcctccagttgaagctggcactgggagcgtgggattagggtccctgccaggcagaaaagggtttctcgtttaccatgtcctcccctccctctttcaggtgtagtgtcttttcccatgaccgggagttcatagaaatagttaagtataagatgatcgtgtgcgagaatgttggtactaaaccagcatggacagttttctggatttctctactactaacttgtctgcactgagcgtgactcacccctaacctggtgggagcgctgattggaggggcgggaggctggcggcgtgagctccagatggtgcatgtgcccttgggcttggcatgcggcgtgtcttcgtgtgaaggacctctgggagcagcgagagggctgagctgagctgagctgagctgcatgtggaggggccctcccgggaggcctgtgccctgaggctgaacttttaacaaaaccctgggaccagagggcttcagggctgatcaggacctgcagcgcttcctgctgggaagcaggaagcaatagaaagtttacgctttctattgctcaggagccgctcagtgattaaaacaagtctaaaaagccaaggggactccgtggccccaccactcccaggctggaaggcaggttcttgctttgtcagcccttcctcagcccttgtccataggcagaaggggtttttattaatacatgattgtagccttgtaggagatgagattatgtgtcttgctttgaaaattctacacaaaagcctgtttcctagttgctacagcagccctcaaactgcccatttctaaagctttcaagtagcccagtgatgcaattggaaagcccaaggcccagtttttcaggctaccacaccccatgcgtggaggctgctgggaggtctgtggtaactccatgagcctcagtcccttcctccctgccccatgggctcagaggcccagcacccctgggtgctgagagggcagggtgcccttcacaagtgggcagtgtccgggcagtcctgtcaggatgtggggtcagtcgtaggaatgccggcaccccttggctgctgagtccttagactcctgggggccactaggtgggaactgggttctacctgacagcagctgcccccagccgcagtgctagccttgggctgagtcttctgtgctagatctctcctgggcccctccttccttcttactcaagtccaaccccagatattttcagttgccgtgattctgaggatctgatgcccctggaaaggtacaacagtccccagcacccactagctggcccaggccccaaactgccaggagtggccttcttgagaccatgtgtcaccctcccagggaacaagagctcgtggctgtctgataagccaggcctgtgtgactcctcaggacatgcacccccaggtccctgtacagctgagcacaatagctcaggagtgcagggccatgatgcctgtgtctgtcttctctcctgggccacagccaccccacgtcatgctgcagcgccgcagagatcatggctgtcctctttttccacaccatgcgctacaagtcccaggacccccggaatccgcacaatgaccgctttgtgctctccaaggtaagagcccagctgcccactgccagccacaccttgcctgggactagggtcacacgggccctggaatggtgagtggtctttgaggagacctggctgggcccacctctcccaggtgccttctccctgctcgtcctggcctctccctcagtgtcctgctctgtgctgacccagctggctaaggaatacaggactgaattgatgggttgctctgccatggagcccaggtacataaacaacgctttaactcaaagaaatggagtaggggactacggaaacatctgttgtgtgttctgcccagtctgggtgttgacaggcaggactggcatctcggtctgggttgtggctccctacctgctctatctgtgttgtgccagcgctcccgaggccacggcttgccccctcggggtggtggtgtgctgtagcagggttttggatggggaccccctgaccccccccttctgggtggaatcacagccacagatccctgaaatccacctgtgctcaggcctgcctccgtggcgtttggtctctcgggcaggctttagagcttagaagtctgtccaagttgttcccatgccacaaaccagggattagggcagccggctgcctgctggggttttggcttcgtccagcctcacagctgtgccccctgcacctgtcttagtgcctgcctggccttggcagtgggaactttgggctgaaaaccaagaggctgaagagggctgaaaggggagaagtggccttcacttgcttcctcccctgaaatggatgctgcagttggccggctcggccgggccccaggggtcagtgtgaagtaggcacagcccgaagtagaaccgctccccacctgacctcaccccaccatccatctcccggcagggccatgcagctcccatcctctacgcggtctgggctgaagctggtttcctggccgaggcggagctgctgaacctgaggaagatcagctccgacttggacgggcacccggtcccggtaagtgctcctgccagagcctcccatgcctctgcctccacttcctatttcccagacatgtgggacgggggtagggggtgcccactgagaagccaaaggtgttgaaaggcggaggagggcattgagttgaggaaggaaagaagcaggtgttttggggacacgtattcaacccaagctggtgccaaaggggaaggccttctgaggcctcagccagggtgctctgggatgacttcagggagggcctctccccaagctacccttctgcactgggcctccttggctaggtagctacagcttgggaagagaggggactcgataagggagtggctgcaggatgctggcgaaaccctggggaagggacccagtttgttccttggggtgccatctggcatccctgcaaacgttaagacttcatggattaccacaaaaactgtcacatggtctgggtccccacgaggggcaaatgttctgtcaattttttcatgattctctctcccagcactttgtgaagtgggtgatgtgggaactgaggctcacagaggttcagtcccttgcctgaggcctgaggccacatagctggctagtgggcagggctgggatttgaacctataattataattagttcattaggagaagaagtcacatgctaggtagaggccatcctggggcctgaccttctgcagaggaagggcttgctgggctgggtgggagtgtggctccctaggcgggtgagaccaggatcccttctcctctcagattaacggtggccttctgttatgacagaaacaagctttcaccgacgtggccactggctccctgggccagggcctcggggccgcttgtgggatggcctacaccggcaaatacttcgacaaggccaggtaacacacctactccccacccccaacctgggtagttttggggagtggtccttgggtgacccacccttcaccatcgcccccagactcttcctctttcctggctagggcagagtaatacatatgcgtggcctcttttgctctttaaacatccgctatggctggtgccatgaccggccccctttacaaatgaggaaacactcaggagttaagggacctgccctgggtccctcagcagtgactggcagggccaggtttgcacagagtgcgtgctctcaatcatgtgctcttcagccagagtgcttaggctgaggacttcctgttttgcccccagccctgtgcccagaccccagaagtctcagaaagacccacccccaggcccctgtctgactaggcaccaggagcccaggcctgagccacttgcctttatcttggtaaaggggagggttgtatgttctgaggggttctgggatacctgtaagccacctcctatcagcagggaagaaacaaacatttgagagattgagccttcagagggtgggtgatgagcctgaccagaaaggtgtgctgctctagcgcccaccaggtgatttgtaggaacggccccccaggaaggttctagccataagtttgtctgcggtggtcagatatggcctggggggatgaggttgtaaactgttaagaataatggctggctgagggaaggattgcttgaggccaggagttccagaccagcctaggcaacagagcaagactctctctacaaaaaatacaaaacttagccaggcatggtggtacacacctgtagtcccagctacataggaggctgaggtgggaggatcacttgagcctagggcttcaagattatagctatacatgattgagccactgcaccctagcctgggctacagagcgagactctgcctctttaaaaaaaaaattattcttttttttaaagaataatcactgtattagtctgtttccacactgctgataaaggcatacccaagtctggggaagaaaaagaggtctaatggacttacagttccacatggctagggaggcctcacagtcatgctggaaggtaaggaggaacaagtcacatcttatgtggaaggcgcaggcaaagagagagtttgtgcagggaaactcccgtttttaaaaccatcagatcttgtgagacttattcaccatcacgagaacagcatggggaagacctgtccccatgattcagttatctcctgctgggcccctcccacaaccagtaggaattacgggagctacaaggtaagatttgggtggggacccagagcctaaccatgtcagtcactcatcagaagggttcctttgccctttgggggctaggccctgtgctcagtgctcatgtgctgtattgggttccacctttaaaagccccctgtgagttgggtagtggtgtgagaaccgtgacccgtcttacaggtgaggaagctgaggcaagatgctggcctaggccatccagttggtggtggaggtacccaggctgctcttggagaggctgagggcaccacaggagctcggggagtcctgtgggcgggaagcctcctagaggaggaaggccagtggggccagcccgcagggtgtgagaagggcccagttctgcagctgatggcatctccactgccctgtcctccactcctgcagcagaagtgccatagtggggttcgggaagactgtgggtccttgaaggacaggaggctgcagggagcaccttctgtgtgcaggcccttccccaggactggctctccaaggaggcctcacagtcccttccagaccccttcaggccagtgtcacctgaccacagtttgctttcattccttggtgagccttggggcaggcttggctacacccagaagtgattcaccatgaagtaaagagagagagacacacaaagaatgagatgcatgtttaagagcattttatttggcagagaaccagagatgtgagttaattattccctacagttgctggaaataattccctgtgaaggggcatttcctgaccctaacataatggaacaagtcagtgtagggagaaggagtttagctgggttcccagaagccagggtggcttggggccagggttgcctggagcctaggcccctgactgtacctgggggaaggggccagggcatccagggattatcatgtcaggccaggcacccggaggtagcgtcttgatagagcaaactggtctccactcactgtttctccctgccctcctgtttaaaaagtacagaatgatattaagaaatgaacgttttccttatttttttatttttattttttctgagatggagtctcgctctgtcacccaggctggagtgcagtggtacgatctcggcccactgcaacctccgcctcccgggttcaagtgattctcctcctgcctcagcctcccgagtagctgggactacaggtacgtgccaccacgcctggctaattttttgtatttttagtagagacgggctttcaccatgttagccaggatggtctcaatctcctgaccttgtgatctgcccacctcggcctcccaaagtgctgggattacaggcatgagccactgcacccaaccaatgttttccttattcttagcacactgcctcccacccccaatttaaatctaatgatgtattttgtccatgttatcatgagaaaagcttacaaatctgtaatcccagtgtgtgtgtgtgtgtgtgtgtgtgtgtgtgtgtgtgtgtataatataaaatctagtattacactttaaaccaagccttctatcatgagctttttctcctgatattaacagtggagagctggttttttttgttttgttttgtttttttgagatggagtcttgctctgtcacccaggctggagtgcagtggtgccatcttagctcactgcaacctccgcctcctgggttcaagtaattctcctgcctcagcttcccgagtagctgggattacagacgcgcaccaccacactcagctaatttttatatatttagtagagacggggtttcatgacgttggccaggatggtcagtctcaaactcctgacctcaggtcatctccctacttcagcctcccagagtgctgggattacaggcgtgagccactgcacacatcctgagagctggttttaatgatcacataatattctgttttatggagatgctataatccatctagccagtcctttgttgttggacacgtaaggtagtttccaaatcgttctacaacaaatgtcgaccttctgtttagggttccctctcttcaaattagttcatgaatggatgtttgcagccccccacccctaactctaacagctcaggcaataccaagcctcagggttagcccaggctcctgtaggccccttccctgttcacaaccccttccttggcatctcctcgggacctcagcacgccctctgacctgagcctgatggccctgtagggcttagccttgtccctagtctcgaagccaaagctgtgctgggcctccagtgctagcctcggttcgacttccctggaagtgggtgtgggcttggggtggcagccagttgccttccctggaatccctttctgggaagtcgagttggcttctctggctcagccccatcatgtggcccctttctggagctgctgtgccagaccagagtccctgcagggtctctgggccccctcaaaacctacaggggaaagaggaggcaaggctgggacaggatagggcctctgaagtgtgggcctgaggctttgtccttctggccatggtaccccacaggggcaccacctcctgtggtggaggccacagaagagcagtatgaggcaggagaggctgcagggagtgctcctggcctgctggcatgtggaagtgctgagtcatgctgacagctccgtggctagctgtcccagcctcttcctgctgcccctgccttggccctgcggcagggaggcctggaggcttggactgctgagcatgcagccgggttgagggccttttcctgcaggagcaggagggcagccatgtcccctctgagcccaaccaggcaccagcctcatttcctagggctacacagctagacactgggcagggtaaggggaggtccccaagtcctaccactcctcaccctacttgcatgcctgcacggcaaggagcggacagtctaggctacagtcagacctgcgtttgaatcctggctcagcaacttcctgacagcgcgaccttcagacaagtcctgtctgttgctgccgtccctctgctacccccatcccctcacatctcccaggccgggaacgttctgtttgctgggtaatttatcccaagttcagtgttctttttaacgtctcactgtcttgaaaagatcacagttgcctgtgttgaggggaggagagggcccctgtggtagagaaagagccaggtgcagcttcagtcttggggtcaagagctagtcttggaagcttggggagagcctgtcccaggaagcgcctggtcctcaagtgccctctgctctatcctccccagagccctcttgctccagggtgttgcctagagtgcctcaggcctccttggcccacctccctcctccgggcagaagcagagcttggttcccaaggttcccctttcccactggcccacccagccagtcccaaggcctcctccaacctctggttcacagcggggtctgtcccctgcagcaggtggctcaagcctattcacccacccttcctcactttcctctcattccaacaacccccatttttctagatcttattagccagatccctgttgtcctagacctctgtttcttaacaaccagtacttcttcctgagctcctgacgtcttccttcatgccattttctcttggggtgtggcttgtggtaggctgcaggaacctggtgacactgttgcccctcgagtgtaaatgccatctgttctgcatatccatgcgtggctgctcctttacccagaatgcaggctccttggatgggtgggggggtgggagccagctgggtccaggtgagagggactggcctgattcactctctgtccacagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcgggtatgtacgaggctgtggcctgagtgtggtcacagcacgggagagtggtctgtgatcacagctttgcaggtgcaggtgcaggagctgaagctgggaccttaagcaccatctaaaggtccctttctttagcatttgactcacaatttcaaactctaggcatttggacttaatggctcaggatatgtgggccaggcccagttttaagtgagtttccttgttttcgtggttgtggcatggtggctctcggagcttccacacaccatctcacgtcagctcgctttgttcttgaggaaggagggttcttgagggatgggggcttgctcggtaaagctaaaggatgtatagctgcggagaggtttgaacctcagtttggtggccacgtcctgtgcccagccccgcccagcctggggaggaggaacaggctcctggtgaaatgggagatagggtttccagatgccccccttcggccttgattggttacaaattcagggtcaaagggcacaaagcagggaggtcaatctgcatgggtgtcagccagaggggctccacctcaaagcctccaccggtgttgccaaacacaagctgctctgcacaggggcccagcattggctgaggaggctgtggaggggagggagcagggcaggtgccgtgcaaggctttgagactcaggtcaggcctccaggactgcgttttgcggatgaacccatgcctgtgactacactaagtaacaggatgcttggggttaccttgcagtagcacagcatacgcaggcctgtgttccctgatgactgacctcagaaagggagaggaggaagggaggaaataatctctgttggacaggcgaggaaactgagccacagggtcctcaccccacaggcctccccaaggccacatctatctggggactcagagtacaaccccagcagcacccccaggacctgtgtccataacctcgtgactcaagccagattcctgaagtcctggctccaccgctaacttgctttgtggcgtgggtcacgttacttactccaccttcggtgtctcagttgatttgtctgtacaatggggccagctcagcacccaagcatggcgtggtgaggcttcagtgggctaatatgggtagtggttggcatggcactcagtttgagaagtgctatttttattcttatgtcaaaaagagtccccaaaaggatagcttttcaagagaaagggtgctctgccccagctccttcctgtatatttgactccatggttcatttcaaaaacatttccagcaccacatccagcatctgtggagtgatcaaatgtgttccccaaataagaattgggccaaaaaattcatcaagaatctaatagcagacagattccaaacccagtgcgctgaccccagaacagctttcagtaggaaatgagcagatcaggaatgaaagagacaataaaggaactgagctctggattacttaagaggaggaggaaaacctgttcagaggcaaacaaaaggaagtaaaataatgtgaaaaagaaaaggatttaaaaaacccaaactggaaacaggaatgttgcaagctttctactactccagctgaggccgcagttgtggggtggagcctgggcagaccccagctgccaaggcagacctttccctggaaggctcctcggtgttgtggcccctgggaattgccccttactctctgccccctgtccccagttggcatgccatcatcgtggatggacacagcgtggaggagctgtgcaaggcctttggccaggccaagcaccagccaacagccatcattgccaagaccttcaagggccgagggatcacgggtcagtatgcacaagccgccctccccaccttcacccctcgcccagacactgtggctacgtagctctgacccgcacatccagggaaacagcccttgctgctcactgagctcaccaggctccagggaaggggagcgggagatgctgtgactcagtgacccctgtggctgagccaggatttaaactcagatccgtctggcctctgccggtgggggcatgtacaggcaggaggagaggagggacttggagggtctgtgggtgagaggaaggtcgtggagtgaggcagcccccgtgccccaccctggctggtgcctttcagagctgcagctgtgtgtgctctgccagctccggccacctgctccagctgaagggccgacacagagccaggcagggcccggagagaactgttccctccaggaggtgagtggggtactcctcaagcaatggcagatgctgagcaaggcctgtgtgggccaagagccttggggggtttggaacctgggttctgccccaggccggagaatgaggcaggcgtaagtcactccctggcacccaggtgtgggcttcagattcctaggcctgggatggcctcacccattttaaagatgggaaaatgagactacaagtggtcagggacttgcccggggacagaggaagtctatggcacgaggggggctgatcccagggcctgggtcggcttccctgccaaatgcccctggctgcccacctgcctgctctcaggggttgtggcttgttctgcccatgtagactcaggtatatgaggatgttctgagtgggggtttggcagtgctgggaggtgtctgggagggggtggatgtcgaggaaagggctctgggatattgtcatggctttggtgctgctgcctggcactgccctctggtgttaaaaatgggcaggatctggaccacttgcagcttcttgggggctcctgctagtctttcgggctgctgggtgctacctgggagttcagtctgttcttggctctggccagactctagtgactactgaggtgacctccagggagagggatattcagccttcctggccgcacacaacaaggtgccatggggtgggcatgcctaggtgcttatagactcctctgctgctcacagatgcattgggtgaccctggaagccctgttctgggccttgggttccccttctgatggccagggtcccttccaacccagtcgacaaactgagtatttctgcagcagacacctctacctgtgtgtgaccctgcaggcggggttgtggggaggaagagaatggacacattggtgaagggatggggcagtgggcccagaaacacacacctgcccacgtctggcccctcctttcccactcagctgtgagctcccaaaggaccaggcagtagacagtgagtggtgggcacgtaggagtccatcctattcactgcgaccctcctttcctggcccccgtgcctggctgggctctgcctgtctgggatgatgccattcctcccttgccctcggcaggtagagggccagtctcctggagcagcctcctggccctctgggagcttctgtcttacccattcctctgtcctcccgtgttgggtctgcaggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaaggtacaaagtggggcctgtttctctgaacccatagttctcaggtttcccaagtctgtggcccagatacaccctctggagggctgggaaagggaggagagcgattcatttagggcgaggagtgatccctgaggtgttgttcctgtcacttccctcagaatgacagacatctctggagttgacctgcagaggctcagaccgggcaagggaattgcccacttagcaagcttagcaagctactgacagaactgagatcaaagccaaggactcactcccaagttcttgcatcgctggtccacgagggacccttggcctgagctcaggacccccacctgacctgggaaaggctaggcagagctgtcccactccaggtttctgtcccaagggaacccatccatgcagcctgtgcctggccttgactcccaagccttctgtgttcccatgcaaagtggaataggttcatggacctggtgcagcaggcgggaagttggggctggtgggtgtcttctgtagcttatacctttcacagccagaaggggccggggctccaggggctcccaagacattgaccgtagtcgttggcaacctttcagcagttaaaagcctctgcaggaccttgtgctccagggcttccatttttggccccgttttaatccttctctgaaagcagggctccaggctgcaggtgtgcactcaccctcagaggggtccagagccttcccactctcttcctcacagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtaggtgctggggccggcagggacaggtccacccaaggctgagggctgtggtctgaggggtgcggggcagccatgttggcagagccaggtgcctgctgtaggccagcccagggagactataagaaaagccaggacccagcgttaacccctgaccttgaacagccacagtttgggaggttctgcccaggtgcaaatgtcctggacaggtgtgcacatgggggagccgaatgggactgcaggtgctctcaggaggagctgcgtacaggccaggcctggtggtgaatggggtctcttccaggtggaggacaggcctggccagtaggtggggccgtgatgggtttagcagcccgagtctgtagagcacctgtaatgcacacggctctgggccctgccaccctgagggatgcagagatgagggaactctgggcccctgacatgtacccatttggggaagcagacccttgtcaggaactgaggttgtgaagtaaggaacaatgttttgtccatgttttcaaaatatcccctcctggtggtccaggagcccagcctggcttgcaggcccctagggacagggagcttcctctctctggagggcactcagatctccagagttcttccaactggacctgaaattctctctgtggtttccagagactgctctgcagggcgtggggctggggaggtcccaggtactagggaaagaggccttgtgttggctggcagattttggagccttgaagggcagctggtttggaactgatgactgtactcagtgctgcttctggatgagtgatttggggcctggagcctcagcaggcatgaggctgctgccctcggaccccagggaggggttgggaggaccggtctctgcagaagaaggtggtgggggacatattcagaagcccagaaaggatggacaatctatatacaaattgtggctttctccacaaaaggggtcctaggctccccgaccaccctctgcctgcccctttgggctgaccctgtcccacctgcccccaggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggtgagtttagccagggtgtttacacctggagctcccttgacttttgcaccaggaggtatgggagggggatgggccaggattccagcccatggatgggggggtaggggtcttatttctgcatatcctttcccccacaccccaggggaagacgggccctcccagatggccctagaagatctggctatgtttcggtcagtccccacatcaactgtcttttacccaagtgatggcgttgctacagagaaggcagtggaactagccgccaatacaaaggtaggttgcatggctgttctttctcctgctggcagccatcacttcccaagggaaacagaagaggaggccagagctggtcacttgctgccccagggggtgtttcctgaccttgcccctggtgttcgtgtagcttgtggaagttagacaagaaaaaacgaaatacacaccccacttactgccacgtggcagacattgtcaactgattgccagtctgtctctgctgagaatcctggcagccctggccggtccagcggttgacacctctccaccctcctgagttgggttctccaagacaggcaaggatgagctgagccctgtggtccaggcccggagctgcatgccacagacccagtgcgcgtggttcctgcccctctgcctggtgcagtctgtgggagtagcccacctgcagccagtctacctggtggaaagttgccttcggtctgaggctgcaaggtggtgggcagttctcagagtgttcaagtggggtgcgggcggcagagggcaagcaaggcccttttccctgctggagtagccaggatgcagtaactaacgctcccatgggaagggatggcctctctagaaagacctcgtctctgaggttgggtgtgccacatcctgtatcctcagtttatctgtttcggtctcagggtatctgcttcatccggaccagccgcccagaaaatgccatcatctataacaacaatgaggacttccaggtcggacaagccaaggtcagtgcctcgcatgccccaggagcccacagagctgcctggaccctccctgctgtgactcccagcagtcagggcacaccctgccccagggccctgagccttactcaccctctgtgtcacccccaggtggtcctgaagagcaaggatgaccaggtgaccgttatcggggctggggtgaccctgcacgaggccttggccgctgccgaactgctgaagaaaggtgaggagaaggggcctccaaagtcatcaactgagcggccactgcatgctaggtcttggggttctttctttcgttctttctgttctttcttgaagagctcacagctagagagaaagcatttcatttcattaaataatgatagcaattatagccatcctttgagcacttgttctgtctggcatgttgctaagtcctggggctgcagtgcccacagtccctaccctatgactctaaagtcgagacccccccagcatggtggccagatcagtggcctggagcctgccagctgggctggaatcactcagccaggcactagttaaggaagtaagttattcactgtcaccatgcctgttttcctatctgtaaaatggagatactagccccttgccctcagagctctcctgagggttacatgcatgtgacttggtattctattattattactgcgagctcacagtgttggctagtggtttgtaggggagacaggcattggcctctcctgcaatagaatcacacagcagatgtcatgttttagcacgaaagagggggcaggtgtggcatcttccagaaagtggcttcagagtgggtaggaattgattagcagagaggagagtgaagggaggccggaggagggtcaggcaggagcaagatggggctggaggagccagaggagtccatccccaggcagggggagacccaggggggtgagctttaagcagggcctggcaagcgtgggtttgtccttctgagaaggtgcctctgctgctggggccgcacgtgggcctctgatcactctgcgggctgcagctccccaacgtcaccacatcaagcctcaccttccatcaggccagacacctggggtgttttctctcgcattccctttgtcttcaaggttgtgggaggatgagggaaggcgctcagggcctgcacgctccgctctgggttcttggatactgcgggcaacacagctggaccagatgccccagtgcaaggggttggcaagcatgagctcagccatgggaacgaggtggcaagtggttctccctgggacagggacaggcccgcaggctgagctcttagctacacgcagccctcaggatgtcccaccaggcccccaccagggcagatagtggtgcccagccctcccctcagccacgccgtgtgctctccctcacagaaaagatcaacatccgcgtgctggaccccttcaccatcaagcccctggacagaaaactcattctcgacagcgctcgtgccaccaagggcaggatcctcaccgtggaggaccattattatgaaggtaaggaggcctggggcaggcaggctgggcaagggacagggccagagagccgagcgttggacgtgcctcttctatctgagccccaggagggcagctgtggcccagaacacccagagctgtccctcagagcagctgggacgtggtctcttaaaaggcctcaggcttggcctggggacctagctaactcacagctgctgatgagctctgtggagctcctgctgcccaggaagctggtgaggattccaacctcgctgctaaatggtggatggtggcgtccctgaggtagtgtagggtggaagctatggtgcagcttgggaagcaatgcagaatttctggtatttgtgagtccttcacacagcaggctccctaagtacacaccagcctctctaagtaggaggccccagtgggagagatgggctttgactctggggtcaaatgtagataattggactatggacagtggctggctggtcaccaacaatggtgtttgaaacaaacatttagaggccatatttgggcttataaaaatagttctgggccgtgcatggtggctcacacctgcaatcccagcactttgggaggctgaggacagcggatttcttgagctcaggagttgggagaccagcctgggcaacatggtgatacctgtctgtctctttaaaataaaaaaaatcaatgagttatgtgatgggctcatggctacaggtggagaaaggcagtgcatatgcagcctcctccatccttgactaaggctgacagagggctgggcccaccactgctcaccctgaggcctcgtcttctgactcccctcctttcatttctaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaattggccctgaaatgttttcttttttgatgtgtttgcagccagtgcaggttctggggaagaagcgtggagggtgcgctagggaggctggtgtccttggtcctgggccaggacctgggtgtcccaagtccccttggaatcacctgcaactgccctcaacctccagaactatcgctgcctcccattcatcaccaggtgacatttgactgcaacctgccttctagctgagaggctgagacctacatccctcattgtgacctcagtccacctggccctgagcgggctggggaactgcctcagtctggaagctgaccaggcactctcagggccgccccacctcccccaagtccccacagccttgcagtcaggtctcctgggatagggaggttcacttgcttgttgtccctcgtccttgtcatatccttttaactaggcatctcagagaagcagagacagggcagccttcgtcctgggggaaaagggaccctcaggatggcatgagaggtcctcaatcccaagtgtggaactgtccccctcaacttgttaaaatgcagatttctgggtcttgccaatggggcctgggactccatgtgacaactggcccaggagcttctgatgtcacacagaattctgcagtcccaagctccagccccgacctgctctgctgttcctaggtgactgccctcacactgctgaccacagtggatttctccccctgctgctcgggctcagctggggtcagccctgcttataaggtcaactgtgcaaaaccttatactggccaagaacaaactagtgctgggggaggagggctgggtgccccggccactggtggagtccccaggaaatcctcagagctgttgcgaggatgagacacatttgtggacacgtccacctgtcctcctgaccgtctggagagaataaacctgtcaaagcc

SEQ ID NO: 37037 - DNA, 31287 bp, Homo sapiens; identical to SEQ ID NO: 37036

SEQ ID NO: 37038 - DNA, 74900 bp, Homo sapiens
gtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggtggggaccgggcgaacgccggagagtcgtctccttcgcccgccggaggagcgcggactgcgggcgggcagcggggtccgcggcagggcgggccggcggtgcggcgccgggggtccggctctgcggcgggtctggcgcgccctcccccgcccgtccctgcttggcgcagtgcttagcgctggaggtcgggctgcctcagccgccgcagaggccaaatgaaaggcgtcggggctgctgggggcggccgtccgcctcggccgacccagcccccaacccgcccgcggcgccgccacctcctccggggacccagtgcccccgggcgcccgccccgccctcccccgggacaatgccagggcgctcctctcccgccggagtccgcggctgggctttctccaggggcggccccgcgcggaccccgtacgctccctcgcgcggcaccggggcctcggctccgggcctcccacctgcgagcggcgggcttcgcctttgttgccaggtggacgcggccccggccttcgcgcgcggcagggatgctgcgagccccgggggagctcccgcgccaggccgcccgctgctccctctgccgcctggggccgggtcgcggacgcgcattttttaagtggcgctgtttgcctgcgtccgtagaccgaggaaacccgctctgggtgcgttgaccgctttcgtgagggtttcagtgagtagggaaggtgcccgcgaaggcgtgtaaactgttggaaaaatcgtcctcttcgggtgtcagaattccatcagtggttgtgcttcgaggtcgcaccctgagcatccccgctgcgagaaaggcgaagcggcagggccgggggttggggaggccgcgggagggggcgggggcggcggggtccgcggtgcgggccggagcgggcagccttggaggagccctgctgtggccgagggagacggcgagcttgatctttacttcccttctcgaagtggtgcttgaactgctggtctggaatgtgtagttctggtgtcgtttatttcttctccctcttcgctcttttaaaaattacaactggtttctgcatacttagctaatttcagagagacctgaagactggatttgattgggcattaattgagagctttcttttaaagacctcaggtttagaatatatttacttctacagaatgttcaagtatttccacgggtaaaaataaatctaataaaaagcctctctgatggaacggcttaacacctttgtattcatccagtttaaagctttgtgactgtgagggtaagaaaggagttcagctttaaagagaaatagttaacgtttatctacagaggattttggattgcgattgtttcagtgtgtccacacaatggtcagagttgtatctgtgatccctgatatgtcgcatgaaaacagctaggtgagtgagatgggaagaaaaaataaaggctttcgtatggaagatgggacttcactagtgggtcgggtgtcagaaaccatcgttcacactcgcactccacttcccactgctatgactaatttgaggcattagtgaattcacagtagaagactcagcagttttaaagaattcgttaatacttgtgtagcgggaaaaaataatatgagaattcattgttgtgtgttaaatttgattgttagccacagcgttgttcagttgaaaagtatggttgaagaaagtaggaattaaacatttctgaaaaatggttttatggtaactcctgttctttggagctgtatttttgctcacacttactaaatgatctttcaaggggccttttgtcaagctatcagaattttattcatatgaatataatttgattttgtttatttgctgtcaggcaagggactgtcgaagcttaatttagatgagagtggcctaaatcaggatgtctttgggaaggccctgattgagattagcgaaagggattctggccaaatccctgatcaagttgcttggcacagaattattgattggcaaatctttagtgttgcttggtgttgactgaattaatctcttacacctgtttaaaaagaaaaagctcacctctggactcagggtcacttcctctcttaaatccgagacaagttctcctgtgtgcatgctcccatttgggactgagacagtattgtgctgaaaccccgcatactgtgcagtggatgactaggctcctgagaaccggaacttgagtttgttctgtcacatttgaaagaaagaaggccatttgattgccagttttctggaaactcaaacccaaattaaaggatgtcaactgaggcagagtagagaaggctttgtgttggtgtttctgacaggtggtatgggagatgtgtaattgtaccttggagagaaaccttggtgtgcttctgataggaatatcgtcttttttttttttttttttttgatacggagtctcgctctgtcccaggctggagtgcaatggtgggatctctgggctcactgcaacttccgccttccgagttcaagcgattctcctgcctcagactcccaagtagctgggattgcaggcgcctgccaccacgcccagctaatttttgtatttttagtagagacagggtttcaccatgttggccaggctggtctggaacacctgatctcaggtgatccacctgcctcggcctcccaaagtgctgggattacaggcgtgagccacagcgcccggcccgttatttttatcataactatgttttaaaaatcttttgataaatacgataaacttcagttttatcaattagttcctccttttgtagagggaatttgttttaccatctaaagccaggctttcccagggtgtagccacaagccacatgtggttattgagtctgtagggtgactagtgtgaatgaggagtgaatttttcattttatttaattttaattaatttaagtttacatttaaaatctgattcagtggttggaaaacttttaactgaaataatttggttatgcgaatttacttttaaactgtacattttatgaaatctaaatgtagatcaagtatttcctatgaaaatttagcttctgaattgagatgtactggaagtgtaacatacacatcagattttgaagatttaatacagaagaattaaaatctcaatttttgtattgactaaattgaaacaatactttagacatgggctaaataaaacattaaaattaatttcacttgtttcttttcactctaatatggttcctagaaaatttaatactatgtatgtggctcacattgtatttctgttagatggtgctgatttaaaattttgcttaaagttggtcctgcatatgtttttattagcagaattttttaatatgttcctatatttttccacataaagtcttgctggaagttggcccaacatgctcttaagtatttttgttagaacaattttgaatgtgttgatttttaaactttttcaattaaaaatgttttacttagaaataactttaatcaccaggcgcggtggctcacgcctgtaatcctagcactttgggaggccgaggtgggtggatcacgaggtcaggagttcgagaccagcctgagcaacatggtgaaactccgtctctactaaaaatacaaaaattagctgggcgagatggcgtgcgcctgtaatcccagctactcaggaggctgaggcaggagaatctgggaggtggaggttacagtgagccgagatcacaccactgcactccagcctgggcaacagagcgagactccatctcaagaaaacaagaataaaaaaaagaaataactttaatcttataaaaaatgcaaaaattgtacaattttcttaccctttactcagattcaccaattgttaacatttcttctagtcacatttgctttactactgcattttttgccaaattatttgagagtaagttgcatacgtcgtcccccatcccctttacccctgagaacttcagtatatattttctaagagccaaagacattgtcttacataggcttagtacagccatcaacctaatgaaatttaacattgatacaatacttggatcttatctgctgtcggttttctagttagtttgttgacccaatcatgttctttatagcatttgaaaacatgttttgttgttgttgttgttgttttgtttttcttttttgagttggagtctcactctgtcgcccaggctggagtgcactggcatgatctcggcttactgcaacctccgtttttcaggttcaagcgactctcctgcctcagcctccagagtagctgggactacaggagcccaccaccatgcctggctcatttttatatttttagtagagacagggtttcaccatattggccaggctggttccaaacttctgaccttgtgatctgcctgccttggccttccaaagtgctgggattacaggcgtgagcctccacacctggcccctttcaagattgtttaattctgtttacccttactaaattttgaggcttttggattttctttctaaaataacagaagaagaattctataggtagtacatattcattgtaagaaatttaaaagtacagataaccaataagaagtgaaaaatgacctaaaatcttattccccagggaaaccttactgtaatattgtatatacccttctgttaatagataggtcatgtacataaattttataaaaatggcacatactgcatattgaagccagcacctaacaatgattatttcgaattatgctaacatgaactactcaaagaaaataatgttttccgtgtgacaaaaagtaggggtaaatctttgtacagtaattgtagtttccatggaggggccagttgagagagaattctaaattgcctataattcaattttcatgggttgatttttaatgagataaactagattaccttgaagtttaattaaatttagtgtattgtaccttgatttatggcctaagatggaaagtggactatgtaggcacattcaagcagaaatgagttccagtcctttgtgtcaagtacaactaataattgcttttgctgagggaatttttcttacctaagcatcgtgaagtctttatttttattttttattttttgagacagggtctcactcttaccaaggctggagtgcagtggcgcagccatggctcactgcggcctcaaactcctgggctcaagtgatcctcctgcctcagcctcccgagtatctaggagtacagtgcataccaccacattcggccaagatctgtttttcaaaatgagatcttttaaaacataactaatctatttttttaaagatgaagattagaaaattagctgactttcatttgtaattcatcctactagtatttattaaacctgttacatggttctgtgctagatgctaaacagtacagtagtaaaaccaaatgtggatagtgctttttactttgcgaaacacactcgtgtatgatttctaggccctaaccccagagattgtcgttgagtacctctgggatgctcagtttcaaaagctccccggatgattctaatgtgcaaggagagaaaaacaaaacaaagtctttgggtaatttatctccataagtccctaacagtctcgtgaatttggtattcttatccctacctaaaaagggagtcagtagaggccgagggttgaacatcacccagctcgaccaggggaaggagtctgcccatcctatctaagcctactgctctgtcctgtcagtgtggttcatatttcccttttggatgcagatttctttttactcatgtctacctgtctttcccattaccaaaacctggtatgagtgtttcccttaaaaggaactaatttcatacaagttgtgatatattatgaaccattgtaaaccatatggttaatagtgaccctttgaagtatgtaattacaggggactttgatgttttacattttccattgatttatttttttctttcgcatcattcaaatgatattcactgatttttaaaaactttttgggcctttctgtttgtttgttttgagaccgagtctcactctgtcatccaggctggagtgcagtggtgccatcttggctcactgcaacttccgcctcctgggttcaagcgattctcgtgcctcatcctcctgagtagctgggattacaggtgtgcgccaccatgcccggctaatttttatatttttagtagagacaaggtttcaccatgttggccaggctggtctcgaactcctgacctcaagcgatccagccgcctcagcctcccaaagtgctgggattacaggcatgagccactgcgggcccagctcttttgtgtctttttatattatgtgcaagttctctttttttagtagtaagttgtgtcatttttgtattctgacctaaagttttaagaaaagaagttacggttccctgtagagatttttatcaaaatcaaggtgcgggattatttggaagagagaaggctgccagcaccagatactcaatcagtggccagtgaccagtgtgatgggggtaagattgtggtccagaaaaaaactacttcgtgtgtggagtggggcacctaaaaggttgcttaattgagctgtccccaccgccttcctaccctgccttccttgggcacactccccagtggttgtggaattaactccaggggacatgctctgataggataatgtccagaggaggaagagatagtctcttcctgtatatctccttttaagagtgaagaaacctttctcaaagcccaccagcataagacccctcaggtgtcactggatagaagtgtatcagatgcttctagccaaagcaagccttggcaaggggaatggtactgcctccacaggctttgacttctcagggcctgcttttggaagcatgtggccaggaggaggagggtgcagcctctaatcaggttgggcttatcagatggtgatacctcttactaaaaagaaaaagttgggcttggttggaaaagaaagctgtggatgttggtgagaacccagtgtctgctacaggggcattccctgtctgggaagttatgtagctgggatggctgaaagagaaagaagtaatttcttctgaagaaattatctgtgggttaaaagttagctggcaaaatggagacatctgagacatcacaatgcgtttgttagatctgggataatgctatcattttaaagggataatgctatccagaagagaatggctggaatggtgaagaatgtgaaaaatttgacatgacaggtgagtggactgtgagggagatatttcgcctagataagaaaatgtgacattagtggtggtagtaaggatcgttagtattttcacatattttatgctttgtctctggaaggctaagcatgtaacttgcttaggctgaagcaggctttttacccggagaggtgaactattagagcttttattttactctctttaattatgagcattccccacataggatagttaaacatgtaaaacagacccttatgtccagcccccagttttgttgaatcttaacatttctcatgtatgttttagccttaaaaaaaaaaacaaaaaaccactggatacggaaatataacattaccaataaaagcctcatttgaactttccagaagtaactcttgagttaggaatttacatttccattcatattttcattacatttgcttaggctgttattagagttgtaacacatatttatcaacacatagtgttaattatttgtgcatactgtgatgattttagaaggtaagaatgtcaagctgtttgagctgaaagtaaagatagccccttatcaggaaagtgccagccacccttgctgcttctacccactattgaaagcccttgagtatttttgagcttttcaaaatttaaaagtacacaaaagaaaaaaaaagctcagtgtgtttttgtaaatgaaacacttgtgtaactaccactgaggtcaagaaataaaacatggccagtatctcctttccttccttgctcaggagtaactgctcctctgactttatggtatcactttttgtatttccttatagtattacctcccatgcattcgtccctaaacactgtagttcagtttttctttctttttttttttttttagcttcatataagtggaatcattccgtatatatttttatgcatttggtctcattcactagacacatttttgacagccacgtgtattgagtgtagctgtggctcactcatttccgttgctgcatagtactccattatatgaataaaccacgcagtttgttctgctgttgatggacgtttgagttgtttccactttgaggttattaagataatgctgttctctgtgtggtttgccttttcactcttagtgatgtcttttgaagaagttcttaattttaatgtctaattttttagtcttgtcttttctttttctttttttgttatggtaggtgctttttgtatcctgtttgagaagtcttttcctaccctgaggatataacgatagtctcctatattgtcaatggggaactttatttttttgcctttcgcttttggagctataatttatctggatttttgtgtagaggtgaagttaagggccatttcatttctgtttttttccttatggatatctggcctgcaccatttattgtcaaggtcatcctttcccttctgctcggctctgtcacccttgtaatcaagtatctccctgtgcgtgaatctgttcctgggttctcccttctattccattgttctctttgtttatccttgcaccaactccacattgtcttaattattatataataagattttatatttactagatcaagcccttccttgcttgtcttgaatagcatcttagctcttcccttaacctttttcttttcacataaatttgccacattttaccaaaacagcttcttgttagaattttgcttttgctttgggtctatagtttaattgggggaaaattgacatttttcaaatacctagttttccaatccgggaacatgacatgtattttttttatttatttatttatttatttatttatttttgagacaggttgttgctctgtcacccaggctggagtgcagtggtgcagtctctgctcactgcaacctttgtctcccgggttcaagcgattcttctgcctcagccttctgagtagctgggattacaggcacccaccaccatgccaggctaatttttgtatttatagtagagatggggtttcaccatgttggtcaggctggtctcaaactcctgacctcagatgatcctcccgccttggcctaccaaagtgctgagattataggtgtgagccactacgcccggcccatgacatgtgttttatttaggccctctataattctgccttcaatgtttggtagatttctgcatagagatcttgtgtatcttttgttagatttattcatagtcatttgatcttttttatgctattataaatggcatctttaagattttttgttgttggtttgtgtgtttgtgaaaaatacaattgatatttttcagattgaccttgtatccagtaatcttgctaaacatgtatactaattataataatttatctgtaactttaaatttttctgagtatattctgtgaattgtgacagttctatttctttccattcaatccttgtaacttttatttctttttcttgctttgctgccccagctaaaatgttcagatagaaaagacaatagctagtgtcttagtctgacttctctcagagggaaactgtttttgcaatttatatgatactcgtagttttttggtagataccagaccctttatcggataaggaagagtttatattctaagtttgccaaagattcttgtcatgaatgaatgttgagtttttttcaaacatctttttttgccaagtataagatgatgatatgaatttaattttgagagtgcagtatgtaggaaactttgcattcctgaaatgaaccaaacttggtttattttctgcatttggtttgcaaaaattttgttcaggagttttgcctctttgctaataagtgagtttgacctgtaatttttctctttttgtaatatacttgtcaagttctgatttcaaagttaatagcctcctaagttttgggggaagagagcattgcctttattactattataattttttgagacggaatcttaccctgttgaccaggctggagtgcagtggtgtggtcttgtctcaacctttgcctcctgggttcaggtgcctcctgcctcagcctcctgagtagctgggattacaggcgccagccaccatgcctggctaatttttgtatttttagttgagatggggtttcaccatgttggccaggctggtctcaaactcctgacctcaagtgatccacccaccttggcctcccaaagtgctaggattacaggcatgagccaccgtgcccggccagacattttatttatacaggtgcttacagactgattaatttgaggtctaggctaatgtgtgttccagacaaaaattttcattctacctggagcctgaggacactagcaatccaggatcttactgtaagttcctggactgtgatgactgtaagctgaactctgtggagtcctgtcagtttctgatttatctttctttttttttttttttttgagatggagtcttgctttgttgcccaggctggagtgcagtggcgtgatctcggctcactgcaagctccgcctcccgggttcacgccattctcctgactcagcctcccaagtagctgggactacaggtgcccgccaccgtgcctggctaattttttttaatttttagtagagatggggtttcactgtgttagccaggatggtctcaatctcctgatccacctgcctcggcctcccaaagtgctgggattacaggcgtgagccaccacgtccggtcgttggatttatctttctagattcatatgctttgagctacaaactccaaacctttaagttctccaagttattacaaaaaatttagaaaatacagttttgaccaaaacaaaaaacaaacccccccaaaaacaaaagagtagattcccccttatgtgtgtataacccgttttttccttcatttaacatattgaataatttccaggtcattacatattttgtaacgtgtatagctttttttgggatcacacttgatggtttggggcttttgaacactctgcaattttaaatgtacaacattcatccctctaaataggtattcatgctgtgaatttggatttgagtaactaaactattgtatgaacattttgagttattgcatagggatgttgcctactagccagtgattggatatttgcagtagtattgaactgttacttgactattttaccctcattttataagggtgataaaaaggagggaaaatgtttattttattgataagcacatggtgataactggtgcttttttggtgtttttctaggtagtttctttgaacttatataaatgctcagtgggttcaattatgtggaaaaaaattaaggaatgcctataaaatgctggaaattttcaagggtgttttcccccctaaaacactggaagtaattgggatctgataaattattagcttgctagtagcagaatccccaaataacatgcatatgtttgtaacttgttcatgtttacagaaatataccttatgtgaaagtagaggactgcctattttgtaatttatttgattcttttataactgaacatgtatgtttctcattcttctctaatgtaaacagcatactgtggatatcttttaaaaaaaaatcattgtagctatatcccaaattggcatttaaaagaacctctggaaaggacttgatctaaaatggaagactttatggtaattggttcgtttgaggcttttcatagtcatcattattagcaaacatttatggaattgccatatgtagggcaccgtgacagaacaaataacaccatagctgaaggcactgtatggttcttaagatgatataataactagaaacttcttctgttggagagatggtagtcaacacttttccagtcttctcatacagattttattaatttagccttttaatttttattactcaaaacttcatttttttttttgtttgtttctgaggtggagttctgctcttgtcgcccaggctggagtacagtggcacgattttggctcactacaacctctgcctcccaggttcaagcgattctcctgcctcagcctcctgagcagctgggattacaggtgcccgccatcacgcccagctgatttttgtatttttagtagagacggggtttcaccatgttggccaggctggtcttgaactcttgacctcaggtgatccacccgcctcggcctcccaaagtgctgggattacaggcgtgagccacctcatccggtctcagtttttaatttaattttctgactctgtgcttgtgcttttaatactttcacactgattttctgcttctcaataaggaaagcacgtttgatctggtcacaaacacaaaacaaatggaaccactgtaggccccgatgccatgtgttttgttttgaataacctcataagaactcctggtctcccagcatgaagccctctaagtcagcctgggcacacgccactgcaggtgttggtgcatttgggacagcctagttttgttagaggctgtattgtaggaaagcctgtgacagtatgtcagactcattgcctatagacagcatccccagaaagagagaggggggaagcttttcatatacagatttttaaaatctaggttatctgttttcttactgatttatagtgtttccttccagatgttttacacatgtcagccacaagacataagcattttctaaattgaacagcctaaagtccacagatctttttgtgtatatggtaaaatgtacataacaaaatatattaaccactgaaacttttcttttctttttttttttttttttttttttttttgagacacggtctcacactgttgtccaggccagagtgcagtggcacaatcatagctcactagagcttcaacctcctgggctcaaatgactctcccacctcagcctcccaagtagctgggatcacaggcgttgagccatcatgcctgggtaattaaacattttttttgtggagatggggacttgctctcttgcccaagctggtcctgaactcgtggcctcaagcagtcctgccttggcctccccaagtgctgtgattgcaggtgtgggccaccaagccctgccttaaaacattttttttttgtggtaagaacacttaacatgagatctaaattttaagtgcacaatgcagtattgttaactgtagagaaaatgttatacagcaaatctctagaacttatgcatcttgcaaaacggaaactttatacctgttgaatagcaactgttttttcctcccttcagcctgtgtcagtgacagttctgtgaatttgattatgttagatatcccatataaggggaatcatgcagtacttgtctttttgtgacttgtttattttacttagcataatgtcctccaggttcatccatgttgttgaatgtggcagaatttacattttttttaaggctgaacaatattccattttatgtatatatcatattttccttatccattcatctctcgatggacatttaggttgtttccatgtcttggctattgtcagtaattctgcagtgaacatgggaatgcatatatctgtctgggataatgagtttaattcttttgctgtatacccaggtgtgagattgatagatcatatgataattctacttttaattttttaagaaccttcatactattttctatagtggctgcaccattttttcaccagcggcatacaggagttccgatttctcggccgggcgcggtgcctcacgcctgtaatcccagcactttgggaggccgaggcaggcggatcacgaggtcaggggatcgagaccatcctggctaacacggtgaaaccctgtctctactaaaaatacaaaaaattagccaggcgtggtggcgggtgcctgtagtcccagctactcgggaggctgaggcaggagaatggcgtgaacctgggaggtggagcttgcagtgagccgagattgcaccactgcactccagcctgggcgatagagcgagactccgtctcaaaaaaaaaaaaatgctttttctgcatcttttgagggtatcatattatttttgtccttcattctgttaatgtgatatgccacattttttggtttgtatgtgttaaaccattcttgcatcccagggataaatcccacttgatccaggtgtatgatcttattaatgtgttgtctgattcagtttgctagtattttgttgacatcctttgcgtctgtgattatcagggatattggcttatagtgttcttttttttgtagtgtcttaatcctattttgttattagggtaatgctggcttcatgggtggaaattaaacacacccttggtaaacagcagtcttaaccattgagccaaagaagaaatcaaatgggaaattagatgatgttttgaacgaatgaaaacacaacataccaaaacccttgggatgcagcaaaagcaccactgagagggaagtttatagcagtaaatgcctacattaaaaaaataagaaagatctcaaacagcctaattgtacacctcaaactagaaaaagaataagctaatcccaaagtgagcagaaggaggaaaataatttgcaacagaataaatgaaaacagaatagaaaaaaacaatagaaaaaaatcaaagaaagagttgggtttttgaaaagataagcaaaattgacaaacccttggctagactaagaaaaacagaagacacaaaatcagatatgaaagaggagacattacaattgataccatgaaaataaaaagtatcgtgagactattatgagcagttgtatgccaaaaaattggataacctagaagaaatgggtaaatttctaaaaacgtgcaaactaccaagactgaatcatgaagaaatagaaaacttgagcagatcagtaacaaataagaagattgagtcagtaatcaaaaacctcccaacaggctgagtgcggtggcttatgcctgtaatcccagcactttgggaggccgaggtgggttgatcacctgaggtcaggagtttgagaccagcttggccaacatggcgaaacgccgtctctactaaaaatacaaaaaaattagccaagcatggtggtaggtgtgtgtaatcccagctactccggaggctgaggcaggagaattgcttgaacctgggaggcagaggttgcagtgagctgagattgtgccagtgaactccagtctgggcaacagagcgagactccatctcaaaaaaaaaaccaaaaaacaaaacaaaacaaaaaaaacttcgaactaaggaaagctcaggaccagatgacttcactggagaattctactaaacattaaggaagaattaacactaatccttctcatagtcttccaaaatattgaagagggaacattttcattttaactgtttttaagtgtacaattcggtggcattaaggacatccacaacattgtgcaaccatccccgctgtccatttccagtactttttcatccaaacagaaaccctgtacccattagacactaactttctattcccctggatcccccagcccctggtgatctatgaatttgcctattctggggctcaagtaagtgaaatcataaaatatgtccttttgagtttggtgtatttagtatattttcaaggcttgtgcatcagaattccattccttttcgagactgagtaatattccattgtgcatatataccacattttgttcattcatctgttaatgggcacttgggatgtttctacctttggctactgtaaacaatgctgctatgaaaattggcgtacatgtagatatgggagtccctgctttcagttctttcggatatttactaagaagtgaaactgctggatcatatagtaattctgtgcttaaatttttgagaaattgccaaactgttttccacagtgactttactgttctccagtcccactgacagtggacaaaggttccaatttctccacatccttgccaacagttactttcctttttcaaataatagctatcctaatgggcgtggagcggtgtcttattgttttgatttgcatttctctaatagctagtgatgttgagtatcttttcatgttgaccatttttatatctttggaaaaatgtccgttgaagtctttggcccattttcgaattagattgttttgttgctattgttgaattgttggagttctttatatattctggatgttaattagatatgtgatttgtagatattttctgtcattctgcagtttgtgttttcactctcaatagtgtcctttgatgcacaaaagtttaactttgatgaattccagtttatctatttttttcttttgttgcctgtagttttggtgtcatttttaagaaatcgttgtgaaatataatgttatgaagcttttctcctaagtcttcttctaagctaagagttttatagtcttagctcttaagcttaggtctttgatccattttgagttcagttttgtatatggtttaaggtaagggtccagcttcactcttctgcaagttgctatccagtctctgcaacatttgttgcatccccattcaattgtcctggcagatcaattgaccaaacatgtgaggatttatttctgggctctctattccaaatgtctgtctttatgccaatatcacactgtttgattactgtagcttcgtagtaagttttgaaatcaggaagtatgagtcttccgtctcaagattgtgtgatttcatatgaattttaagatggatttttctgtttctgtgaaaaaacaaaacaaaaccctgttgggctattaagtattgcattgaatctgtagattgttttaggtagtcttgtcataacagtattgtcttctaaccctcaaatgccatagagctttaaagttaattattgtaaattagtaattaacagaatacaattacttttagtttacactatggcttttgagtgtaaggtgtttggtgaattttattcttttagagtaactgtcatcagcgtcctcactgtgatacctagtacgtaacctaaagttgaggttgaagacctgcagtctgcaggcagaatgtgacctgtccttgtgttttatttggctgttaccatttgaccttccttgtgtcttaaattcaaagtaaatatattcatttccaaagatcatgggttttaatataaaaattccgctctggttttaaagaaattagaacatctggcagcaggggctaagtagtggcagccccgcttcagttggtgaagagagcctgtggtctcttcgagggggctgagtatgggtctccattttggtcttaccctctagctccccattccctgtctgtgatgtagaggcagttgagttttcaacctttgttgaaaacgaggaaaagagaacattggtttgaaatgatcttttgtagtaaatatttaacaccatggcaggtttcaagtgaaccaaaaaccacatttcatagcagaatggccctgcgattggttggactccaccctgccccttatcctcttctgaagaggctttctgtgtaatactgtagaatgtttttccgtctagccacttcctattagaagaatgattatttgcggcttgattagcttcctcaggatctacattaaaaaaaatcctgctgggctattgttttgcaagattaatcttgtgaattgataaaagtcattgaaactcaatgttggttagtgttgtttttaaacaataggaatagtattcaggacagattaaaatcagattaaaatattttaagtattgcttttaaaagattaaatacagagcacagactcaagcctgataagctcccagccaaacagtttttacatgtagttttccctgtgtatgtgtagtcagtgaagatgctgaacttgtcacaaaatgtggatgcatgaggcatattattgtaacttgaattcagatggccccaaaattaccccattcactcagcataattggttaaacttggtctgggtgatatctgtaagtcatcaaaggaaggaattttaggacaaggaaaggatggtttgattgttccaggggggaaaaaaccataaaattttaagaaaatcattgttcagggaaggctgcaagcactggtaaggaaacagagttttccaataagttaactgaaatcgggagtaacagacctctgaagagtctatctttgggaaaatctctgacttcattcttgacatgattgaggacttcatgtacaatgaattagcaatgcgaatcatctaggcatataaactggaaggaaataagaaggtttgtagagcaagcaacaccagatactcatgcttgctccagagaagttttccaggaaaagcaaatgtcatcttctctctctgcttcactaactttaaattttgagacctcaggcagtctagtccatgaagaaaacactccagaatgaccgagatacttaagtttttaacaacatttaaaataatatgaaaaataaaataaaatgttgttaaaaacttaagtatctcagtcataatttgtgtccttttttttcttttgatatttgttcagaaatagactcccaacttataatattaataatatacctgtagaaaatagggacggccttctttttttcacattgcacagtctcccccaggtggttctgcctaatctctaggcttaaaattcttccagcctggtaatgaatagaaaatccttacttccagctcacgttaccctctggaatgcccatcctctatttttgtctggtggacaaaaaacgcggcacttggtaagctgtgagtccttccagtatgatgccactcaaaactgaagtttatcagtctccaatcctcagccccctccctaccacccgtccaatttctttggctgttagccttgccattctcccagttgtcagaattagaaagctggactcattccaatccttccttcatgtcccctgtccaagtatttctcatctgtcactttcctattcacactgctcctgcctttgttcatcatcttttgcctggatgaatgcagtggcttcctaactggtctcctttctatacttcatctttcctgatcacaccctcctaccttccaaagtatgcatagcagggtcatgcacacgctggaagggagcccaagcacactttccttggagaagagttctgaaggctcagcccctcatcctccgtagctgtcgctctcctgtgccaagtccgtgcatgcctctgttacagctcttctcagttgcagcatgctcactgtctccatgtcctcacctcacattcacagcgtgcaccttacattgtaatcctgtttctctacatctggatcctgtctcagagtatatatgctccctaaatacacatgttgagtcttgtttacccagtgtgtttgtttgctagagctgctgtaacaaagatgccacaaatggagtgacttaagcaacagaaatttattgtttcacttttctggttttctggaggctagaagtcccagttcaaggtgttagcaggactggactccttctgaaggcactaacaaagggcctgttccaggcctcgctcttggcttttggcagcgtaactccatcttcacgtggcgctccctctgtgtgcatgcatgtctgtctgttcacatttcgccttctcagaaggacaccagtcatattggattaagggcccaccctgctccagtatgacctcctcccacttacatcagcagtgaccatatttccaaataaggtcacattcagaggtatttggggctaggatttcagtaaatgaaatttgaggccctattcaacctataagacccagtggctagtgtgttgactgacataactgtaaagtaatcaagtgaaatgatctttgaataaagggtcagaattttattttcttcaaagttatgtttatgacaaataaaagcttatgatcttgggaatactttcccatctctagttttccagtatattcatagtagctgttgaattgttgcgcgtcaaaagatgctggtggagtattctagttctagctctgtctttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacattttgcaccgcccttaatccatttaaccctgagtggacacagcacatgtttcagggagcacagggttgggggtaaggtcacagatcaacaggatcccaaggcagaggaatttttcttagtgcagaacaaaatgaaaagtctcccatgtctacttctttctacacagacacggcaaccatccgatttctcaatcccttccccacctttcctgcccctccactccacaaagccgccattgtcatcctggcccgctctcaatgagccgttgggcacacctcccagacggggtggtggccgggcagaggggctcctcacctcccagtaggggcggccgggcagaggcgcccctcacctcccggacggggcggttggccgggcgggggggctgaccccccccatctccctcccggacggggcggctggccgggcggggggccgacacccccacctccctcccggacggggcggctggccgggcggggggccgacccccccacctccctcccggacggggcggctggccgggcggggggccgacacccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggccgggcaggggggctgaccccccccacctccctcccgcacggggcggctggccgggcggggggctgacccccccacctccctcccggacggggcggctggccgggcggggggctgacacccccacctccctcccggacggggcggctggccgggcggggggccgacccccctacctccctcccggatggggcggctggccgggcagaggggctcctcacttcccagtaggggcggccgggcagaggcgcccctcacctcccagacggggcggctggccgggcggagggctgacccccccacctccctcccggacagggcggctggccgggcggggggctgacccccccacctccctcccggacggggcggctggccgggtgggggggctgacccccccatctccctcccagacggggtggctggccgggctgaggggctcctcacttcccagtaggggcggccgggcagaggcgcccctcacctcccggacggggcggctggccgggcggggggctgacccccccacctccctcccggacggcacggctggccaggcggggggctgaaccccccacctccctcccggatggggcggctggtcgggcggggggctgacccccccccacctccctcccggacggggtggctgccgggtggagacgctcctcacttcccagatggggtggctgccgggcggagaggctcctcacttctcagacggggcagctgccgggcggaggggctcctcacttctcagacggggcggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggcggggcagagacgctcctcacttcctagatgtgatggcggctgggaagaggcgctcctcacttcctagatgggatggcggctgggcggagacgctcctcactttccagactgggcagccaggcagaggggctcctcacatcccagatgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccagtcaggcgtggcggcgcgtgcctgcaatcgcaggcattgggcagactgaggcaggagaatcaggcagggaggttgcagtgagccgagatggcagcagtacagtccagcttcagctccgcatgagagggagaccgtggggggagggagggggagggggagggagagggagctctgtcttgatgatagaataccacttagtttgcaatacagttaacgtatgaataaactaacaaagaacaggaagggagagatgcctatgaaatcttgaagatggcaaacagactgagccagcaaatcagaaaaggctgagacctcatcttagccgggaggagccaagtaaaagcaacctcatttgcagagcaaactcagatctgagagatagaaagcaccagggcctctgaagacatgctgaggccccaggggacatagatgaaactaaatgtgagcatttagccccctgaatacccctccctacctggcagtctaggaaaagacttgaggtttacttggggagagtgggcccagcagaaggtgagggactgagcagtgaaagtctccctaaccaggcccggggcagagaactgactgaaggattcctccctggagaggcaaaggccgctcttgaccttgtgcatgtgcaggaaacttccagaaacttccaaccatcttcttagtgttcccttcttaaatgtgaattagatggcttaggatcaccaaagacttcaggaacaccttgaacatgaacgagaacaaaacaagaagaaaaagcaacttgaaggcaatgtagggaatagacaaagacaagttcttacctcaaaggagagaagagggggcataacatctatgaagtaattgtttgaaatttaaagacgttcagataacaaagggttcttggaaattagaaatgtggaagcagaactaagaccccagtagaaatcttccagaaggagaaaacaaaaagaaactagaaaagataagtagaaggtcaatctaggaggtctaagagataactaatgagaatttcagaaagagaatagcagaaacacaggactgtgtgtgtccaggccaacagggccactgagagctcaggccagtgagtgatgaaaagagcacaccaagacatgttaggttgaaagttcagaataccagagattgggaaaatcttggaacttttattttttatttatttttttttttgagacagggtctcactttgttgctcaggctggagtggagtggcatgatctcacgtcaccgcaacctccgcctccctggttcaagctatgctcctgcctcagcctcccgcgtagctggaattacaggcatgtgccaccacgtctggctaattttttttgtatttttagtagagacagggtttcaccatgttagccaggatgatcttgatctcctgacctcgtgatccgcctgccttggcctctcaaagtgctgggattacaggcgtgagccaccactcccggccgtatttttttttttttttttttttttgagacggagtttctctcttgtagcccaggctggagtgcaatggggcgatcttggctcaccacaacttctgcctcccgggtttaagcgattctccttcctcagcctcccaagtaactgggattacaggcatgcgccaccatgcccagctaattttgtagttttagtagagacggggtttctccatgttggtcaggctgttctcgaactcccaacctcaggtgatctgcctgccttggcctcccaaagtgctgggattacaggtgtgagccacagtgcctggcctaatttttgtatttttagtagagatgaggttttacgatgttggccaggctggtcttgaattcttgacctcaaatgatccactcacctcggcctcccaaagtgctgggattacagacgtgagccaccgcacctggccgggatttacttctatatgtaaaaaaacccagacctgcacaaaggattgggaagattggctttagatttatcaatagcagtgctgaaagctagaagacctcaaattctgagggaaattatttccagcctttaatttagcgttcatccaaattattgacaagacgtgtacataaaataaaaacctttttgggatctgtcatgtttgaattttccattcacacaccctttcttaggaagctatggagcactgtgagccactaaaacaggaagttgagaaagagggaagtactgagtcaaaaccaaagaaaggggaaggaattttcaggactcatgagagctgtgccgaggcagagagagtaactggtccagatgaagcagggaaatggagggccagaggagggatgcattctagaaaggagggactgaaaccagtgggtcagctagtgtgtctgactacactgaagggaattttactgatcttttctgacaatttcagggagaattggtagtcaatgcaatgcgtgtgaaaccaagcaagtaaaagaagatgcagttgcttactctaatggggaaatagatgcctagaaaggaattgtaatcacagtacgcttttatgttataatgagatagaccagatgcgtggttcacacctgtagtcccagctctttgggaggctgaggcggaaggattgcctaacaccagtaagattctgtctctacaaaaaagtaatgaaaattagctggatgtggtgtggcatgtctgtagttacaactactcgggaggctgaggccggaggattgcttgagtgcaggagtttgagactgcagtgacctatcattgcaccactgcactccagtttgggtgacagagagagacctttctttaaaagtaataattacaatggaaatgaagtattgatttgaccatgggacaagtgggtggatgggtgtagggtttggcagtttaagaattaaaaacattggaggataatatctggactgaaaagatacagaaataaaacatgttgtgtagaaatgtggagataaagagcaggtggaaggcctgatagctgtggaagcacagtctctgcagagcaggctccacttgggtggaagctgtccttctcgtgtgagctctagccttgtactgtgtggcttctcaaactgtgtgcttggagtcacttgacaaaaattaaaattaagagaatggaaacttgccatcttgcataagtttttttgtcatttaatttgtcaacttttagtaggtctccttgtatggagactagtacactgttgatttagaaatacctgcaggttgatactagtttagtgcagtatcttgaagaaaccaagagcatagactttagagtcagttgtttacttgggtataaatgatgagctactgcatgctaggggctgttcccagataacagtggttaggaaaatacatgaggcctctccccttgacgaagtcacattctagtgatgggagatggacactgcagatgaatgagcaaggtcgtttcagattgcttgagagagataaaacctggaatgggttggaggagaaggccttccacggaatgcccctttgagcagagtcctgagggtgagaccaccacacttgcttgggaacagcaggggaaggcttcgagttctgggagttcattagaattcaggacagtcatcctcaacaagagaggacagttggccttgaggtgagacagaccctggcttgtgacatcaagggtggtgctggactggagggatgctggagtgtggcaggggctgcatcatggtgggccttgcaagccacattagccactctgaattctctggaatagaagagcagtgtgttctgccttgaggtgattcagagtgctgggtagagactggatcctggagggctcccagtgcccacctgacaagtagtacaaaagtgctgttgaggctgggccctgtggctcatgcctgtaatcccaacaccttgggaggctgaggctggggaattgcatgagacttggagtttgagaccagcctgggcaatatagcgagacctcatctctgcaaaacatttaaaaattagccaggtgtggtgctgcacgtctgtggtctcagctcctcagaaggccaaggcaggaggatcacttgagcctggaagttcaaggttataatcagccgtgattgcaccactgaactccagcctgggtgacagagcaagaccctgtctctaaaaaataccaaaaaaggtgctgttgtattttacaccatgcaggttcatgtgtgcttacacacacgtttatattccttttattcattctttttactcgagggtagcttttcctgctgtcgtttatgcatttattagtagttaggtggtttgaaccccagaaggttaactaatagccagtgcagcaagcagtaaatatactgactagtggctcatacttgctttattacttcagttttttaaattgttgataattacaataatgcacatgggcatgggtccaagacaggaagaattattgtctgcaagcagatctgctgtaagctggtaatacagtctgatttacttttaaatttaaatgccacataaatcacaggaaagatgtcttttaacttgctttgaatttggaaagggtagagcactttcgtatttttgttattttcatggttttaatgggcattagaagttaaattgatttgttatatccagattgatatctgagtgttgtgtgcacctaataaaatgtttagcggaatgactatagaaatttgtatttaaagtgtaaagtttctctctccctgccctgtgaaaatcattttggcaaattgtcagattttcttgttataagcaaagatatgggttattcacccaagaatttcatgcctttcagcatagcagaaccttagaaatttaaggaccaggtatggcgactcatgcctgtaattctaacactttgggaggccaaggagggaggattgtttgaggctgggagtacaagaccagcctgggcaatatagtgggaccccgtctctgcaaaaaatgtttgtttaattagccgggtgtagtggtgtgtgactgtagtccctgctacttgtggggctgaggtgggaggattgcttgatcctgggaggttgaggctgcagtgagctccagcctgggcgacagagtgaaactctggctcagaaacaacaacaacaaaatacccacaagaaaaacctaaacctgtgatttccagtgtttggtttttatggaataatggaactaagaaaaatgttttaaatagataaggttgttcttggttaatattacagaagaataatttttaaaaagcagctacctgttgattgttgccatcattttatgaaaccattttaataacaaaaggtagaagataatgttagaattcaggacagttattcttcagcaaggaccattagcagttctgtacccttacgcgtggatgtgtgcacaacacatgcacactagacctttcttaggtttctcatttttcaggggggccactggaaaccttttgtagaccctgttagtcccctagtggatgctggggacccctccctgctttaaaacactggcaaaaatcatcatatatattaaaacatggatatttggccgggcgcggtggctcacgcctgtaatcccagcactttgggaggctgaggtgggcggatcatgaggtcaggagatggagaccatcctggccaacacggtgaaaccccatctctactaaaaatacaaaaattagccgggtgtggtggcacgtgcctgtaatcccagctacttgggaggctgaggcaggagaattgctagaacccgggagtcggaggttgcagtgagctgagatcacaccgctgcattccagcctggtgacagagggagactccgtctcaaaaaaaaaaaaaaagatgttttcagttgcatgaatttgttttcttattttttcccagatacgttaaaggaaaagagatctagtgaagtcaatttcagatctctgacattggttattcatgtttgtggttttaacctcttgaagtcagttacagcatttcagccaaagctggcatgttggatagtttctcaacttagccttggtaaaatcactaattcaagtgtttatttagtgaaatagttggtcagaaaaatggaatattttaaaaagaagtgtaattttttacaagtacatgaaatactcaaactatgcttaatctgatttttagtgactggcttaatgcatataaaaacaaagtatatatcatagagtaccaggtcagccagaggaagcttataatttctgagagtattgccaggtttgtgcttggatattctacagaaaacccttcatcatttgtattatttctgtcatctgaatcaataagaatgatttagaataaacatattttattattaatatttaatgagtagtacttctgagtgttacttgaaatcatttcactcttttaaggtttagaaaacatatccttctacatccccccacccctgctctgcacgtactagtcagcacactcttaataactgcctaagtaatgctggccagtgagttcaaatgttaagcccaacttcacaccatttagatcatcttatattaattctgaggcctcctgccttcctgacctctgcagttagcatgcctgacaaagtatgagaaatgtctggtttgctttggagtcacagtgaattctgacttagtgagggaggccatcttcatttctaagccatgtttctcctgcatggggagttttaggaaaatagagttccatctgttatagtgtgaaaaaaagttaatattgtaggtgtctcatttaataactaaactttgagtagcaccctatttatgttgcacaaaagtgaaaactaaggtcaagagagattaaataacttccatgagattacatagcaaggaagcagaatgtccatcaggaaaaccagtttagaaaaataatttacatagtgctcttctgatcacagaagtgttttgatagttgcagattcatcttgacttcacttccaagtcccggaagctgggctagagccaggaagtcagcaactcttggccattttcttttaaatgtattaaatcattcatctaaacgtttggtgactgaattcccacaaaatatgaagcattaatgcaacctgctttcctcatgtccatagttaatgtgtgaagaaggaatgtgcactcttttaaacccatttcatgccatcctggatttgggaaggatggccagtcatgtggggactttgtggcctcttcccttgtgcacctcgggttcaagccccagttctgcgcaattgcagccagagagtggaaagagccagcctgatgatgatggtgatgctaacgtgcttgctctgcggcaggcattgtgctcagtggttctgcgtgttattttaatcgaatcctcacaacaggcctgagccgtcggtatgttaataaccctgttttgtagattaaaaaattaaaacctggtaataatgaaagctcccaatgcttgaagagcgcttctatgtgacaaacacttttcaaacacttaacatatattaactcatttaaacgtcagagcagcactgatgtgtagttattattgtcattaccttatagatgacgaaagtgaagcccagagaggctaggtgacctgccagagttggcacagccagtcagtgatggaggtggaactctgtcatggtgtgtctgcgccttaaagccacactcttggtctttctcccaggtcagtagtacagtgagtagaagagtaatggttggccgaggccagtccctagtgtctccataccccctggaaataagtttcatggacttcctattttataatgggcaatcagaaaaaaaacacagggactgatgaagaacctgttcatttgagaatttcaggtgtgtaaacactgttctgcgtggttttttttttacatgaaagtattttatgtatttgtatattttgaaaaaacttcccttagctctcatgtcagagacacatactgaaagacagacctctattaaatcatgatgtttggctccttaccactataatccagatggacaaattaccatgtttccataaaaagcgttggagacagcctaaaccattttcaatcttggaaatgatacctcatttatactttaatatttaaagctctaataaaagctggagttatttgtataaattactgtctgtgaaaataatacctaacagccggcatatgtcactgtaagaataatgtctttttacacttggagttttccccctacacccagttcaccagtttctaattagaattaagtttaaatgttaaaaaatcaaaagaccaagaattttccattcatgtaatgcaaactctaaataataggttttttcattttactgctatacaaccggaaaatgcttaacaagaatcctgctattttattagatagtggtttgaagcttcacttctctgctgctgaaaaagatactcttaaagtttcaaactgtggtcactgtttggacagtaaaaaaaaaatgtggcatttcttacacattaggctctgggtcagaatcgtgatagtcttccaattgcagaaaaatagaatttaatatgtgtacaatggggctttactgtattaggatgtgtacccgtgtgttttgttgttgttgttgttttttgagatggagtctcgctctgtcgcccaggcggaatgcagtggcgtgatctcggctcactgcaagctccgcctcctggtgggttcatgccattctcctgcctcagcctcccgagtagctgggactacaggtgcccgccaccgcgcccagctaattttttgtatttttttttttttagtagagacagggtttcaccgtgttagccaggatggtctcggtctcctgacctcgtgatccgcccacctcggcctcccaaagtgctgagattataggcgtgagccatcgcgcccagcccgtgtgtttagaataatacacttttcaggtattgagcctgttccgattttacttactagttgtgctacctcaaattgtgtgttctctttttgacagatgagactcttaatattgaaacgatgcattccagattgaaatctaggcatataataagcagaattcaaaaacactgtattttgaacaaattttagactttaaaaaaagttgcaaaaatactacaagagttcccctatactgtaaccctgtttcccttaatgttgacatcttgcataactcgtaatgcgatgatcaaaaccaggaggtttgcactggcacagcactgttaactgacttacagaccttattcaaataattgctgcagtttttccactaatgtccttttcctgttccgggatcctgtccaggcgcctgcattgcatttacttgtcatttctgcttagtcttctcagatctgttgcagtccccggtctttcctgatcagcaccctcaaatgtctcattgtggatgagattaatgtaggtgtctgatgtgtgtctctgctctcaagtaattgttttcccttttgtagctaatatctttggggagataccttgaaaggatactgagaacagaatttttttttttcacttcgttcagtttagtaaatctttggtgaaggttcatgaacataaatttgttctaatttgtgaaccttgaagtacttcagcgcttgaacaaatatgaatgaaaataatatataggattttcgtatcttttaacagatggtccttttttactgacttttccttaaaaaaggtttttgaacaagagcgtcgtacctttcgctatcagtagtttgctagtggtaactagatgcctcgaaggcctgcttcattccgcgtttattagaactagaactgtgttacattgccttcgcagggtgaaacttgaatactcgtgtgtctcataaagccggattcctttcaaagagacctgattcttccactagtgggatcaaaccatgttcatgggaagatgctccctctatggcaggcaccttcagaagccctgcagccagatttgatcctggaatagtagcttcaatgagggcagagataactgggtgtgcacgtttgctttggagtgagaggactgcctggtcctgagggctttgtgaagggaggtaggcttagatgagcccaggagttgcatcacttgaggtgattaaaggccctgatttaaagtaggttgagacttagatttatttagatttacatatttatttccttaagccatttcaggttttcgaccaagttactagaagcactttttaccaagttgaatttctgtccttggattgctaaactgttccccaagccaaattaataaaatggaatttcttattaagaatgaattattaagcaaaatggaagtgctgggctagggaagcagttgatgcaatttgttttccaagccttaaaagtgctgcagtatgcatagatcacaaggactggcttcagtgccaacacatggggcattaatttttttggtagaggattccaggtttacaggatatcagaagtgctgacttggcagcaaaatcccatttgtaacatgttagattaggaaacagattgatttatatgttgatgtaatggatcaaggcacagtctgtgcttaaggaaatggacagcacattaaataagggcattttcaaggtagaagtacaaacattacagaaaaaattagccttttacaccctaggtagggttggggtatgtttgattagttgactcctaaaacatggtccacagaggctttttatatttccgatgataccttcttgagagtctcttaagaccacaaggattaatctttctgaactcaaaagtgaatcactacagcatattagctgtctggattgattccagtttctctgctttttcttggtggtaactgatgtgaggatctgttggtgcttagctgcctcttcctgttgctttaacctctggtattttaagattctctttagggaagatagtactgaccatctcagcacagagccgaaatgcacttagcgctgatgtgttgaccttagtggttgacccataaactgaacatttatacagttggaactcttgcggtcttttagccaacaaccataatgagtaacatgtggaacataatctttggtgctgataaatggctttttacgatgaaattgaccattccacgctgtggcttgggtgacctcatgtaactaattactgtttcttagctatattcacttttggaatttaaggggtaaatggtttctccttctgcaggctgaactgctgacagattaaataccacctgaaatctgatttgtttagtagctgtctttaatgtaaaaatatagaaggccagagggaatctaggaaacactgctcagaagctttcagacttaactataggagttcattcgtagcaggtttaggaagcacattccttccgacctgtagattgggcttttcatatacgtatttatcatgtcttcttggattttcttcatttaattctatctgaactttcgaagtgggaagcaaaggattcgggggagagcactggtttcagtacacgaaaatatccctggggtttccttacctttatctttggatatccccatttttctcgacacacaatccaagtttctagccataatccttagattacaaaagaacaggacttttggtacacatctttttttttttttttttttttttttttgagacagattctctgtctctgttgcccagtctggagtgcagtggcgcaatctcggcttcactgcaacctctgcctcctgggttcaagcgattctagtgtctcagcctcccaagtagctaggaccataggcacgcgcccccatgcctggctaatttttgtatttttagtagagacagggtttcaccatgttggccaggctggtctcgagctcctgacctcagatatccacctgcctcagcctcccaaagtgctgggattacaggtgtgagccaccgtgccgggcttggtatgcatcttgaactaagtgtgaagattaagcacatctgtcttgtgcatcctttataccttttaatgatttgtttgaattaagcaccactagagtattacctatgaataggtgtgtgttccttcctacacatatctttaggtgttttttccttctttgggggaagcaggaactcatattagtctgtagcttcacgtgcattcatactgaaggcatagggccttctactttaataaatgaatattcgttccagcagggtaaagtcaattctagttaataaaggtgctaattgtttgttgggtttaactgaggtgtttttcagccctgatagatattggcaacattttaattccaaattagctttctcccagctgtccaacaagggttggtgcttccttctcttatactagtagaaagcaggttcattttaataagcttcgaagcaaaacatatgtcagatggtaaattggtcctggaaaaagaccataatatatttcacaatcaaatttaagttactgattagaaggattgttcatgtctgtgtagttcatcagcataaataaattaaagtttcctagaaaatcatacattttccacatattttaaaagtcagctaggcgtagtatctcatgcttaggatcccagtcctttgggaggtcaaggcagaaggatcacttgagcccaagagtttgagaccagcgtgggcaacacaatgagaccccatctctaccaaaatataaatacgtgtatactgggtgtgatggcgcatgcctgtggtccctgctactcaggagattaaggctggaggatggcttgagcccagggggtcgagactgtaatgagctgagattgccccattgcactccacgtgggtgacagagcaagaccctgtctcaaaaaaaaaagggtgggggcatcaaagctaccctttcttgttagtaggaaaaccatgtcatgtatatgctgtttttgaaaagaacaacatggtagaccatataatctaaccctcctcctctacaagttttaacttaagaactgttatttgtttatttattttaattttgaagaaagttttgcagttggggactcttatggctataaccacgagtaatggatgtttttagagagatgcctgtgcttgtctctctctttctctctctctctccctgtctttctgtctgctttttttttttttttttttgagatggagtttcgctcttgttgcccaggctggagtgcaatggtgtgatctctgctcaccgcaacatctgcctcccgggtccaggcagttctcctgcctcagcctcctgagtagctgggactacaggcatgtgccaccacacccggctaattttgtatttttagtagagatggggtttgtccatgttggtcagtctggtctcgaactcccgacctcaggtgatctgcctgccttggcctcccaaagtgctgagattacagatgtgagcccccacgcccggccgatgcctgtgcttttctcgtgcatgtctgcaggagccttgctgttgtaatgttacttctcagctatagcttctgagctgttaatggttagactgcacataaaaggatatgggccaaagacagatcttatggaatagttgattatttttacccaacatgagagaaaattgttcatgaaatcccctttagtgttctgtgtttatgaatgatgccatcacattttgaatcatgggagccaaacttgaaccttcctcttcctcatccctcatatcagttatcacacctaggcctattttaggctctgtggtttcttgaatctctctatccaccactccaccttagcccaagctaccatttattcctctcttggaatgtgcacctccagtgtcctgaatgatttccctgcatacactcatttcctttcagtcggttcttcaccgtgcaactagagaaagcatcagagctttgttatgaaaatagtaactttctgcttaaagcctctcaacacttcagtggtaaggactgaagtcctttcttggtctgcagactcttgtcccggcatgcctctcccaccatctctctgcctcaaaatcaacattgcctccatatgggatgcttaaagcgctactcagctgtcactctctttaggaagcttccttgatcagcttcctacccaagcttaggtcagattcctttttttttttgagatttgagtcttgctctcttgcctaggctggagtgcaattgtgcaatctcggctcactgcaacctctgcctcccgggttcaagcagttttcctgcctcagccccctgagtagctgtgattaccggcatccgccaccacgcctggctaatttgtgtatttttagtagggacggggttttgccatgttggacaggctggtctcgaactctcgacctcgtgatctgcctgccttggcctcccaaaatggtaggattacaggtgtgagccaccgcgcccggcccagattccttttttatgtgctttctcaacactgtgttcttttccttcttaagacatttgggaatgtggtcacactttttgtgagttttaactcttgcattagagccccaagaaagcaggtcatgacttttttgcccactcttatatcctaaacacttagcatgttgctttgcgaaatagtagttgctcagaaaattttcttttgtgggtaaattaagtaaaattattggaattttagtaattctccactttcatgatttggtgtgtgcaaaggattagaaagtagattagcttttacgaggacagactgcagttggattatatgttctaaagttagaagtatcccagatggggattgagggttagatttttcctttgcctaagtctcaggatacaaaatcaatgtgcaaaaatcacaagcattcctatacaccaataacagacagagagccaaatcgtgagtgaactcccattcacaattgcttcaaagagaacaaaatacctgggaatccaacttacaagggatgtgaaggacctcttcaaggagaactagaaaccactgctcaatgaaataaaagaggacacaaacaaatggaagaacattccatgctcatggataggaagaatcaatattgtgaaaatggccatactgcccaaggtaatttgtagattcagtgccatccccatcaagctaccaatgactttcttcacagaattggaaaaaactactttaaagttcatatggaaccaaaaaagagcccgcgttgccaagtcaatcctaagccaaaagaacaaagctggaggcatcacgctacctgacttcaaactatacttcaatgctacagtaagcaaaacagcatggtactggtaccaaagcagaaatacagaccgatggaacagaacagagccctcagaaataacaccacacatctaaaaccatctgatctttgacaaacctgacaaaaacaagaaattgggaaaggattccctatttaataaatggtgctgggaaaactggctagccatatgtagaaagctgaaactggattccttccttacaccttatacaaaaattaattcaagatggattaaagacttaaatgttagacttaaaaccataaaaaccccagaagaaaacctaggcaataccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaaccttgggagaaaatttttacagtctacccatctgacaaagggctaatatccagaatctacaaataacttaaacaaatttacaagaaaaaatcaaccccatcaacaagtgggctaaggatatgaacagacacttctcaaaagaagacatttatgcagccaacagacacatgaagaaatgctcatcatcactggccatcagagaaatgcaaatcaaaaccacaatgagataccatctcataccagttagaatggcagtcattaaaaagtcaggaaacaacaggtgctggagaggatgtggagaaataggaacacttttacactgttggtgggactctaaactagttcaaccattgtagaagacagtgtggtgattcctcaaggatctagaactagaaataccatttggcccagccatcccattactcggtatgtacccaatggattataaatcatgctgctataaagacacatgcacacatatgttcattgcagcactattcacaatagcaaagacttggaaccaacccaaatgtccatcaatgatagactggattaaggagatggcacataccatggaatactatgcagccataaaaaggttgagttcatgtcctttgtagggacctggatgaagctggaaagcatcattctgagcaaactatcgcaaggacagaagaccaaacaccgcatgttctcactcataggtgggaattgaacaatgagaacacttggacacagggtggggaacatcacacactggggcctgtcgtggggtggggagaggggggagggatagcattaggagatatacctaatgtaaatgacaagttaatgggtgcagcacaccaacatggcacatgtctacctgtgtaacaaacctgcacgttgtgcacatgttccctagaacttaaaatataataaataaaataaataaaaaagttttttcctttgcctttcactttgatcatacacatccagaagtcactttttattctgttctagctcctgggaaaaggatttgtttgtgaagatacaaatagtaaataattaaggtttttaaaagatgcattctgtcacatagacctgaatgactgttgcctctgtgctagccttcttggagtaaacctgcaatttttttccctttggtaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggaggtaagagtgttgccagtaagttgaaagtgttatttttctggggcagggttgaatctgtttaccttagaaatagatattctgtcattctcttttgacctaagaccaagatgctaatgactggagccccaagccttttgtttctaaatgtgtggcatgactgagacctctcaaaggctttgcctgcgtgttctgtgagctctcagttctttaaggaagggatactgcagaagcctggcaagtgccatgggagtgcagcctgcttctcatcctcccacttgtcttggaagatggaaaacaaaacatgtctccttactgacagaaagccaccagtattgtaaaggatcatctcaggtctgattcaactctgtgttaaagagaaaatgataggagatgttataacttgtatttattttttctgatagagacagggtcttgctacattggccagggtactctcaaactcctggcctcaagccatcctccccagcctcccaaagtgctgggattataggcatcagccaccacttcttaccaagatgagcagacagggccagggtcaagttctgtaatttcattgacagatgtttccatagacttgcctcacggagccatcagttcaacagctaccctacaagcaaacttgacatctcatgaatttgttttgggctaaaagcgtgctgcttttgtttgtccttaaatacatatcccttttgaaaacagaatgcgtggaagtgttcagaaatctaacctgtcaaaactaatacagtatctttttgtttgatgacttcagttagagccagggataatggagtggaactttagatgtatgtaggataagggtggaggctgaataaacttagacactccatccttacttgcaagtgtgtgtctgtctgcagattgatttattgtgtgtgtgtttgttttcttaacagatgtatccagagctacagatcacaaatgtgatggaggcaaaccagcgggttagtattgacaactggtgccggagggacaaaaagcaatgcaagagtcgctttgttacacctttcaagtgtctcggtgagtgttcttggttacttttcaggaagtgccagccccctcccattttaaatttaattttctcttggctcacagtgaaatatttacacctgttaagaagctgagtgtgacatgaatttattggggaggatttctcttaggggtgtttgctggcttcgagtgtcagtggttgacctcctctcagtgatggctaactctgccttcccattgtagacatccttcctcaggactgaataagggtgctacccacagagcaattgcacttacgccctcacattgtttgatatcagtggtttatggtgatagtgctgagtagtattaaagcaagcagccccaggagaagagtcttctgtttcccttactttcatcccacacacgtttgcaccatttgaccaaatttctgctagttttcaggagaaagaaaagtgacttatggcagcctgtggacagtcaagggtaccggggccagggcttataggacctgccattctgaagggtttggggctggtaggggtgttcgtgactctgtgttgctggtgtcaacattcagagccaatttgagtaaaacggtaactgtttgttatgcagaaacagagttgttgcttcaaatgctcagggaatatattcattttaactatttgtgcctgatacattggaattacactcacatatctgtggtctggtgattcaggaacagatttggtcacagaaacttcaaagggcaaaaaaaaatcaattttagattagccctgatgggattaaagtagatacagcattaatgtagacatcctgagtggttctgtagctatatgtaattggaactattaacttattctcctctctcccttctgtaaaacctttccttctgcttctgatggcagcaaaatggaatgtgatactttttctcattctcacgtgtagccaagccacaggaagaagcggtgcccctgaacaacagtgtttaaaatgtgtggcagttaactttcttttaaaatattcgtgaggagcaagaggggcgtcatgtgtgcttaccaccgtttactttaaacctgggcatctcaaggctgggaggcttgttaaaaatgttgtgtggtgtggtttaaggacgctttctgttctgtttggctctgagaaatctctaggtatgaggcttcatttgctcgttaaaaaagttctcaaactaaaagtgaaatgagattatcctggaatatttgtagacagtggatagaaagtgcttgaaatcgttccttctgcattgctccccctaaagactttgcagcctgattatctcctcttgtttgtccttgtcaccttccagcttcactccccacccagacatctgagtgggacctgggagactcttcgattcttttgttatcctttatctccctgtatgcggtcagtttctgagccagcctcatacttacttcttaaataggcttatagtcatgattttcaaactgtgcgccgaggcacctcggggcattgaagcaaaactcacagggcattccgggatgtttctgatttttcaagggaaatgtaatgacatctgtcaggcattctgcaaactactagctggaagtaatttacagtttcatcatgacatcatttcatttattttgatgacttcatatctctgtgaagctgtttttagttattcctgtgataaaaagcaagtatcttttgaaaatcgctgaaaaagaaatgagggtgatggtgttcagtctgattgcagttgggggagatgtgcagggcccactgggcactaaggtgacaggacacagtacttattaagttgttgggtctaaggtgacaggacacagtacttattaagttgttgggtctaactacttaacttttcggtactttttttagcctaggaatcctgtgaaaaagttcctaagacactcagggtgctgtgagtcgaaaatgtggttatcgctggcttgtgtcctcttcctgcatcagattcccactgccctagctcagcctgtggtcagttcttgtctgggccgagagcagcctccatgctgtttctcagtgctggctgtccaatctgttgcctgcagattgaaaatgaagaccaaatcatgtctctcatgcacaaaatcttaaaaaagaatgttgaaactccttagcgtggcttcaaaactccatgatctggcccttgctcaactctcccctgttctctgtgatgtcatgctttaggttttatcagcatcgaccaccccagggtggtcgtgcaccatccagctctcagcatttggaatggctttcctctgctgactttgcttgggaagttcttcctgcaaggcttacctcaggagttgcctcctttaaagggagcctttcctggtcttattttctatccattcatccaggtttctgtaatactccttgctgttgccatcgcacttatcacactgtaccatgattgttcatagacctttctccaactatgctgtgaacaccttgccagcagcgaccctgttttagtcttttttgtcaacctcagcaccatggtagtgcctagaatatcggatatactgtttacgataattacaacacaaaaatactactatagttggtacacaacagaaattttattttattgctttatttcccaaatgatagagtttaaatttgttagcatgttacagaaccaagcaatagtattgtcgttaatgaaatgcataaaagacagtttaaccataatccatttggtaccttctttgcattgtggtcactgaataaagcattatacaatctttggtgttacttcagacggttattcatgtttaccccagcatccatttggacaacttagtaaccagtcggtagagctatccattgatatttttacataagcacagttgcctgagcctaaacgaataaggggtgacatgactggagtttaagggagggagtaggaaagacatattgcagttctcccttatcagttagattttgatgtctccctgccccttccgctgtcacctccacttcgagcacccaggcagaactgacatcattcagttaataatggccaccaccttttccccccatagactccttagaaagccttttgatgatagtcttttagagttgctattgcttttttaaattaaaaaataatagtttaaaaataatttcaaatttacagaatggttacaaaaatggcacagagttcctctgtgtacccttcacccagatttcagattttccaactgttaacatttgatcaatgtggtaaaaaatcttattctcccttcccagtacccctcacacacatactcgaggtttgttgttttttgaatcatttggcaataaggcaaacatggtatccttatgccttaatactacagtgtgtatttttaaaaagcaaggaaattctcctacgtaaccgtggtataatcatcaaaaatcaagattttgtagacaatatctagttgatccaatatctcatctacagaccctactcaggtttcacctgttgttctaataacatccaggatctaatctaagattacatgttgcatatttccttgtcctttgtgacattgatttttttttttttaactacagaccagttcctttatagaaaagttttcaattagcagtgatcacgcctccgataaacctcactggctacgatactgccactgcacaaagctcagttcctttatagaatgccttgcaatttgtgtttttctgtgatccttttgatttattcatttttgaggggagtatcacagaagggttctcactgcatcatagcaggagtagtgcgataccagtttgtttcatcacctggctaagatggtatctacattcatttgtcttactatgtacacattgtctgcatttggccagtgggggccccgttatgctggttcctgtgtccttataacatgtccctatcattctttgagaactttactttctgatacaaaagattctccaagtccattctgtattttccctactccactcctggagtctgttttctctgagacaccatggtttcttttagtggggaatgctattttgaaacccagatctgggccttaggtgatttgttttttgtttttggttatttttggacagagatttggacaggtagtgttattgcgatatgaaaactactaaagttctgatttaatatctactttgaaaacaaaactggtctcggcagctttgaggtgctgtcttctgcatttgtaccttggtctgttggcatagctcacttttccattgcaggtgtccttttgcaagtcttctagcctttgagttcatgacagccactgacagttcaccctgttcctggtgtggacccctgtgcaaggtgaatgttccactctcgagaggtagcgtggatccttcacttctctgaaccctgttttccctgaaacatacctggggtgaccaccagacctcattacataaggctgttttctcccacctgggtacagcttttaccagctccctaaattacatggttttcctgtttgcacctggagtgtacttttgtagtatatttattattatttttttaatttttaatttttgtgggtatatagtaggtgtctgtatttatggagtacacgagatattttgatacaggcatatagtgtgtaatagtcatgtcagggtatgtagtagatttacttatatgcatgggtgttggtgttggaggcttcctcaagtaggtaaacaacctttgttatttattctgaaaggaatttcagcaactctgaaaaagctctaaaacctggatggctgccatagcactgctggagagaagtagtaggaaagaaaagctgaatcacagggatgattagaaattggcgataaatcctaactgcagcttaaatgaatattgtataggttaggttttgctatattgccatattcattgatcagcaaaaacagtagagctttatgtttgtccagtgacttaggaaattgtggcaattatattatactccgctgataaaattgaggatgttaccagcttgaatataaattactaaagtgagagcaaaccattttcaatgttctgtaaaacagagtaatactgatctgcctaggtaaatttttttccctaggagcttctgatgaaaaattgtagcaaaggcagagagtagcaatgaaatgatagagcggatgctgggattgaaatgtgtttcctctttcagtctactttttaaaaaggggtttatttttcaataaaagaagtttgcattgggggaaggggacaaaaacaattattttcagtttctgtactaagttaactgtgattaacattttggggtatagatgaacatttttttctttggatacacatggaaatgtatatacttttaaatgttttttccctaactgtgatgatacaacgtatgctcctctgtttaaagttctgtttatttttatttggcatttattgagcttttattatcatgtgctacttttagggatacatacatctttgaataaaagataaggttgggagaaaaaaaaaagataaagttggccttaagtaactagcctgaagaaggggttagagatacgcagtgggtttccttttgtttgtttgttcaatgattttaaaaattattaaaccaccatggaaaaatgtccatgttaaatatacacataagccatatttcttgtaaccccatactattctgttgtatatatgtatcatcatttaattaattccctctcgatggacatttaggtttgttctagttttttgatattaataacactaatgaatattttaattcacttgcctagttatttccttagggtgtgtatctttttctttttttctttttctttttaagacagggtcgccgtcacccaggctggagtgcagtggcgcgatcttggctgactgcggccttggtcctgcgtgtccccctttccaccctgcagctgagattacaggcattcgccaccacgcctggctcatttttactatttctagtagagatggggtttccccatgttggccaggctggtcttgaactcctaacctcaagtgatccacctgcctcagcctcataaagtgctgggattacaggcatgagcccctgcgtccagacatccttagggtatctttttagaactggaattgttgaatcaaagagtactgttaaaagatatatatatatatttttaggccaggcctggtggcttatgcctgtaatcacagcactttgggaggctgggatgggaggatcatttgagatcaggagttcaagaccagcctgaccaacacggtgaaaccccgtctctactaaaaatagtaaaaattagctgggtgtggtggcgaacgcctgtaatgtcagttactcaggaggctgaagcagaagaattgcttgaacctgggaggcagaggatgcagtgagccaagattgtgccactgtactccagcctgggtgatggtgtgagactccatcttaaaaaaaaaagttaaattttagaatttagtttgttttcaaattcagtggtgttcttttttgatttttagagatcgaacagattgattcagtcatggaatagctgaagattagtggcatttaattttatggtttagcatggaattaattattttattaaatttttggcatttccgaaaaggttttgattttaaactttaattctgaaatattacaccaagcatcctgaagagatgagacataatgtgatggttgctcatatgctcaccctcctgatttcagttcttcagtgttctgtcatgtttgcttcatctccatctttttttttttctgagacggagtctcttgcccaggctggagtgcagtggcatgatctcggctcactgcaacctcagcctcctgagtagctggaattacaggtgcatgccaccatgcctggctaatttttgtatttttagtagaggtggggtgtcaccatgctggccaggctggtctcagttcttttgcaacatttacatgcatctataaacaatgtttttgtgttttaaaatttacattaatggcatcatactgtacctgaccttttacagcttgcttttactttacatcattttttagtttatccaaggtgttgtatagattgagttaaaggttgtatttctgaccaggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaatagttgttgtgtttctatagaatatagattagtagtgaaattgctgctttaaatttttttgatgttgcagttgcacatttaaaagtgaggttttacaaattaaagtgcattaactgttgcttaaatatacattgctttatgagtatggttgaatagttcgtataaaactagttcctcaagacttcactaacattaacatcaatagtgcctaccaggtgtcagtttctgtttttattttaaacaacaaacccacatgtggaacaatagtttctgttctaagcttttcttgttgtatagattatgtcatttagtccccacaagataaagaaaccgagggacagaaaggttaagtaacttggctaaggttactctgctagtaaatgacagtgctgagattgaaccctagcattcaaccctgcatatacttttcctttagcatccacttttgttgctttttgtcataaatgaacaaaaacagcctagttaattcagaataatcacattaaaccatgtgagttggtggttggatgtcagaattgaagtaatttctacttagattgagtatcagggttgttcattctcgtagaggcagattctagcttactgttggtatttttgctatttttaagcaatgcttttaagtctcgttgattgctaaagcctgtttgcaggtactgcctcccctagagcctttggggtcctcaagggtaagcagcatgtcaggctcactttcgcaatcctgcttcagtgtcacattgagctgtgtgatcccaaagtccctgtgctagcagtgctgagaaacctgactgccatttgtaatgcagttttcatgtggggggactgttacactgctacagcttgtcatgtcaggagcccatcttcccctacttacacatcagcaactccctttctcttaccactggggcggtagaaagactgacttcagtgcttgcgcccgaggcccaaggcagaggatcctgagagactcatccatgatggcgaggctgggtgggtctgtgtagacttcccactagctgggccctaagccctttcttagaccacattactttctcatgatattttcagggttttccccccttaacctcagaggttagtctgccagctgcatcttcctgccactgcttcctgcatctcttcctgggctaagcacccttctcgccctctcttcctctccctctacactgtgtggagcacatggcagacgtatgcccagtgtagattactgagccttaccttacactactgatcagagtcttggggtgatcatccagtgatgtgttgtatatttctaactttttattgtggcaaattacaaacatggccaaacaagagacgatgataccgttcaccctcacgtactggttgcccagctttgtaaccaccatcagttcatgagccactcttccaccttctataggcccactccctcacaaccctgattatttggaaacaaatcacataccatcttttccctgtaaataaacagctatgtgtatctttctcccgactttttgggacaagttttagaaaatgtaatagtgaatatctctgtaccctttacctagattctccagttttacctgatgtttttctctctctgcatcttatatgtatatttttgtgttgctaaaccatttgaaagtaagttgggatatcacgacagttcatttctaagtatttcagctggtttctcctaagagccagggacattcttctatatataatgacaatacagttgtcatgtttggaaattttcctaagtgtccaactagtgttttttatagcttcctttttaaaaggatcacatactacatttcatctaggatagttccctagtctttctttagaaacaaaaactttcatgacaatgatattttttaagagtccatgccatttgtttaatgtaatgtccctgagtttggatttgtcttagtgttttagcatgattagattcaaatgataatatattttggcagaaatactgtgtaggtgatatattatttttaggacatcacacacaccagtttgctcgttatcagtggtgttaaattggttatctggctgaggtagtttgccaaggcttcccaccgtaaagacacctttgcccctttgtaattaatcattgattattcttactggattcaattattacatcatgttttgtctaaagattcatctgtacttgagtagaacacctggttttagtttcttgggcatttgattacagaggtgtgggcaggaataaggaaggcagagccatgtggggagagtagctgtgtgtgtctgaggcgggcatggaggtgatcctattatattccccgtcacgtgttgctgtagccctgcagtgggactgcagtcagggggcttttaaaaggtccctggcatcatggctctgacagattggtgagttcttgtggctgcttggctagaactgtaccatccagtcagcctttgaaggtacgagatgtgcatctgctcgtatacatgagactgctcctggctgtgtagactatcatcataaacttcagtgaggggcattttcaccttgaaatcatggtcagatccgctctgacaaagattctcttttccagtgggtgaatttgtaagtgatgtcctgctagttccagaaaagtgccagtttttccacaaagagcggatggaggtgtgtgagaatcaccagcactggcacacggtagtcaaagaggtaagagaactcggggggaaagtcagctgctgttgtatctgttaggagggaagtagcacttttctccaaatctcaccatgcttttaagttagttatgtttcccccattatctccttaaggtttacaattacttctgtcttataagttagaaatatttgggagagaagtaggtatttgtgtaggagagctcagtgttgacagtcagctcctgaagttgaggatgttaaggaggtggctgagcgagaatactgtatgctgctggtgaggctcccaggaaaccatcctaaccctaaggccggcatggaaatcgccagtgatagaaaatataggtctggacatatgcacaggcaggactgcatgccatctcacttttctggtggcaagaagtaccctttcttgtcttctgtaattaggctggctctgctctttggtcagtaatcttcctttggtcaaatactgaagtagtgcttgcaccagtggtgagtatctattaacattgaccaccttatctggctttagtcattattagaaaaaaatgctctcttcctgacttttttccacatttgggatttcagtatttttggaccagatcatgtttccccattgtaaattaaaatttataaatcttacaataatattattacaatttttttttgacagaaaatgtatgtgttcataagagaaagcattgctaagtgatttgataagggtttattttggagggtagagatcggagtgtatttgaccacgtttactctggagtatgttctgatgtggcctgtgggtttcttttaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaaggtaactcttctactttgaactgtgaagtcgttttgcctttttgttagcccttctgtaaagacggctgttggctgctagtccctcacttctggataaactgggcattcctttgttctgctagagttgattaagcttgcatttcattctagccattgccaatcacaggagtacctgtgatttttgtgtttacatcattctgagctgttattttctgcaggttactatgatattttttaagagtccgtgtcatttgtttaacataatatccctgaatttggatttgtcttattgttgtatcatgattagattcaaatgttcacaaatacttcccgtttgctgatgtagctgggccccagggcttagtggcacggtgaaatgtgcgttgagcttatttcctgcctctgtttttgtgtttcagaatagagaagggacccattgttgtgctttgcacataggagctattaaccttcctttttttctattttggccttcagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaaggtaaccccatgtagagccatggctttgaaatccatgtggtaattattcacttagacttttgcattgcgtctgtcacaggtaagtcagtcacagaaggaaaggtgtggtacctctgcactgaaggtgagttcagctctccagtgcagtgatgggatggtgccgtcttaacaaagtgggcaggcaggcacatccagggagagatgtaggattgaattagagaacggggactagagagtaagagagacaacgtagtccgcccttcagcaggattcttccacattcatcctaaaatgttccctccccaaggggagctcccctcttcgataccactcaagttctggcctcctagaatagaaatggttttcttggtttttcttttcctgcttgtcttctaatctgtaggctgccctatttgtccagatgttttagttgggagggtgaaatttattgacctgctggtaacagattggggcctgcagttttttttttttctcatcttgccaattaaaacacgaaaaggttgcagtagttccagagccattaacatgcagcctcctgctgatcgtatatttgaaaccaattaagatgcgaagaattatttaggacccaagttgggggaaattacttaaccagttgagaagtttgtgatttgccttagagaacataaaagtgggaaacaattgtccgttctaggtgcttgtctttactacgggtatcaccacttaaagcagcctttccactcacactgtctcctgaatagacaaactaggcagatacctccactgaacagatcagaaatgtgaggctctcgcagctgtgagacaaaggaattgctctacgtcaatctaaactcagatctagactccagagggtgccaaaaaaatatttatcccagttcctaaatgtctctactctgtggggaagcaacttgtcctcagcaaggctggcctgagctggagctttcggccaccgggcctccaggctccgtccagtctcaggcctcccccagcccatcccccagctcgccagcctgtagcattttgaagcatttgacgtcactgcctctgtcctgctgacactctgaccattttcacacagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgagtaagtcctgcctcgcgctggtcccgtgcggcagcaccgtcctgtctggcgtccgtctccctgccgtcttcgtggctgcatctgtgtggtgtccctgcccactcgggtgtttgctgtcggtcgtcttcccctcatctttgtgctttctagatctaggctttgctctcctgccggcagtggtaagctcagttctcgtgtcctgtgctcaccgtgtgtctggtggtgcttggtggtgatggtgcgtacccaccttggtatagcgggcagcacagccaggggcttgttctttcttgtctggctttggagtctgcaggtccccaggccactgtagtattggtggggaaggcagctgtcccctgggctggctctagcttagaggcactgaacattcctgtctttgaactgccctgtcactgacccctgtgatgcatgccagctcatggggcgcctcctctcgaaaggagtgacagtgaagtactttgggcagtctagaatattgaaatatcttgcataatgcactctagagagagctagcagccaagtggtagtgactcactctgtttcttcaatattttgcaaccgggtcacacagctttaggaagtgagaggatttcagttggtgtgtgctttggtgtgacaggaaggtcagtggttcagttgagttgggtttatgctggacgttggtagaaagagtttctaccaagagttttcccttttctccatggctactcctttttctcgttaagaccttcagtctctcaccttgcagcactaacctacacattaggaaaatcctcaggccagacagtttttcttggttcctactctggaatttgttggagtaataatttgctatgaagaatttggctatagcttctgacggtttttcattcacatgccttcatgttccctcttccttccttctaccaaaagatctttcaaatcttaatgtaatatggcagtgccttgagtgcttcccttccagctccaggaaagctgtttttattcggtaacagttgaaaggtgaaagaaaaggaggccttagggaaccttggtgaataaactttgcgttttcaggaaagatttagaaatagaaattattgtgatacttactgctttgtaaaacttggactgaagcctgaggaatcccactgagtgtggaggtggtgatctctacccgaagggtcagctgggtggtgctgtgagacatgatggagtggcaggtctgtaaaactcccgtttgctgtggcttggatgagatttgcctcggagaagctttgtgttcatgttcttgtggggcctctgcctggagggctttgcaggttgagaagcatcaagtttacttccagtgggagcgtttttgttcttctttgaaggggctgaggctggcggatgtgccggcttcatgagtgggtgattccacagggaccgagggtgtcttcagaaaaaagcatttcggcccgctgtcctctccactctggtcccagggaggctggaagcagcctgtgtttgctgttccctttttccagtccagcaatgtgaaccaaaggctccgtctccagcgctcaggcctttatagcacaggcatgtgtcactgatccgcatgatggactgcagtgcttgaaattctcctccactgaacttgcgagtgtcttggggaatggcatttaccaagttatcgattctaatttagttaatctgaaagtgggatattgacacccttttaaaacttatgtagggctcatattcttcatgactttagttgtcgtttttaggtctgttaaatgggcaaataaaagatgcttccgacagaaaaaagttgaactggctggctaatttgtagctgtattcatcaattatatggttgttttaatgtattaaaatgatacaattctagaaattaggtgaatttgcttctgaattaaaaatcagttgaaccttggcattcactctccacttagctctgaaattgtgtcataatctatcaagcaagtccacaccagcttgggaaatcttgcatgaattaggctagtaagtgttaccttaggtatgtcttgagaggctgactgagtaaacttgtcatctcagtcctttcccttatcaggctaaattccatcgtgcagagacttgcttgggccccatgagagattatgcccatccagcagtcgggggtgctccaatgggcctgtgctctggggaacgcttgggaagccctattggtcagtgtcatggatcaaaaagccctatcttcatatcggtgaaaggtgtccttgtcaaatagagcaactcagttttatccttgttggttctgtcactgatggtggggctaagagtccttcactgatactgaaaactcaaaattatagctggagtgatggggactttctctacccagcgtatatgcaaagaacattcacttgagcctgttttctgttgtaaattaagactcaaagatagccagaagagcagaggtacctgagtaataaatttctttaaaaataaggaattgcataaaagtgcctctacagggtctgattcctgcccttgtctctgttcagatgctcagttacgagcaataaggtagctattgtttaggtttccagggttcgagcactgaagggaaggtatagaagaaaccacctctttttcagccctgaggtcttaagtagatgcctcactggtgctgaagctgccaataaattgctgtattagcgtgggctgacatggttgatgaatattgtgtaaggaagattgcccactgtaatctaaccaagtgaagtcttggcagatagcagcaccctgcacttagagaatgccacaaaacaaattgagtccatcctgcaggtcctgagctgggttttcttcctagagcacagtgcatctgatcccaaagagaactccctctgtaattttgtttcagttcctccaactcctctgccaaccaatgatgttgatgtgtatttcgagacctctgcagatgataatgagcatgctcgcttccagaaggctaaggagcagctggagattcggcaccgcaaccgaatggacagggtaaaccttgacaatttcttcatcttcatggtacttggctttgggtagcatggttctcatagctgaagaaaagtaatagcttctccctagattgtcatgctgatgtataaggactggtgagtcaggagagagttaccagtggagctgccttctgggtggacttcttcaccacctgcatccagataatatataatataattatcctctgagcacttcctataccattatctgccctttttttttttttttttgccattaacttgctttaaaatttctttattttaaagaaggaaactttatatcactgttatcaataaaaagctagtaccatttgccgtgagaagaaagtgaccaaccatacaaatatattagatgaaagcaaacatgtactaatacatgctagctagatactgctgtctctggaaggttctgagtctcagagatgtttcttttcctttaaaagggttataagagagcagcaggaacaccaaagtgcaacttttcttctggatttactcaggattgaagagaattgaaaagggaatgccttgctaggcctaagctccaccccaaatcccacacagtcccatgttgggcttacagtttgcaaaatgcttattgttttatccacatcagctctgaaaagtaggtattaacctcaatttttttggtgaggagactaaggcacagagacttttaaataacttactcaaggttatgtaacaaagaggtcatggaattgaggctccatctggggatagttgaggcctggaaccttctgaggcagtaacaatgctaagctcctaagagattgtgtgattggtttccttttgcagtttcctgtgagatttagcatctgacagtgtttttagcaaatggaggagttgtttcggggtattaatcactgctgacggcgtttttgacctttgttctaggtaaagaaggaatgggaagaggcagagcttcaagctaagaacctccccaaagcagagaggcagactctgattcaggtaagatgccttctctggggacatagctttcagcctgaccattggaaaatacggtcagagccccattcccaacgaaattaggattggacaccacctccttttaggtgagggcttacaaggaagttgtaactggcctgtttttctttttcacctcaagtattgctaacctatggtagaaggaaaccaaacccccaccagagcacacctaattcatgccagaaggtaaccttagctcagctgcctttcgttaattctgctttcctggcaaaagtcctctgccattttcagtcttagactgtgacttgtttttcagcagtactgaattttttttaagactaattgaaagtcaaaggatagaaaataaagatctctgatacaattcatctctaactttgtagactataactaaaatcatagcagcaaactgcattccccttcagtagaagagtgttgctaggaatagggatagcaatttccaggactgatttggtttttacaaaactgattttgtaaattttaaatcattttatgtttagctgaaatgcctttcctcctaatgtaacactttaataaagtgttaaaaataatcttaaaaggcttttttattgatcacttagaaaatctaacagttttaattcctacagaagtcagtgcatcttgttcagggaaatgtagttcagcaggcttaaactgtacctgtaaacctggctggatacctcacggataacttgcccttcatgactttattgatagtaatggcaaaaatcacaattacttttgcactaacctaatgacaggaatacttcaacagaacttaccacataactcccattggtcagtggtctcagagtttggaagttagtgccttgctgcaatgtgggaaggacagtgttctttttttatagtgcatattgagaaaccaggccttgggcttgcaggcactagcacttgtagttacacagatactaaggaggccctttgacactgaggtttaacttgctctctttaaagaaggaagtaattctcctgatagaagtagaatgaaggtaggatgaagtagactttggatcttacccttgctccactctccgaacctgttactgtctcgcatgggcactgacaggagaagcactggggtctcagggtgcttgcttaggcttcctctgggtgccacaaatcatgtgtggttcctgctttcttggtttagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacgggtgagtcctgcccctagcactgcctgccctgaggtggtatatgtaggggaccaatgtatgacactcaggtcagtaaaagtgacatttgtatgacaagttctggcaaagctgaagctaaggaaagatgatgagggaggaaaaggtattacattctaatatctgtgtatataagctaagcatgacatcgctttatgcctgcgtataccacctgtgatgtgaaagtgttttacgctggaaaagtataacctcgcgaaattgatgggtaattatccagttattgaacttcctttcaaagaatgaaaacatgctattcatgaagacttttgaacaagttacattataaataagattatgaagaaaggggtaaagtaatttcttctgaaactcttgtgtgagtggtctcaaatgattttgtcccttaacactaacctgccttgctttgggggatggaaagtattgggaggatatttgtgtccttaagtaagccggttaaagtcttctctctttgggtgacacaggagactatctagcttataggtgtcagaggctgagccaggaaaaaggacagatcagaagagaacgggagtgggcaggagattctggaaaatactgtatgttaaggagccagtataactttggaacttagttttgctattttacctagacagtttttttgttacttggtaagctaaaaaagccttccagttacagctttcattcttgtgcctagctgagctttacattcttaagtgaactttttaagcttttgttttcctgcctattttcaattctctagtctctggatattaaaacaactgttctctcttgcagcctcatcgcattctccaggccttacggcgttatgtccgtgctgagaacaaagatcgcttacataccatccgtcattaccagcatgtgttggctgttgacccagaaaaggcggcccagatgaaatcccaggtacagtagatgtagtagaaattgctgccgtgagggcatttccagtggggaacataatgccttgactaatggttgaccagcactgctagttgcatttgctactagtccttagaaaatgagttttgatttccgaagacattcggtacgtgaactggtttttgcaaggtcactgtttttaaaacatctttttaaatacttttttatattaactgctttatacttaaacaatttctgaattttttatatcatttatttctgatttagggtattgccagaaccaatattcaagatccttttctaggtatatttatcaagcagatcttaaaaattggtctcttgttttgtgcagtatagtttttgtttagacagacacttttacattcctaggttttgtccagctttactttcatctacagaggtttgtttctggttcctacttctaatattggtgttgttcatatattaacttgagttttacttttttgtattcataaaaatgagcttgcctacaagactgctagcttccgtttaaaccaggaagtctcctagctcagccttagttttcctagagggccttatagtaacaacgctgatcttacttgatttcctctcatattgtaaatacagtgctgtgctgattgtgagtgtcagggtacatgggctcacttactgcacgggtgctggcctgtcagcccagaaaccctccttccccacagctgctatgagtgtgaagatgaaaaggtaatgtgcctaaaggcctaaaggcctttggagtattggagctgagctgctccatttgtggagctgggggtctgtctcagtgccagactccacactggcattcagtgctgccgggttgactcccttgagtgcccttgagcagctcacacgctagtgtagagataataactgtaaaggtgaagagcaggtgtttttttgtctgtttgtttgagatggagtcccactctgtcactcaggctgggttgcaatggcaccatctcagctcactgcaacttctgcctcccgggttcaaatgattctcttgcttcagcctcccaagtagctgggattacaggtgcccaccacagtacctggttaagttttgtagtttcagtagagacggggtttcaccatattggccaggctggtcttgggctcctggcctcaggtaatccgcccacctctgcctcccaaagttctaggattacaggtgtgagccaccactcccagcctagagcaggtgttcttagatatacagagttcacttcagaagctggttgttttggggaataaaagaactcaggcttctaaagagtgggaagaacgtggaaaggggctgggttggagaccctaaggggcatctggtgtgggcctggagctcaggactttgcttcacgctggatgtagcagaagaggagaaagtccaagaggcctggatggaaaacgcatgcatcttgacagggcctaggctcttggggtctacttgattttttgaaaagacttaatcactttccaaactttctggtttaaaattaaattatcgtgttgtattctagccagttttgtgtgagagtagaagggaaggagagattttgatcagtatattaaattaatagagaattcctgcaagtgagatcaagcttccacaccaagtaatgtgggaagtagaatgctcccatttaaacacctttggggagaaaacccagctctcctgtctgctacttactacctgctcttagctttaattctggcaaagcttaccttctgccttgttccctattctgttatctaaacaccagaaaaatttgcagatattcagcctgttgtaacttgtgccatgtctgcttgtctggatatgagtgagatggtgcttttacccccatactatagccaatggtttgctgtagagacactaatttgcagtctcccgctctgtggttcttgtcctctgtgagtgtatgaaccttcctgtctcacacggctcccggttcctctgggaggtgtagcaggacaacacttgctgaacccgtgggtgttgcattttggcttcatttgcattttttcttcaaggcactcactcttgtgctttccttgattgacagaatggcaaatataaaattaaattgctttcatccttgctttgaaaggtcagagagatgtcagtctacaataaaagcatctttccatttagctttttttttcattttgatccttcatgttaatggcttcaggcccacataattaatccactggtttccagcaccctctttaggaaaagcttggtaattgcaggtctaaccaggcggggatgacttagcttgaaaagcttgtgggagctacagcaacacacctcgccgtgtcattggggtggatgctagcccgtcacctttcacttccatcctggaaaactgtaaaaatagtgaccacttctaatggcctttttttttttttttaaataatgaataaccttagaacttttgcattcagaaaaggcagtgagctacggtagatgagtcttcctttatcacccccttaaaatcaggtttatttatacctcagcatgagtttttcaaaaaatagcaatttagttaaataggaataaactaattctttatttaccacaataatcatttaagcaattgcttcactaagcaaaatccataatggttccctctgttgccaagtctgcttttcagccagtaatttcagtcttttttaatcccatctaatctgaccagtggtagaaatcaactgactcttctttcactcagcaaaaccttactgaacattcggcattgtacaaattagagttcttttttttttttttggctcaatataattagtagtaagtgccttgtatgaaaatccagtagctagtggccatttttaaataaattgtctcttaatttggagcactttccagataaattctcatgtcagctgggggaattatacagtctttttttttttttttaagacaggatcttgctctgttgcctaggttggagtgcagtagcacagtcatagctcactgtagcctaaacctcctgggctccagtgatcctccagccttagcctcccaggtagccgtgactgcaggcacacagtactatgcctggctaatttttgtatttttggtggagacagggtttcatcatgttgaccaggctggtctcaaactccttcgctcaagtgatcctgctgtctcaccctcccaaagtgctggaattacaggtgtgagccaccacgcccaggctgaacacgttcttatactttagcagtcagtaaatatggcgtgaggattaatacatttcccctgaccagttgctttgctagactctgtagagaatatgctttgtaaagtggtttttccagaagttgtgtcgatgttccagctgcaagttccctcctggcctagttgttttcagtcacaacacctctccaccataactctgcttccaggtgatgacacatctccacgtgattgaagaaaggaggaaccaaagcctctctctgctctacaaagtaccttatgtagcccaagaaattcaagaggaaattggtgggtaccagctctttgtgtcaaggtcatacgggacttcttgcagaggctcaggagtgaaagctgggcaagagtagagagagatgagcaagcaaggccggtgaagtggggcattagcacatcctggcttcagaagcctggagtccactggagctttcatggcaaggtgaaggaggaaccaaggacaggtgcactggctgtgagccatggagcctcgggcttcactgaccttcactctgttagcggaagaatatctggggtgtgaaattgcaagagactacgagtttcctgttcccgttttcctccttcgttctgattatttcaagcacctgattttatataaattctcacctcctcctctcccggtctttatcttcttcatttattcaacaagttttattatggctgctgcgtgcgtgtcacagagtaaaatggtccacgagcagatggtacctgctggagttgatgtgttgataagagaaaaacagatagtaaaacaagaaaataagtgtcagctggtgataggtgctgtgcagtgtgaaaactcgggcagagtgctagagagtggccagtcggggcggctgcctctggggacggtggcctgagatccgaatggtaagatcacagcgggagagcacgttggtagcagagggagcggcagctacaaaggccccaggtggaagtcaggcatcacatttgagtagatcagtgtggctacaacatagcaaaggggatgtggccaaagtatgcagggaccagatgaggaagaaatttcagcaaaatcaaggagtttggattttattctaggataatgggaagccgttagaggattttcagctagggaaagactagatctggattatgaatttttaaaagctcacttggctgctgtgtgtagtcgattaaaattagaaaccagccaggaagcgattttagaaattcaggagagagctgttgggagtatgcactgaaggggtgacggggtaggagaaggagcaccccagggacagctggggatggtctgtaggatgtgttctggtgggagtgtgtggggctgcgcccagggctgcgtgtggggttgggggagcggcatcaagaagtgcacttagggttccactgggagcagctcggggatggtggtaccatggctgactgaggtggagaaggaaatccggagctctcttgatacatgttaagatagaaatttctgttggatgttatgtggggatgtaggatttaggtgaggcagaggtcaggcagtaggtccaggattcgggcctgggagtcatggtatatggtcagtatttaaaactggcgtcggggagaagtaggtcagagggtatgaagtggtagttgtagttacgtggggtggatacgtctagagatgggatggacagcatgaggactgtagttagtaatatcgtactatatactaaaaatttgccgagagtagatttgaggtattcttatttttaaaaaaaagtaattctggaaggtgatgtgtgtgtttgcttgactatggaaatcatttcatggtgtatatgtatatcaaagcattatattttagaccttaaatatgtacaattttttaaacccccaaaatctgtggagttgtggataccacttaactggagtgtggaggtggatgcaggggtgcctgggacggcgccctggggtccctggtgttggggctctgtggtgccacagaatcaaggaaggtgtttcaggcaggaactgggagccacagtggggtcttggagctctagagcatcctgtgcctggacaccaggcccttctgaagcctgctttctgtcccctgccctgtcttcatcagatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggtgtgtatgggcgacggtgccacttctgggcagcagggggaggacaaaatgagagaattgaagtcagtttttcgaaaaccaaattgagttgggagatggtgttcctgcgagagtcaggggaagggagactggattcattgagcgcctactgtgtgcaaggaccctgctagatgctttcaaatcattggtgtcaatgtcaccatgaagttaagactaattctcccatttcaagatgggtggcttcaaacccccacttcttccaacttgtgcacttccttacatgggggaggcacttggcagttgaaacagcgccttcctgttatggtgttacctttgcccagccgtcttgggaggtaggtgctggagaggctgaggaggtgacagggctggcgtgggtcatatctctgacatgaggtggggataagaagctgttcctctgggtcctaggcagacgttctttcctctattcccctgctggttctcagtgtctaagaggatctctaaaagctgtgagtctgctccagaaataaacaagttgctgagaccagtgccctgagagccgtccccctcatcagttctgtttgttgctgttgctgctgacagggtaatgataagaatggcccacagctatgccgtagtccttgttatatgccagctttagctaagcatctcagcggatgctctccatcctcacagtaaccctcgcaggtgggtagtcgagtgtccccatgtggggattctgaggtataaagagattaagtaacttgcccgaggtcatgtagcttataagtggagagtcaggggtcgaatccaagctgatctggtcctgcagtcacagacctgactggatatagcactggaacagaggcctcaggaaggcatcaaattaggggtggggggatggaggtacatccagcttagccttcagaccttaatggaaatgctttctaaactagcgatcccagagcagttgactctccagaaataaaacaggatctgaggaagtggcagatagatgaaaaggcgccatgccacccgcaaatctccgtgggtttttggggtggtagatgaagaggcaccatgctatccccaaatctctgtgggtttgtcgggtggccatgcttggacaacttcttatgtgcttgttgggggtcggggcagcttggatatacctgaactaggaccttatctccctgtcagcaaaccacaaccaacacttaacttcaattttcacttttttctaagaaaaataattatgtgggctaagctaaatagtgcaggcatctcccagtttccctaaaaaggcacaagacagacctacttttttctctcttatcaaggataccctccagtgatttgctgtggctcatactgctggtttgtttatgggatatttcaggcagggtgtttttaaggaggaatactttttgttcacattatagagaaattctaagatagaaattttaaaagaagccattttcttttttaatctccttttgtgctattttattttgttttttattgttttcctttctgctagacactcagccggagttgtaccacccaatgaaaaaaggttggtttgtccaagatgttccctttaagaccttcattcctctccactccctagtgtgtccgaagcttcatgttctgtttcatgccatcacctggctttccccacctcattccttctgacacggctgtgagtggggtcagagcagccccacctccatgttgctgacaagctgacctgactccagcactctgaggccagtttccatggtgttggttacctcgtggtcatgctaagctttccctctgggatgtcagagaatgcacagcaaccaaaatagatttcatgacccttttaatctgggtagatttttagaagtatatccaacttaggttggttgtgaactgctgtctccgtataaatatgccttatttacagtcaggtggagagtcgttctcttttccctctttttctctgcaattcccatttacatcttttctttttggctctcctcgccctttgtctgtgccagttgtctcatgtcccctgagttgtatattcctcagaacatcggaagccaatggatcaaacagctggagacaacccagctcactgtactgagtctccagttttcaaaaagagttaacgttccgtaaagcactatgtggaatgctttgcattcttgtccccatcttagtccactgaacgtccctgtaggatgagtagtgtttttagctctattttctagattagacaattgaagaagtttctgagatgacgtgacttgctctaagaagtggaggaaccaggatttgaacccagttctctgttccccaagcccatgtgatttcattacctgagttgtcggtgtcacgggatcccccaggtgggtgggtggcccagtcattgtgaatcatttcaacatttcttgttcataatgtgttgtatgagcccacccttggctttggcagacttcctgttgatgggccaaacggtgttgcccggctaagaaggtggtgttctggtttacgccacaggttattctcagaacacaaaagtgtgatttcaatcttctgaaaatgacttcgtgtagatgctttattttattctacttggatatgcctgttcgtggggatgactgtgccgacattcctttcaacagcacaactgagatgtttatagagaaagatgagttttctagaagtttaactggcttttgcttttgtactgaactgttatgagttgggacaatttaaacattaactttggtgtcttgaagtcacttgtttatgttaagaaacgtgggggctataccaccaaaaatctattataacagtctggactggtggtaggttttttttttttttttttttttttgagatggggtcttgctgttgcccaggctggagtgcagtggtgcggtcttggctcactgcagcctcctcctctggggctcaagcagtcctcctacctcagcctcccaagtaggtgggaccacaggtgcatgccaccaccctcggctaaatttttttttttttttttttttttaacgtagagacagggttttgccatgttgcccaggctggtctcgaactcctggactcaagtgatcctcccaccttggcctcccaaaatgctgggattataggcatgagccactgtatccagtgacagtagacctttagtttgctcagtgccacattgctttttgaataattcctgcctgtgtgacctttaaaattctgggagagagaaacatatatatggaaggagctcagaattacagttgattgggcttggtcataagcatccttgctgaggcaatacccttccagatccctctttctcaaatagttggagtgcagtattgctatttcatgggcactttgagacaaaagctagctctgatttaactagaatctagtcgtgcaagtctttaaagttgaagctttagaaaaattgcatcatttttggctgcattgcatgagctagcctgcatgttcagcagctgtggaagctgttacaagttgctatgtgttaagaacaagtctagttgtgaggcagaagctctgctgtggttgtgccttgtgccattacctgcctttgacaagcccagggacagcagtgctttgcatgtcctcatgttgaagtctcacttgcaggtagttaccttagaatgccagatacgctgtcgggttgatccagttataaaaggctcatatcacagacgtttatattgaactgtatgttattatgaataaggaattcttatgatagctagaaatcacatgctttggaactaaaaatagaggacttcctctcacgttccctccctgggcctgtgctgcgtcgtcgtgctgcgtatttggatactatccttcggagcgccacactcgagtgatgttgctcaggcagtgtctgaccttggtgagaggagagttgctgttcttgctgctctgtttagagaaaggtgccttccatgctgatattagaatgcttcctataggtggaatgcacgcttcctgtttatcttctaatagccacttaggatatgagcatctaggatctcggcacagagggattcagcgtggtgggagatgcgggaagaaatccgtaatgacagactgttgtcattactgttggaacctccccaggaccaactgaaacttgaagggaaaataagagtttaggttggggagggtatttgaggcagaatgaattccctgtgggctaacctactatgtccaaggcaaacgtgcaggttattgtgaggatgggtgctgtggcagccgggtgtgggtagtaggtgctcagtaatttctcctacgatggtgtgtatttcccatgctaggatgcccctcggctccgcttctatgtgtcttacaataaacattttctctgaaggcttgcatttcattttcccaagttggagacaagtaagcactccctcctcctccattatacccattggtctctgcaaatgcctgtctcattcatctttagagagcacagggcaccctcagacttgtgaacatggtggcagatgagtcgcgtggggaggtgcgtgttgaggggctcactggccctcaggagggagtttgctgcttctgtgcaatgggtgtgagatgggccatccttgggaactcagccatgatctctctccacacaggatctggagtgggagagcaggatgggggactgatcggtgccgaagagaaagtgattaacagtaagaataaagtggatgaaaacatggtgagcctgttctttcttctgcccaacacgctttacttttgagactcattagagcgagtgacctgatgtcagatgcttccaggtgcacgtctctgtgttcgttttccgcacagtagaaggttggagggctccaacggctcccacagactggctgtggtgtttagcatctgggtatgaaaaggattaaaaagcccttttcagcagtagctcatctcttgctatagagtaggaaaatatatttacaactaaagatatgaataacctgttagaggccattttcaagtgagtagagagttaataacttggattagagttgggttttgttcttatactgccttaggtttatacccccttttattcacctagtattttctgtcatttatagttctggattatcttcaactgagtttgatatttcaatgtggctttttttttttttttgaaatggagtcttgctttgtcaccgaggctggagtgcagtggcatgatctctgctcactgcaagctccacctcccgggttcacgccattctcctgcctcagcctcccaagtagctgggactacaggcgtccgccaccacgcctggctaattttttgtatttttagtagagacgaggtttcactgtgttagccaggatggtctcgatctcctgaccttgtgatccacctgcctcggcctcccaaagtgctgggattacaggcgtgagccaccgcgcctggtgtaaacggggctttttggcagtctgttctgagatacgtctccacaacggttacttgaaggaaaatgcatacgggaccagctgccataatatagtcttccctccatacctgccccttcattaggggtttggggagtggatttggaaggctgtgacagaactggttggttaatgggggtcccacaggtacctgcttccttccatcaagcagcaggtagcagaggaaggaggcagtaaataccaaactccccgttcacccagttgcttgctgccgacattctcatgactgtttcaggtcattgacgagactctggatgttaaggaaatgattttcaatgccgagagagttggaggcctcgaggaagagcgggtacgtgtttagctccagaacctaaggtttcctgccaatcttaggtatttctcctctggaccttctcagttcaagtagaaaacgggagagatgcctgagctaataagggtccctcatccccagctttccgtacttttggataagaaagctaaaattaaaatctccatggagattgggaagagtgggcgttctccacctgtgggtggttccctgcaaagcaggatcttggtgctactttgggttttaggggctcgaccttccaggagcgtggccctcagtgagttacttgcctcacggctgccagatggtcactgggacttttttccacgtctgctttattacgtaggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggtgaggagctgggctgctgagggcctgctctgcactgtgggctgggttgggggtgggaacctgtggaattaataggcatcttcactcctcgagtactggacatgctgctgttatcagttcagttactcactggattcctaggtcgtgtttttggaaatcagcccctgccacaaggggctgttgccaactttcaacattagtttgggccttggctatgaatgtcagaaagtcatgtgaacattttatgctacagagggtgaaaactcttttctcagattatttccttagtgttcctttttccaggtatttttttttttaatgggggaaaggagcaacaggaaatttagaaagtgctgaagcagactgtttctgttctgtcttctgctggttactgaacttgtcttgccactcactccttagtgaacagtgggaatgtccagagtcccttgatccccaaatataaatacagtaaggaccttaatgagccctgggaaattagtgcagatgctggtcttagttatttgtgtttttttgtttgttttggttttttggttttttggagacagtctcgctgtgtcgcccaggctggagtgcagtggcgcgatctcagcgcactgcaacctctgtctcccgggttcaggtgattcttgtgcctcagcctcccacctagctgagactacaggtgtgtgccaccacgcccagctagtctttgtatttttattagagataggatttccccatattgaccagggtgatctcaaatcctgacctcaagtgatccacccgcctcagcctcccaaagtgctgggattacaagcatgagctactgcacctggccagttacttggttttatctcctgctggagactggcctagctgtagaatttcagaactgaaaaagaccagagatcccctggtcccaccgtctgcttgctagcctactgctgactggcttgccttggctggcccaggtagtaagcagtggcgccgagccttgcttgtcaccacggtgctaggaaatccagttgactgtcatcttccgtgagggctaagctttcagggctctcgtttcgaaagcattgcctctttgatccccttattttctttctcctgtgtttcaccaccggttctcatttggcctgtccggtgggaacgggctgctggctgcatttggtcctcaggggattgtgcagcaaatggctcaggtctcccagcaccctgtgcaggtctcttcccagacaccacaatgaccctcaggttttgttcttccaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 37039 - DNA, 10867 bp, Homo sapiens; identical to SEQ ID NO: 36976

SEQ ID NO: 37040 - DNA, 44042 bp, Homo sapiens; identical to SEQ ID NO: 35601

SEQ ID NO: 37041 - DNA, 44042 bp, Homo sapiens; identical to SEQ ID NO: 35601

SEQ ID NO: 37042 - DNA, 22818 bp, Homo sapiens
ggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgaggtgaggatctgagcccggcgtaagggctaaggattgaggcgagaagcctaacccactccagtgtgggagaacgggcctgcggcctagcagccggccgccgccatgtgaggcagccgcgcctaggcggcccggagcggcagagccggcgaggactccggagccgcaggcttggccgcagcccgctttcctcagggcggcagcgctgaggcggacctcctgccgtggttggcgtttccggaatggagagcacacgttgagtcgtcctcccggaaggggctcgaatgcccggttaataaccccgaacgagactggggctggcgatccctgcattcctttctgctgggcactgccgccccagctcgcctcactgggtgccgggggtgccaggggtgccgcgaggagcctctcttggcttggtataacgccctcgttaaaactttctaggctatcttgtcggggccggtatcccgcccttgtttgccttcctagcattgttttttaaaaagacgagggggtgatggggttagaacgagagaaaaagattctgcagcctcaggaagtgactgaccttcccggaaagtttccgggcgagcccctgagcttcccttaacagagggctaccggcgacgtgagcgggaagtgcgggctgtgaaactggctggatctttttttaccgtggtacttggatctcagtgaatttcctcaaatccctttccctcagatttatcctagttgatataacgtctaacgacttaaaatgaagttgatgttaagtactcccagtaggtattgcttaacattgggggaggccccgtaagttgttgagaatttcctcaggcaataggaagccttgatcacaagggcaaaggaatggtcgagaaaggccagtaaatgtgctcacaggaagtagaataatctccagtttgattagagttaaggggtgaacacttgccaagcaggtaatgactagttcatggagggctgtgaagacgaagttaaggaatttggaatatattctggacgggattccagtctcttacttggttctcacaacagtcctgtaaaataggtctattgttgtgcccattttagagatgaaaaatttgagtgttacagagttgtataatgcccatgatcaaatactaagtggctaaaccagtagaattccagattgactaggatcttaatgggttagagaaactgaaagtttgtatatggtccttggcggttatagacattgctctaggctgctgtatttcaaaagttctgagagtggcagtgtttcacacttgttttgtttctactcatttttcaaacttctcataacctttggcaaatacagtacttacgtgtgcaagattccatggggtgttattctgtgtatgggtcaactagatgacacacaaggtagaaataggaccatcaacgtagtgacttggagggctagagggatcagtgggattaggctttgaaagaagtggaatatgaatgcattactgctggatgaacagaattttgtgaagcaaagatggcagaaccagcatttcggcataggactttggaagccaataaagtattagtttggccacttaggggtgccggtccaactgtattttacaggaaaccagggccgagggagattaacttgtccaagatcatgcagaaagttagtaggacaagaaccctggtctttggcttccattctgccaggtagaagttaggagtagagaggggtatgaagaatagggtatagggcctggttcctgtagtgctgttgactaggtaagtatttttaggccattcctttaacatctggctactgtacagacttgtgaggatcagataaaactctgtacttgaaaatgatttataaactgccaaggactttcccagagtggaagtaatcctgcctggtggtcaggctagacaattaaagaggctgctattaaaaagtaattttctgttttattcatatttctgtttttttttttttttttttgagatggaatttcgcactgtcgctggactggagtgcagtggcgtgatctcggctcaccgcaaccgcctcctgggttcaagcaattctcctgcctcagcctctcctgagtagctgggattacaggcgcctgccaccatgcccagctaattttttttttgtatttttagtagagacggggtctcactatgttggtcttgaactcctgaccttctgattcgcctgcctcagcctcctgaagtgctgggattacaggcgtgaaccaccatgcccagccttctgtttttgttttttttttttcttgatgtataattgaaataaactgcacacatttatttttaaacctggtaattaagccagaaacttgccaaaacataacgattttcaacctagtagaactatgattttttttgtttgtttttgttgttttgtttttttagagacagggtctcgctcttgtttcccaggctggagtgcggtggcacaatcatagctcactgtggcctctgtcacctgggctcaggggatcctcctgcctcagcctcgcaagtagctgggactacacgtgcatgctcttgcacccgctaattttttaatttttgtagaaatgaggtcttgctttgttgcccaagcttgtcttgaactcctggcctcaaacagtcttcctgcctcagcctcccaacatggaaccatgatctttaaaaagcagaatcctagaaatatggctgctacctggtaagggaaaagaaaaatcccctactcaataggcattcagtaattttcagactatttgttaaaagcagcatcaatatttaatacttgcctacttgctactaggtcccattcacaaggagtcagaacattgggttttcataaaatatggtaaggtgtttttgcaaaaagaagctttaaattaaaaaaaaaagtatttgattcaaaatgggatgtgtgttgtgtgaagttaatgaaacacaaaagaatacaaagaaaaacagcagaatctaagccaggcatggtggcattcacatgtaatctcagctactcaggaggctgaggccaggagttcgaggctgcagtgcgctataattacaattgagagtagtcactacatttcagcctgggcaacatagtgagactcccgtccctaaaaaaaaaaaaaaaaatcccacaatcctatcacacagagatggcaacacttagcatttgttctggtcacctttggaaggaacttttagatcaatgtcttgcttctctgtgggttcttttgtgactcacacctgcttctgggtatagtatgactataaagttgatttcttgggtaaggtatgatctatgagaggaagcttctaatttgatgagcatcagggtaattttagctggtataccttttctttgccctctccaatcaaacgtgagaagttgaaaatagaaaatttatgcttttgaaggctttgttgtgaacctaaaatataactcaagtgatctgtagttttccatatgtgcactgtcaacagctatttgcttttcaaatccaaactagtttcataaaagaaaaccaatttggagtgtagtcagcttataatttggaagctagacatgaaagtcttaaaaagccattttagtcaagactaacatggcctcatttttggggaggtctgctttgggtgctgcttcgggatccctggtccttatttgtaaactgtacttcgcaggatggtatgaataaaataaggcaatgagtatgtatgttaagtatccagacagtaattgagagagatgttaattatttcagtttatgattcctggatgtttattatcctttacaaggctacaaccaaactgtttagctgtagaccataaggtttttcaggggataagaaggcacttgtgaggctgtcttctggtgatatcaggatccttgccatcttcagtctgtcttgatgaataatggttaaaaggcaattaatattctagggaacttgatgcttgaaaaaatgcaataaatggatggtaatcccttccagaaccaaatttatagtgtctagagttttgtctgtccttttgccaagtctccctatttctagaatgaagatgaaatgtagctacttccctgtattattgcagtactccttgcagtgggggactctttcctctttgctcttctatcttggtagggacacttctttaagttggccagataatgttcttcagactgactgcatttcagatttaattatttatacagttggatccttgttaagggagaaaagactaactttgaaaatgctatgcaaataccatacttctctactgggcaaggacagtaactgtattaccttattacagactgtagcttggtttcagtctagttccattaatgatcttgggacataaataagtttatgttataatcaattttgggaagcttttgagagttttatatgtttgggaaattagagcacctgaattgatgaaatttcagtgataggaatcaagagaaaaccatgctttatgaatggtaaagtattatataaattacaattgctaatatttatcgagtacttacgtaccaggcactatggcaagtgttttacatttacatacttctttaaccctcccagtaaccttgtgtggtttgttgtcattctgctacttgtctccattttacacatgagccgtggaataacacaggtacaagccagagtcagaatttaaatctagtcagatgggctccagacttgtgcttttaaacactttactattaacgctgtccacagcagatcactgggcaaaatgctgaatttaagcatggtattaatagaatatggagagagattggtaaggggttcaggaaaaaaatacttgggatttgaatcaggttctatttgacttcaaagaccctgcactttctttttttttttcgagaccgagtcttgctctgtcacccaggctggagggcagtggcacgatctcggctcactgcaagctccactgcccatgttcacaccattctcctgcctcagcctcccgagtagctaggactacaggcacccgccaccttctgctaattttttgtatttttagtagagacggggttttaccatgttagccaggatggtcttgatctcctgacctcatgatccgcccgcctcggcctcccaaagtactgggattacaggcgtgagccaccgcacccagcctcctgcgctttctactctatcaggtgtctgccctgtatgttgtttaaactattatgtctagataacttttctttcttcaagtgatcagtgcaagcagatagtctacaaattataaattagtttttcacctactctatagtggacatttagataagaataagagaattttggggcaaggcatggtcctcacacctgtaatcctaacactgggaggctgaagctggtggatcatttgagcccaggagttcaagaccagcttggggagcatggtgaaaccccatcaatactaaaaatacaaaaaatagctgggtgtggtggtgcactcctgtaattccagctactcaggaaattgaggtgggaggatggtgtgagtctgggaggtcaaggttggattcagctgagatcatgccactgcactccaacctgggcagcagagccagaccctgtttcatttaaaaaaaaaaaaaaaaaagaacctttaatgttaaacaaaaagcagagtgaaatgttgtatagaggtttctcttactcagagatttgctatatgaagagttgctgatggatttccttgaagatttgtagttaaaaaaaattttgtttttttaatcaggtcaaaagtctctcaagtctctgtgtaacagccccaagttaccagccttgaataaaacattgatacccctggccaggtgcggtggcttacacctgtaattccattgctttgtgtggccgaggtgggaggattgtttgtgcctggcagtttgtgaccacctgggacaacagagggagaccccgtctctacaaaataaaaaaattagctgggcatggtagcacatgcttgtggtcccagctacttggggagctaagatggtaggatcacttgagtccaggaggttgaggttgcagtgagctgtgatcatgccactgcactccatcctgggcaacagtgagaccctgtttcaaagaaaaaacaatacaaaaaaatttacaccccgcttaggtattgttttcctatatctgtaaagtgaggggcatagcataggttgttgccaaagtcccttccctaaattccatgattcattcaaatgtccaaatttgctcatgaaagtgaaagtgaagtatctgtgatactttacaaattgaaagatgtgtacatgtttcagttcacctgatgtttaatagtaacaagaaggttgggtggacaatttattttattttttggtaaactcccctttggtgttttaatgtatcacatactcttttaagagtatgccttttgaggataaagcatatttggaatgtgagcatcattaaaaacaatcatttggtccctttttgttttttgtcttttaaacagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaaggtgcgtggttgatgtgagagagttactgttgtcatagaagccctggttctatgagcgttttggcttttggatatgcagcgacctctcagcctgacaaggctgttccagtgaagtcaaggccatcagtagtctgtatgcagtggacctttttagatttctgataggcttgttgcagggatgtttccatttaattcacaagttgcaaagatgaaaccttgctgttccagagctggttttccagttgaacccatcaggtctcttctctgactttttaatggtagttgtatttgagtgtgggcagaaagaaatggtactaagataggcagttttgtgtcttagcaagtctgaaaatgtatatgagagattaaaattatagcctaaagtatttggggttagacaccagctttagttacttacccctgtgctgtaacatagacataatttgactgttagagagaaatgtttctataaacattgtatgtgtctgttgaatataacactgtgccaggatagagacaactgacattcactgagcatctgccctgtgctaagtgtcttctacatgtttaaaacaaatttggaaagtaactcattcctgttgtaataagataaaatggatttgtaaatagtttcttgaaaaactttgtagcagaaggatcctaaaatatttctagtttataacatggcaggtcaaatggaaaacttgttgaacagaacctattattactcattaatggtaggtaaaatttcactgataacttgtatttactgcacagctgtattttaatgaatgtgaaataatttgttaggccttttgatgattagttgattcaataaaatgttgagctagacagtagaatttaggtgaacaaggcatatactcttagtattgagtagggagatagataagcaagctggtaataagtacctcagttggagtaagcagaagatactatccaatcactctggggatacctaacccagttgtggggaaagatggataagcttagagaaggctttggtggaagtaatttaaccaagatcctgtgagatggaggtaagagggcccacgggaaggtttgttggtgagagaccgcacgtatattgcagtaggaactgaaagtagttcagtagggttagaaccagggattgaagtgaggaaggcaagaagcagaagtggaagatttaaagttggagagttggaaattgtgttagagctctgactttgtcttgggaacagtgaagagtgatatggtcagattactaaataaatattctcaacatggtcccctaaccagatttttcctatagatctttgagatgacctaccattttgtttttcagaaccataacttttgtggccgggcgcggtggctcacgcctgtaatcccagcactttgggaggctgaggcaggcggatcatgaagtcaggagagcgagaccatcctggctaacgtggtgaaaccctgtctctacttaaaaaaatacaaaaaatttgctgggcatggtggcacatgcatgtagtcctagctactcaggaggctgaggcaggagaaccgcttgaacccaggaggcagaggttgcagtgagctgagattgcgccactgccctccagccttggcgacagagcaagactccatctcaaaaaaaaaaaaaagaaccataagttttgtgattgtggagggactaattaatagtcagtcttttctggtgacttgattaattgctgaactatgtttgtgtaactcataatttgatgctttgccttttagttgttaataattatgccttggtctttttagatgcttctgatgatctagatgacttgaacttctttaatcaaaagaaaaagaagaaaaaaactaaaaagatatttgatattgatgaagctgaagaaggtgtaaaggtagtattgctttcttgttgaaggtaaaatttgacctcttgcaaggttgctaatggctgatgtttccctctctttgactcatctcttactagctttgcttttgttattagcacttaattgccactggtagcgtcattttcttgggagtgtgtctgactaggtatcttaaagggattgtggttcaaggaatttaaatttaggtcttacatattgtattgtgtgccattaagatgatcacaaatgtcccttgtccttaactatactgagatttttggctgtggagaactatttctatgagtgagaaatccttctgagcaaatattcctttggtttcttaaacttttggtaacatattgaatatatacaaattgatatgtgtacctctaagcagcaaagaatgaaccacagtggtggttggtagctgatgacaatgtggcctgtaggcaaaccagagcactcaggctagttttatggagttctctgatcttgtggatacttgagaccctgtgagtcttattactgaattgatttctaatacaaatatctcaaaattcttttggacagggagtaagtaacaggtgggcaggaaggtgaataggagggagggtaggtggatggatgaaaggggaaggagctgaagatctgttttcctccctagagttaccattttaaagaccctgcctaggaatcactttagcagaatccacatgtctatttataaaacccaagataatagcagtacacacactcactcacatagagcgcgcacacacacaacagcaaacatacaccaaatatcttgtgccctctactcaaaattttctttgataagtagtttatttgctcaaactcaagtgaataaagtacatcccacatgtagcaggaaatgtatacagtaattcattgggttttagaaataatgtcataattttatgacagttaattcagtaaataagtatgagtgattacagcaagtcaagcttttgaagtattgtgtggtaattgctagagtactgaaatgagtaagatatttttcctgtttgcagagatattttggttcaaggataatttagaatccttgagaacaagctggttttatctggattcatcttgttctctccctgtttggggattctcttttccttctactatagggaaattgagaaaaatgctcagattataatcagaaatgggatttaaatatcctgggtaacagggcgacatgtagagatgtgctacagaaagttttggttaacaaggctttgttggttgattcctccagtagcttttattggaagattagttctaaataagtgcttgaatactatttttgaaggcataacataagaggatgttagaggtatcctggtcatcaggcaaggcacggacattcacttgaagggtttttgaggtcttgggctactctcccacctgaatttccagaccatccgagggcttttgaaaagccttgaaaaatgctttttgcagactggacgtgctgtctcatgcctgtaatcccagcactttgggaggccgaggtgggcagatcacctgaggtcaggagttcaagaccaatctggccaacatggtgaaaccccatctctactaaaaatacaaaaattagctgggtgtggtggtgcacacctgtagtcccagctacttaggaggctgtggcaggagaatcgcttgaacccagcaggtagaggttgcagtaagctgagatagcgccactgcactccagcctgggcaacagagcgagactctgtctcaaaaaaaaaaaaaaaaagaaaaatactttttgctgttctccaccttctgctgtgtcttggtgtcaatatggaagtagatcttactgggataaaataataatagtatagcactagaagttggctagtgtatgctaacttatattcagcatttctaagttcttatttattgacttagagactaggtgagtatctggtgtcctgtttgtatggtatgtagctaataccatgggcagatttatttatttacttatttatttgagacaaagtctcactctgtcgcccaggctggagtgcagtggcgcaatctcggttcactgcaacctccgtctcctgggctcaagcgtccctcagcttcctgaatagctgggtttacaggcacccgccaccacgctgggctatttttgtatttttggtagagaggggtttcaccatgttggccaggctggtctcaaactcttgaccttaggtgatccgcctgccttggcctcccaaagtgctgggatgacaggtgtgagccactgcgcctggctggcagattggtcttgatagccacatgtggcactaagactacacaactggatttgggatcccgaatctgagctttatttactcccagctattccaacttttctgctggtaagatttctgaaatgactgtagccattgtcccaggtcaggatgtaggcacacacaaaatagatattaatgaatgagtaaggttgacagcacagttcaggatagggagctggataagctggtagaaggaaggagaaatcagaaagctggaaactgagactggccttttctgctcttctgggatgtttatgactcatttctaggttttaatatgccctgtttacatccatgcctctggcaactaatcttggggtcaagctttactttgtttccattccattccatcacttgatcctaattccccatggcttctgcctttccctctttgataatgtcatctattggagtgatgcccaaagaccacgccacagactggtgccaggctgactgtcatataataaaaaataaatatttgttctttacgttcttggctcacaactgctaaaatccttggaatctccgaagtgataacagggtctttggtacgctaatgagatttctgaaatgactgtagccattgtcccagttcaggatgtaggcacacacaaaatagatactaattaatgagtaagggatcccttatctggggatctctagatagctttaggatgggggctggtcaccagaaggacaaagctatgattttagagggttggaactttcagtggtccccctgccacctccagagagggaaggtgtggagattgagctcagtcaccagtggttaataatgtaatcagttggccaggtgcagtggctcacacctataatcccagcactttgggaggcccgggccggtggatcacctgaggtcaggagtttgagaccagcctggccaatatggtaaaaccccgtttctaccaaaaatacaaaaattagctaggtgtggtggcgtgcgcctctagtcccagctactcaggaggctgaggtagaagaaccacttgaacccgagaggcggaggttgcagtgagccgagatcatgccactgcactccagcctgagttacagagtgatactcagtctcaaaataataataataagaagtaaataatgtaatcaattggtcatacctttgtaatgaaacccctagacatgggttcggagagctaacatgctggtgagcacagcaaggtgctaggagggtgatgtccctggtgtggcagctccacgcctgccctccttgccacccctcagctcccacccccataacttgtcctatgcattgcttatgtttggctgtttgtgagttgtatcctttataataaattggcagtagtaagtactttcctgagttctatgagtcgttttggcaaattattgactcttgatggcgaatgtgggaacttccgagtttatagccatgttggacagaagcaggcagcatgggaacccaatacgtggtgactggcatctgaagtgaaggcagtcttgaggaactgagcccttaaacctgtgaaatctgatgataactctggatagtgtgtgtctgaaataaactggaggacacctaactggcattggagggttggtgtggaaaaacacatatttggtgtcacccggaaaaatctttcccaatgactatatcaaaatcacttagaaacttctttaaagtactcctgaaccctgttcctgctgaagatcatcaatccgatttaaacttttaaattttctcaagtgattcttttttttttttttctttgagacagagtttccctcttgttgcccaggctggagtgcggtggcacgatctcaactcactgcaacctctgcttcctgggttcaagcgattcctctcaagtagctgggattacaggtgcctgccaccacatccagctaatttttgtatctttagtaggtgtggggttttaccatgttggccaggctggtcttgaactcctgacctcagggatccacctgcctcgacgtcccaaagtgctgggattacaggtgtgagccaagacgcctggcctctgccgtgattctgacagtagcctggtttggaaataaggacaataattataagatcctaaggctgaagaataaagagatgaatgagggggaaagatcccacaagtgtcttgaagaattcacagttcaaatggcagagtctctgtgagccagtttggtccatttctgacaggcgtttcttatctgtaacttcaattttgaatatgtgatttttttccctgccaaaataatgtcagcccacgtcatttttaaaaaagaacaggctgggtgtggtggctcatgcctgtaatcccagcattttgggaggccagggcgggaggatctcttgaggccaggagtttgagactagcctgagcaacaaagcaagacctcctcatctcaacagaaaatgtaataaaataaataaaaaagaatagtcccagtatcaaatgttcagactcatctcactttcttaggatcttaagattgaaagtgatgttcaagaaccaactgaaccagaggatgaccttgacattatgcttggcaataaaaagaagaaaaagaagaatgttaagttcccagatgaggatgaaatactagagaaagatgaaggtaatgctgaggactcagcagcacatttagaggttactcaagcctttggccctggtctccttgatgggggtggagggtgcttttaaaatttttttcttgccccttatttctactgactgataatggaagcgaaaggaaacagtgtttggcttgataatggcagttaaagaatttgttaactgtgattacattaaaaacatactgattcaggcttgggaaaattactataaccggattttttttttttttttgagacggagtctcactcttgtcgcccaggctgaagtgcaatgacacgatcttggctcaccacaatctctgcctaccgggttcaagcgattctcccgcctcagcctcccgagtagctgggattacaggcattcgccaccactctcggctaattttgtatttttagtagagatgggagtttctccatgttggtcaggcaggtctcgaactcccaacctcaggtgatccgtccgcctcggcctcccaaagtgctgggattacaggtgtgagccacagcgcccggccccgattttttaattaaaaaaattttttaaactcgtgtttacagttttattagtttctaaatgctatagggtctttagagaacttttgtcagtagatgagttttatggatgttgatgtttcttaagtgctcaaaacagttggactttttcctctaattattccaatgcattattttatctttgatttgttaaattaagaaacatttcagtatgttatcaactcctaattagagaggtctctattaagggccttttttgaaagtcataacatccctgtttctaaggaaaagggttgtgagctttggtttctttatgcttaaggctgttgtgaatgcagctgtggaagggaagacagatgtctttgaaactcttcatttctctagacccaccccacttttgtattgtagtagggcccacccctcattcttaaaatcttttttatctgtagctctagaagatgaagacaacaaaaaagatgatggtatctcattcagtaatcagacaggccctgcttgggcaggctcagaaagagactacacatacgaggaggtaagacaaaatctgttgtgaaaaggggctaagctattcactagtgctcaaagaagagcaagataaatcttattggaacggccgttgaagtaatgactgatggtggaacagatgcagagaggtcacacagccagtgcacagcaattcctggtgcgcacccgtggggcagcctgcccagagtgcagcagtcattgtagtactactcactgtccccacctgaatttgtggactgctgagggcatgcagccctctaggaattaggagggcagtggtgaattagctaatttagggccagggtagtctggagtttgctagtttgggctttcctgaatcttacttttccatgtatcatgtactttgccatagaaacaacagaatgagtggttgttcattcatttcactttggacaaggagttgctgagcatctataatgaaccaaatgctggttggggatgaacctctgccctcaaggagctcccagacttgtagtaatgcatgtgtatatttaatcagaagtgaagtatttgctgttaagcaacatgactcaaaggggaactttatacccctgcagttactaagcgtattcatgaataccactttatttttatagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactgtaagttggttaatggagtaccttcatcccaaatgccagattctcattgcagttttaagaatgttaaatgtccttattgtcgactttattatagatggaaagaacacacaggtgtaggggttgagggagttcaccgttcaagcctgtcattttcttcaattcataagtctcagggctgttttattttattaaagataacggtcttgctttgtcgcccaggctggaatgcagtggagtggtcatggctcactgcagcctcaatctcctgggcttcagcagttctcctgcttcagcctcctaagtagctgagactacaggtgcacaccaccatgcccgaccaatttaaaaaaatttttttttttttttgtagaaacgtgggtcttgctgtgttgcccaggagggcttgttttattagtgcattcagaggtgagagaaatcaactcatgctgacccactgaggatggatcctaactagatgtagtgaagagtgaggaggctcaatgtagttctcaggagccttgggagcccagggagtggaaaggctcatcagttgctctaggataggcctgccaagcaagcagtgagctcagggaaagtgcctgaatttgggtgcctcttccttggatgatcattgccaggacacaattgatgagattgtatctttcttaattaccatcacattctatgccagagtcagccctgggttactgtctgggaatggcttttctctgagctcctcagctgcatgttttctggcagtttccttaggaccactgagtttatccactctttgttctttaatttcctaagtgctacatgcttgttgtagaaaatatggtaaacacaaaagagataatattcactcaaaattttaccacccagagataaccacttgttgtcattacttacatatatttaaatagtttagatttttttggctaatgacaatagtagtatatactcattgtagaaaaattagaagataaagacatgctaaagaaaatggaaaatcatctgcaaagtccaccattaagaggtagataactgctgggcgcagtagctcacgcctgtaatcccaccactttgggaggccgaggtgggcggatcacaaggtcaggagttcgagaccaggctggccaacatagtgaaaccccggctctactaaaaaatacaaaaaataagtcaggcgtggtggcacgtgcctgtaatcccgctactcgggaggctgaggcaggagaatcacttgaacctgggaggcagaggttgcagtgagctgagattgtgccattgcacactacagcctgggcaatagtgtgagactctgtcaaaaaaaaaaaaaaaaaaaagaggtagctaacttatcatagtttaatatttttctgtttagccagttttatgtacatattttaaaaataaattgctatcatactggtttttaacctattttctcaatatattgtgaaagttttactcatgtcattagtctgagtaagtgttttaaatagctacacaacatattttaacagttccataagttggacgtggctgctcccaggtttttattatcagaggcaaaacttcaccgaacatctttatacatgtatctttccagtagctcagaatagaatcttaaggcaagatgaaattgctgagttaaaaggaatggatatttttatggcaaacattagcacattgctttctagcaaggtcgtgccagttcatactcccgctagcaatgtaggagcttacctattttattatatttttaccagttctcacctattgcattttggggaaaaaagcttaaaaattgttgtagttagcacctgcttgttggaacaagttcagtgccacagtatagatttaaaaaatgaaatgaaaatattgaatggcattgctctatatttgtgttttttattttatatgtgtatgtacatttttttttttttgtatattgagatatttctaaaagtagaatacacccttgaatggatttatttaaccactcctctagttggtgaatatttaagatgtttccatttttctgttgtgctaccatggaacccttctagacatacactttcttttaatgaaaattttacacatgaaatatatatggattaacatatatatttattagcctgtttgataacatccaagtatccatcacctaggtttggtatatgttgaacttttgacacatttgcttcagatttttttacttctttaaaaagaaggttttatgctattttatgatagtctcaaaaacaaaagaaaaaggtggttttatagttataattaaggccacctttgtatcttttcctggcccctttttccttcccagaggaagttgttattctctgaagtcggtgttgatgttttccatccttgtttctagatgcttacgcacatgtatgtagtcataaaatgtaatatggtcttatgggcattgaagtgtaaacaagtgctatctggctcagttcacatctgtaatcctggcactttgggaagctgagacaggaggatcatttgagaccatgagttccataccagtctgggcaacatagtgagaccccatctctacacaaaaactaaagaattagacaggcatggtggcacacacctgtagtcctagctacttgggaggctgagatgggaggatggcttgagctcaggagtttgaggttacagtgagctatgatcatcactgcactccagcctgggcaataaaacaagaccctgtctcttaacaataaaaaaagtggtgtcatatactgtatctttatttcaaagtttaaataaatggtgcagtgaaattcacttaatagctaaataatcacagatcaaaacaatgaacagattttttagaagtttggtgagatttccatgagagataaggtttatatattttgattttctttttagattacatcgtcagcccaaacatctccttgcatttttgttggctgaattgggtacaaggtaagaaactgtatacatttacatacagtactgctggacatttcataagaacctttcttgaaaaggatatgtaacacacttagagaaaatgttcacctgattattagagaaacttttaggccagtggaggagtgaaatcacttcatttctgtgggagagcttggctgcttaggaatagggcacagagttgacatctgaacaggcctgctggtgtaccaaccagaggaccacagaactgccatgtttagactttcctgttactaactgaaactcttgagtctttttatggagcaaatattagatttttagaggaattggttttcttaaagtcagacttttttttcctaaattggtaacaggctgttgaagaaatacagctagtaagttgatgagtggcactggagaaaccattgaaaccaggatctgtgatgaaataggtacttacctgtcttcagggctcaccttttgaaggcactgagcaagtcattcccattcaggaaggccaagatctcatggaccccatgccaatgagtttgactactatctggaagcctaatgtccctttaaaaataagtaatgtagagtaggtcatgataatgatgactaatgcatattgagcacctcttttgtgccaagtgcttttttgggtgccatctcaattaatcttcacaatagttctatgaagtagaaagtaatattcctatcttcacgttcggaaacaggttcagtaaagtgaagttgtagttggtcacatagctagttagtggcacagtcaagatagatacaatcaggtctatctgtccctgcagcttgatcacctaacaggcttgacacctgtgcgtcactggcagtacagagataattaaggtgttctcttcctactctctttaaactgttgggatttgctacacttggtgtggggttaaggggtaatttacttgaccgtggtggatacgtaggctctgttgtagaagaattgtgggttttgttgttttgttttgtttttttgagatggagtctcgctctgtcacccaggctggagtgcagtggcacagtctcggctcactgcaagcctgcttcccgggttcatgccattctcctgcctcagcctcctgagtagctgggactacaggcgcccgccaccacgcccagctaattttttgtatttttagtagacgaggtttcaccgtgttagccaggatggtctcgatttcctgaccttgtgatccgcctgccttggtctcccaaagtgctgggattacaggcgtgagccaccgcacccagcatgttttaaatataaatttgttaccatcgttatttgtaacttgcacaaactaatgagggagcaaaagctagcattgttttttctattgttagaataatctagaggttttgttagaggtgggataaactattataacaagttgtggccagtaaacttatggtcaatgggttaaatgggttttcgagaaaattccatttattttgacagtgaatgaaaaagaatttctacatcaagcattgcaatcactgtagcctggagattaagggttacaatctgtggaggaggaaatttaaccctgcttgactgaattttgttgtttcactttatgatttataattttgaatgaatgataatatctagcctagagctttgctttctcaaaagtgcctgtcaacagtttcctatcagtttatcattaagtaccattgacagtttgtggcttgtgattcaactatcctttttttttcttcaaacagctttattgagataacagcttacaaatttaaagtgtataatccaggagagtcccactcggacgtccgtctctctcgcaagacagagctattctttctcttttgcctattaaacctccacccttggaccccccccccccaaaaaaataaatatatataaataatatatacaatccaatggggtttttttttttttttgagatggagttgtgctctgtcgcccaggctggagtgcagtggcgtggatcttggctcactgcaacctctgcctcccaggttcaagcaattctcctgtctcagcctccccagtagctgggactataggcgcccaccaccacgcctggctaatttttttgtatttgtagtagagacggggttccaccatattggtcaggctggtctcgaacacctgacctcaggtgatcaactcgcctcagcctcccaaagtgctgggattacaggcgtgagccaccacacctggccccaatggtttttagtatgatcacatattaaacttaatatgtataactgctaccacaatcaattttagtatatttttatcaactatacttctaaccatgcctgaatcaaaatatttggtgcttagaattttaaaaaacaaacgtagcccctttcctgtttttatatttctaggtctctcctttgccttgctttgtacatggtatgatgcagtaaaagattttttcctttgttggatggactgtcacatacaatgaaggaatcagtttgttttagacttaaaatcaattataaatctgattgttatcactggagatttaattggatttgatgttagtatgggtacatcattagacgcaaactatttaattaaaaataaattttgaggctgggtgtggtggcctacacctgtaatcccagcagtttgggaggccatagtgggaggatcacttgagtccagtagtttgagaccagcctgggcaacatagggagacccctccatctctaccaaaaaaaaaaaattagcagggcacagtggggagtgcctgtagtcctagctacttgctaggcttaggtgggaggattgcttgagcctgggagattgaaggtgcagtgagccatgatcacgccactgcactccagtctgggcgacagagtgtgagaccctgtctcataaataaataaattttgggaaaccaagtagtatagcaccagtcctagagtttatcctatgctactgaatatattttaagttcattaagtttaaaggtgctggaatttggttcctttaggaaaaaacaataataatggagatatttttgttttctttcatagtggttctatagatggtaataaccaacttgtaatcaaaggaagattccaacagaaacagatagaaaatgtcttgagaagatatatcagtaagtgtataattcatttcattagatcaccctgaaatgttctcatgaggctgcagtgttagaggaagagccatttgattgcagtgagctgggaaaagctggccttaaaaagatcagagacaaaatgatagtgaaagggaggtggctcttgcctactaactaggggtatagatagaaaaggatttggatttttaaagaaagcccagctgattgaagctgctggttgattgtagggctgaaggccaagtcagagaaacttgcctgtgattcaggcctggccttggcccccttttgttcctagttatttaaaattggcatgtctgtcaacatgtttgagtggctctcctctagacagaaacgagaataagcaagctggcaggcttccttgcatcctggggcattgagtatcagcccatgtttagtgccggaagcgccacagcagacagcttgtgttttcttacccctcgaatagctgcgcttccctggtctgggtgcccagctaaattctcagcctgggcttgtggagttctttgtagatgtatttaagaaggcagaaacttctctacctcactgcagccaccaggtaattctgtgtgttgctttatttgcagaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa
